United States Patent 8,781,750 (CELL-TYPE-SPECIFIC PATTERNS OF GENE EXPRESSION) - sequence listing, part 7

SEQ ID NO: 35971 - DNA, 46630 bp, Homo sapiens
gtagtggtgccgacttcctgttgtttgaggccgggttgggggtgtgcgattgtgtgggacggtctggggcagcccagcagcggctgaccctctgcctgcggggaagggagtcgccaggcggccgtcatggcggtgtcggagagccagctcaagaaaatggtgtccaaggtgaggctgcgacgcgctcgcctcccagggcgcgcccaccgctcccttccgcgccctgtcgagtccgtcccggcccagccaagcaagcttcccagacgggccggaagccccggtgcagtccttagcgacctcctcagaaccccgccccgaggcgcctgtcgcctggtgcgggaatccccgtacgggagctgggagggtgggggacggcgacagtcaacaaaggcgtggagcggaggctacctgacacctgccgcccacccgccctcctctcttccactgagtttggagctgtctgtggggcagtgtagtttttcgtttgtttttataaacacaaacaagggatcatacttagttgtagatctgaggcaatcctctactcctgtcccaatctagggatcctccagtcttagcctttcttttgccgacccgcagagagtgtggccttttcagttttgtattctccagaaaagaagcgaaaataccagtcccttactgccccaggtgaaatacataccattaccatttcagggattttctaagagtaactacttttaagtgtatgcttcttataacgcgtatttatttgctttgagcttaatttatgatcttcacggctcaagactagtgttttttttttcaatttttaaaaaagcagttaagcattttgtattttaaagccatgatttatttatataattacttcaaacgtggcacctcacaccagagtggaatggcttttgttatgttttgttgtaattttccaaaactatgtaaaatgattgagagttgagtcttgaccagttcaacgtgttagcttgggatagttttgtcaaagcaagaatggtagcaatcagcggtttaagcggtttcaatttttaataaaacacactattatgtgtaaaacttttttaaaaacagactttttccagttaaatcgcccccatagttcttgattgaagaccaaataatctctaaggagaaaatgacagctttcaaaataaagcatatattggttgtgtaatcgtatattttaggcttcttggttttgttttgataaacttgttatccttagttatagaagacatatgggaagccatagaagattgtgacccaggtaaagatccatgttgtaacttttatatatcactttttgaaaaaaacggtatattgttttacatagtatgtaactgaagagtatctgttccatgactcttttttttttttttttttttttagagtcttgctctgtcacccaggctggagtgcagtggcacgatcttggctcactgcaatctccgcctcccaggttcaagcgattctcctgccttagcctcccaagtagctggggattacaggtgcccaccacttcacacagctgattgttgtatttttagtagagacgggatttcaccatgttggccaggctggtcttaaactccagacctcagtgatccaccgctttggcttcccaaaatgatgggaatacaggcgtgagccaccacacctggcctccatgacatttttgatctttaaattgatagcatagtcattaagatttagtccttgggctgggcgcagtggcttacgcctgtaatcctagcactttgggaggccaaggcgggtggatcacctgaggtcacgagttcaagaccagcctgatcaacatggtgaaaccccgtctcctaaaatacaaaaattagccgggcatgatggcgggtgcctgtaatcccagcctactcgggaggctgagatgggagaatcgcttgaacctgggagacggtggttgcagtgagtcgagatcaggccactgcactccagcctgggtggctgagcaagactccatctcaaaaaaaaaaaaaaaaagatttattccttaatgtatgtatattcatataaagagcaagaatattcaaatattagcttattttttataccctaattaagtttcctaagcttccctagagaaacctgccatcaaagacaaaggcaaggcatgttcagaagatattttatacctctacctgccttcccctccacccaacctgtgattactttagaaacaaaaacagaggtagggaagaggtgggagagggcatcctacctgccttttggtccttgactcaatatctggaaaattgagactcctgtatgtgattatgacgattctgagcatcagcattagtactgtccaacctatgaattttagacaggtaagaataggaagtaaagtaatagaagcagttgtggggctccttcctcctaaagaagggcttcaaatgttttcctttcagctggtgtggtctgatgtaagaattgttagccaggaccctgaacacatagctagggtgaaggtcattattgttttctctttatctgattgtaggctctccacacacatcatggtactctggccacctgccttatgttttatgtgtttattataaaaggtctttttttcccttgagcattatcttagctcccaacttcaacataactttcaacacctttctctgttatttttgcaattaacagatatatttataccagattagtccttcttcttttacagaaacaacttcccactttagatgtttcatacatacagccacttatatttttacatagtttatctacagcatttctagaggcacagtcactgctaaatgagtagaagaaaactgtgggcctggtgtggtggctcatgcctgtaatcccaatactttgggaggtagagatgggagaatccacttgaggccaggagttcaggatcagcctgggcaacatagctagactctgtctctacagaaaatttaaaaatcagccagacttcgtggcttgcacctgtagtcctagctacttgagaagcagaagcaggaggatcacttaagcccaggagttcaaggttacagtgagctatgacagagaacctgtctcaaaaagtaaaaaataaacattttaaactataacaaaattggccaggtgcaatggctcatgcctgtaatctcagcactttgggaggctgaggtgggcggatcacttgaggtcaggagttttggaccagactggccaagatggtgaaaccccatctctactaaaaatacaaaattagccagacatggtggcgcacgcctgtaatcccagctactcgggaagctgagaaaggagaattgcctgaacctgggaggcagaggttgcagtgagctgagatcacgccactgcactccagcctgggtgacaaagcgagaatccatctcaaaaacaaataaataaataaaaataataaaataaagattgatatgtccctcactgttttaggttctagggatgcaacagtgaacaatcagacaaagaaactgtgcttctggaatttaaattcttatagaaggcaataaacaactcaataaatacatcaagaagtacgttggaaagtgataagtgctttagagaaaataaagcagggaagaaatggggaatgctagggtgtggaaatgggatgagtcaccgttttatatctgatagtaaagagaggtctttctgaaaaaatctacttgagctcacctgagagaggtaaagaaactgtgtgcttgacatggggcttacacctgaaatccaaacattttgggaggcggaagctagaggatcacattgaggccaggagttccagaccagcctgggcaacatagcatgaccttgtctcttctctactaaaaatataaaaaaattagccaggcgtggtgcatacctctaatcccagctggttgggaggctgagatgggaggatcacttgagcccaggagtttgaggttgcagtgagctgtgatcacaccactgtactccagcttgggtgacagagcaagatcctgtcaagaaaaaaacaaacctggaacaatctggggtaagaacatttcagaaggaaggaaaaacaaatgcaaagactcatagacagaagtttgtcatgcatgatagaggaacaacaaaggagggtatggtggctagactggagtgagcaagggaggaaagtggtggtatgggtctagacagcatcaatggtatgggaggtttggagggccttgcaggccattgtaaggaccttggcatttacttggagtatgatgaaaagccgttgctgtgtttcagctgttagcaatattactctagatgctatgctgagactagactgtagggggttaacgatggaggcagagacacgtaaggaggctgttgcagtaatctaggtgagaggtgctggtggcttagaccaggactgtagctgtggagattccggatgtattttgaaggcaaagctaacaggatattttgacagatttgctgtggatgtgaagaaaagagagggcatcaaggataatgtcatggtttttggcctgagcacctggaaggatatgtatgtatacacatatggaagacactggagaagtaaatttggggagaagatgaggagttcagttttggtcatgttcaatttgacatttattagatatccaagggaaatgtcaaattggtaattgtatatatgttttctggagttcagagaagaggttaagattggaaaattttaatttaagggtttcaacatataaattaattttcaaccatgagggagatcaaaggaatgagtttagatagagaagaagaccaaggacttagcctgtgctcaataataattggttaggataagagaacgaaccagcaaagagactgagaaggcacaggcacagagtgcaggagaacagttgatgtcctggaaatcaaatgaagaacatgttttaagagaaagggagctgggcatgatggctcatgcctgtaatcccaacactgtgggaggctgaggtggacagattgcttgagtctagaaattcaagactagcctgggcaacatgctaaaatccagctctatcaaaaatatacaaaaattagccaaacactgtggcgcatacctgtagtcccagctacttggaaggctgagatgggaggattgcttgagcctgggaggtggaggttgcagtgaactgagatcacaccaccgcactccagcctgggtgacagccacatgctgtctcaaaaaaaaaaaaaaaaaaaaaaaaaaggaaggggccaggtgcagtggttcatacctgtaataccaacactttggaaggctgagttgagaggatcacttccaggagtttgagaacagcttgggcaacatagtgagatcctgtctttatgaaaaatttaaaaattatccaggtgtgatggtgcatgcctgtagtcccagctacttgggaggcggtggtgggagtatcacttgagtccaggaggttgaggctgaagtgagccatgatcataccactgcactgtagcctgagcgacagagtgagaccctatctcaaaaaaaaaaaaaaaaaaaaaaaaaaaggaatcagtttggtcaaatattgctgaatcagcttggtcaaatactgctgacaggtgaagtaagacaaaggtagaattggtcattacatatcatgtggcagttattggtgaccttaatgaacaatttcagtgaaatgctgagtgtagaagcctaattggagtggatttgaagagaccaggtctctagacgttgagcatcagtggttgctgatatcacagagatactcagatatattgtgctccatgatgaaaaaacgttatcctctatgaagtgatcttaccagagaagaggagaaaaatataaaagcaaattttttttttttttttccaagacggagtctagctctgtcacccaggctggagtgcaagggcacgatctcggctcactgcaacctctgcctcctgggttcaagcgattctcctgcctcagcctcctgagtagctgggattataggtgcggaccaccacgcccagataatttttgtatttttagtagagatggggtttcactgtgttggccaggctggtctcgaactcctgacctcgtgatccgcctgcctcggcctcccaaaatgctaggattacaagtgtaagccaccacgcctggccggaaattttgtaatcatgaaaataacctctagatccaactaactcacagaaacatatatctatgaaactatactaaagggatacaattaacacattccaaactgtgagagcctctgtaggacaaatgaacaaatttctttaagaaataaattctaaggagcaaaaaagagatgtgcccatcagttaagtatttttcagctgaacagtaggtgaataaaatgttcagtaagaagtgggccatacgtgcctgtaaatcccaacactttgggagcctgaggcaggaggattgcttgaggtcaggagttggagaccagcctgggcaacatagcaagaccctgtctttacaaaaataaaaataaattagctgggcatgatggcacatgcctgtagttctgtatacttgggaggctgaggcaggagaatcacttgagcccaggagttcgaggttacagtgagctgtgattgtgccactctacttcatcctgggcgacagagcgagaccctgtctccaaaataaataaaaggagtgaaatacagataaatgctacaacgtggataatctcaaaaacatgctaagtgaaataatttagtcatgaaagatcacattgtatgaataagcaaatctgtagagacaaagtaaattcgtggttgtctaggatgaaggctggggacaagtagaatggggggtgattgctaaagggtatggatttctttttagggatggtgaaaatgttctgaagttgattatggtggtggttacacaactccaaatgtactaaaaaccattgaactatactctttaaatgtgtgaattatatggtatgtgaattatatctttaaaaagctattaatggtgagttaaataatataaattattgagacgttttaaccaatgcaatgtgtggactttatttggatcctgattcaaactgagaacataaaaaacatgacttgagactatagatatttactgatgttaagaaaatagtgattattttagtgtgataatagtattatgggttttttaggttctttcaggctttcattaatgttaacaattagtggaagagattttaagaaaattcatccagctgtaaaatatatgcattggttttaaactaaattcttatgcgattttgcttttcagtacaaatacagagacctaactgtacgtgaaactgtcaatgttattactctatacaaagatctcaaacctgttttggattcatatggtgagtttatgcagtaaaaatagcaatttctatactttgagtttactctctttgttaatgattgtaattttttccatttgaggtttgtggatttttcaattgtgggattgcaccaccgcctaataaaactgttggagggtagcaaattagaagatctaataaaaacatttcatatttctttagttttagttttttatgttaaaaaaaaatactgtacctggatgtggtggctcatttctgtaatcccagcactttgggaggctgaggtgggtggaccactgagcccaggaggttgagaccagcctgggcaatatggtgaaacctcgtctcaacaaaaaaatacttaaagttggcctggtgctcctgtagtcccagctacccaggaggctgaggtggaaggattgcttgagtccaggaggcagtccaggaggcagaggttgcagtgagccgagatcgggccactgcactccagcctgggcaacagagcaagaacctgtctcaaaaaaataaaaaacaaaacctctaacatagaactatgcaaatttaaacctaggaggggatgttaaagataatttagtccatttcccaaagtgttgtctgtagacccttagttatgctgggaacaggggtagaggcagaattctatagttaagcttgagcaacttatggattaaacaaaattgagtttcattgcatgaagatttatcagagcctttagtatgctaatgtgttgtgtatcaccgagacgagcaagaatatattgtataatacatcctaaagttatttaactgctgaacctccctgcccccatagtgtctctttatattttcaggaacacattttgcgaaactatactctggactgtccctttcattttatagatgaggaaaatgttatttaatgtggtctttaattctgtagagtaggtaagcataacagtttgtctctactttctattgagacaaagttgtaaggcaagacaacgcttggagttttccttattttaaaatagtcttttctgtccctaccaaatcctaacataatttcttcaaccctgtctccttgaaaataatatgccagggccgagggaaaacccatgctgctgcttgtccattgtgagtcccttagctctgaaagcaaggaactgaattttgtagctgagactttctaaatttcatttgcttccaaggctttgaaaacattaggaaactggtgaagagaggtgggaagcaacagaggggcaatcagttctgcatttcctgaacaataaagacatgaacccaaagtcctcttccaaacctaggacacgattccttctcatctcagcctaccttatttctgtctgcatactatatgtacaatggtattttgaactacaaaggcctcacattaccaaaattaaagttagtttttaaatggcttcagtggggagaaaaatggttggagctagaattttatagtttttactgcatataaaagaataaatacatttatcaaaactgacaaagactccattataaagtcttgtatagtttcatgtggctggactaagtgtaaatcattgttaacaaatacttttagagtaaacaaagccccaaatttatataaggtggttttcttttttaaaatgcacaaaatcagaatacattgcggtatagcttacattcgtcaacagtaagtaaaataacaaaggtcaagaatgtacagtcgtgcattttgtagtgatagagatatggtctgagaaatgcattatttggcaatttcatcattgagtgtacttagacaaacctagatggtatatcctactacacacctaggttatatggcatagcctgttgctcctaggctacaacctataccagatgttactgtactgcataccataggcagttgtaacacaatggtatttatgtatctaaccgtagaaaagttacagtaaaaatacagtattataatcttatgggaccagtgttcttatgtgcagtccattgtagacccaaacattacacagtagatggctatagttctatgtttttgtactgcacattacaacctttcctctatgggtatagtgttaattccaaattattgttagaaataatagctgtccaatacaaactatgtgccatattaattatagacataaattatagatagaaaaatgtgtgtggtatgagaaatacagattgaaagaaattgtttatatttggctatgaacttttctttttttcattttaatactggctaaggaggctgaggccaggagaccatttgagtccaggagttcaagtccagcccggacaacttagaccccatttctaaaaaaaaaaaaagctgggcatggtagtgcacgcctgtagtcccagctacacggaaggctgaggtgggaggattgcttgagcctagagtttgaggatagcctgcacaacatagcaagaccctgtctccaaaaaacaataataaataaataactgtgagcgactagggataaatgtctgcacatctctaaaatagaaagacagtaggttaacatttagtatggtattgtttgatagtgtttttttgtttgtttgtttgcagtggagttttgctcttgttgcccagactaaagtgcaatgggcacagtctcggctcactgcaacctctgcctcctgggttcaagcaattctcctgcctcagccttccgagtagctgggattacaggcatgtgccaccacgcccagctaattttgtatttttagtagagatggggtttctccatgttggtcaggctagtctcaaactcctgacctcaggtgatccacctgcctcggcctctcaaagtgctgggattacaggcgcgaaccaccgcgcctggccgatggtgatttttaaatagttttaaaagtgactcacacctgtaatcccagcactttgggaggccaaggcaggtggataacgaggttaggagttcgagaccagcctagccaacatggtgaagccccatctctactaaagatacaaaaaattagtcaggtgtggtggcacgtgcctgtaatcccaactactcgggatgctgaggcaggagaatcgcttgaacccaggaggtggaggttgcagcgagccaaaatcgcgccattgcactccatcctgggcaacaggatgagactctgaaaaaaaaaacaaaaaagagctgatcaatgacattgagtgaatcaacaaagaattgttagttattggacaggatggatgatacattgacaggtcagcccctttcaaggataatgatgaattttaaccagtctttctgaaagaataacttatgggagtatcttaaaaaatgctcatgattaaatcattgttctttcctttcagtttttaacgatggcagttccagggaactaatgaacctcactggaacaatccctgtgccttatagaggtaaatgtcttattaggtttccagcatagatgcattttgaatacataataaatatgttgccaaagagttataaccaaattaaacctactttctcagggctttgatgctgatatagattttaacttctattcaaattgaagttcatttggcagtaacacctaacattttcagctttcttaaaacttccttaccaagatatatgaacaaataagtgcctaagttcaccagaggagtttaatgtttcactgaatcaaataattgtagaactagaaatggatcttacttgcctcctagttcagcctcccacaccattcaaactttcctgacaatgggaagctaagatataggcttcaaagtcaggacagagttatgtttgagttcttgctctataatcttagcagttttgttacatgttatatatggatatctttgacatttggataatagtacctaacttgggggaagtgagcatttattagataatgaatgtaaaggacgtggcacagagcctggaatataataagcagacagttaaaagtagctgttatttatggttgtgatgttggtgataatgctaatgatagataattgatctctgttagcctgtctttcaccctctgctgaaatatttagtggtgaggaagcatttagcttaatgagagaccattttgtttttggacagctctgtttgttaattattccttgtaattagctaagacctatgtcctttacccattgatttcacatagtacctgctattcataaggcaataaggataggagctgtggctacaaagatgaataaaggatgtacctcttctggaagaactccactaataggggaaacaaagggaacagatagatatttacactattctgtaactgctatagaattataaaatgaaaaagtgctatgagattacagaggagaacaaggccacatgggaagatcacagaggaagtgacatttgagccactattaataagtcaaccattcataataaacagagggaaaaaacagttaattgagtatcagcattgtataaagcaagtataagtttagggaagactgagtaaaatttaagattactgactttgctattgccctcaggaaataaattctgctgggggaaataggaatgggggggatgcggatatatgtataaattgtatctagactaaacctctgttcctttaaccattcttcaatttaaaaataataaaaatagagtaactgaagtttctatttctttttcaggtaatacatacaatattccaatatgcctatggctactggacacatacccatataatccccctatctgttttgttaagcctactagttcaatgactattaaaacaggaaagcatgttgatgcaaatgggaagatatatcttccttatctacatgaatggaaacacgtaagtattcatagtgttctgtgaattagttatgttttatatattttgctcactagcatctgctttcttttagcactcaaggaggattcgaggtaggatagataagttcagataatggactaatcactgagttgagggtaaattagaaaaggctgactaaaagaaatgggtttctgtagagctttgtaattttcagaatacttatattcaatattttgttggctttagttgaacctttttaaaataggcaggattcacatagtgggaagtgcattttaaaaaatagtatcctggtgaggtagttatggaattcaaatctgattactcaaagcatttctgtcaagaataatagtagggaacttctgtttatgtgtctgatagtgtaactgtgacagattaatgttcctatgaaaaataactagaaaagcaagagaaaatacaaacaacacctgttggaaggctttggaaagctgtttaggcaatcaagacatgtatggccaagattctgtagagaagaaaacagcaaagagatgaggtagttctgccaataacttttcccccagggtacttactgattcctttttttttttttggagacagagttttactctgttgcccaggctggagggcagtggcacaatctcagctcacttacaacctccacctcccaggtccaagcaattcagcttggtagactcaacctactgagtagatgggattacaggcgcccaccaccaaatacaaaagttttgtattttagtatttagtagaggtggggtttcaccatgttggtgaggctgttctcgaactcctgacctcaagtgatccacccatctcggccttctaaagtgctgggattacaggcataagccaccatgcccagcctacttacttattcttgatgaaggatgaagggctgagaatctgggcaaagggccttagctaagaggcagagaaacctgcagagtctctagcagtctcagagggctgaaaagacaaaagttgctgttctgtctaccaaagtaactaggacttttagatccaagatttgggagaaaagccataaagaagtgagtagctctggggatggtggctcatggctgtgatcccaggactttggaaagctgaggcaggaggattgcttgagctcaggagtttgagaccagcctgggcaacatagtgagaaccccatctctataaaaaaatattttaaaaaaaccttggcatggtggtgtgtgcctgtgaccccagctactcaggaggctaaggtgaaaggatcacttgagcctgggaattcgaggctgcagtgagccatgattgcatcactgtcctccagcctggacaacagagcaagatctgtctccaaaaaagaaaagaaaagatgagatactctgaattttcccaccttaagagatatgttgaattcctgagcttcaaagataagatgctaaaaaaaaaactaagcagaacgcctctgaaaatcagccaagttttcagcagtcttaggttgaggaggcaattggagttcagtaccttatcaagaaggggaacaagtaaacatcctaggctgttagttggcaccactggaagaacacatcttaggagggagaacttagaggtagaatgagccttataaaaatctgtccttgaggctgggtggggtggctcacacctgtagtctcagcactttgggaggctgaggcgggaggatcacttgaggccagaagtttgagacgagcctggccaacatggtgaaatcccatttctactaaaaatataaaaattagccaggcatgatggcacatgtctataatcccagctactccggaggctgaggcaggagaatcgcttgaacctgggaggcggaggttgcagtgagccgagatcgcaccactgcactccagcctgggtggcagagtgagagagactgtctcaaaaaaaaaaaaaaaaaaaatctgtctgtccttcaatcagctcagtccctgatcctgactgtctgcctgccacaggatagggtgaacccttgctggaagaagataatatatagactctctataatttttcacaatgtctagcatacaatttatatttatcaagtacaccaagaaagagaaccaagaggaaaaaaagacaatagaaacgggacatccctccactccacccccacaaacacacaggtaacttggttatcagacacagacttaaaaatggttgtgatcagtgcattcaagaaaatagaggacaagatggtaaattttattaaaaagaaactaagtggaaatcttagaactgaaaaatagaataatagagattaagaactcagtagatgggtttagtagcagactggactcagtagaatagagactgcctcaacctcctgagtagctgggattacaggcgcccaccaccacacctggctaatttttgtattttttagtagagatggggttttgctacattggccagtctggtctcgaactcttgacttcaggtgatccgtccgcctcagcctcccaaagtgctgggattacaggtgtgagccattgtgcctcgcctcagtttgaattcttaacctgttgctttatattaggcctggaagtagatattaacatagatattaatttttttcttcaaagaatttagtgtaaaaggaatggtatgataattaaaacttaccttgacaaaactgtaagaatgtatgaatgaagaattgattcatactaccacattaatgaattctgaaaacattatgccaagtgaaagaagccaagcacaaaaggccatatattgtatgatttcatttatatgaaacatttaggaaagcaaatctatagagatggaaagtagattagtggttgctaaagggctgtggggaaagggaaacgggaagtgactactaatgagtacagggtttctttttcggatgatgaaaatattatggaattagatggtggtaatggttgcatagcttcgtgaaataataaaagccactgaaatgtatactttaaaaggagaaagtttatgggatgtgaattatatttcacctacatgcatgaggcttacatgaggctatgatttagttaaggaattttgttgggccgaaaaattgagaaagcatgtggtctcagtggccatccccacacacaccagccacagtatctgtgagtgttgcacagatactgtgcttataacaccccgagtctcagtatataaatttacaggcaaacacaagaaaaatattggaaaagtagatatcagcaagttttcacagaaagctttgagaaatgttattaattgtcatcttccatgagttaggtcaaaattgaacaaatgaggtgagtttggttctttggaaaaggtgaaaactgccactgaactcttctgtcaggagtattaaaagaagtgccaatcctaatcctgtaatcctgactacttgggagactgaagcaggaagattgttgagttcaagtctgagctgggcaacatggcaagaccttgtctggggggaggaggggtgtaaaaagtagtttctatgaagatggttagcctatcaaggtgattgagtaattcttcagaactcagtgaacttatgaatgaagtacgtgagatgagatatacacaaaatagattaaggagtaaaagaagaataatcaaataagccattttgaacaactttgtctagcacagcttaattagtggttggtagatatttcttttgttgttttttgttgtcgttgttgttgggttttgtttttgtttttttgaaacagggtctcactctaacccaggctggagtgcagtggcgcagtcatactgcagcctcaaccttcctggctcaggtgatcctcccgctgcagcctcctgagtagttgtgaccacaggcgcatgccaccatgtacagttaatttttttgtagagaccaggctggtctcaaactcctgagctcaagctggattacaaaatggaggggaaagtactggaatagacctagaatttttaaaattatgcatgctgcaaaatagccttatttgatcctcctgccttggcctcccaaagtgctgggattacaggtgtaagccaccacccctggccagtgctcaataggtatttgagagaaaatcttagtaacttatgaaaaaataggaatctctttgtcattgttggaaggaaagatcctttaacaattcacccctttgtactacaatctagcaatttctaagctagaatctacgtataatttttttgtttgtttgttttgagacagagtcttgctctgtcgcctaggatggagtgcagtggtgtgatctcagctcactgcaacctctgcctctggggtttaagcaattctcttgcctcagcctcctgagtaactgggaccatagacgcacatcaccacacccggctaatttttgtgtttttagtagagatgggattttgccatgttggcccagctggtctcaaactcctggcttcaagcagtccacccaccttggcctcccaaagtgctgggattacaggtgtgaaccacctcacttggctagaatctacctgtaatttcagagttcataatatctttaataaaaattaattttaagaacacgtatttccaagatatcattgatgtcttttaatggcctttaataatattgtgactgttgctcatattcatccctaaatttgtaccagtatacttataatacattgtacagtggcaataaaataaatttttgttagttctgtggagtcaaatgaagaacaaaactctatgaattttgcaatatgctgctttaactagtgctatttttatatacttgaagcaagaaccttgctgcacatcatgtttaaaaccacttaactctattaaaataaattaattaaatgaaattttcatgattggggtcctacaaagaaaattatcaagctgagttgaaaaccgatgagaaatggctaacctttttctttttactgaaaagcaactctgtagctgacttgaattttttttcattttgtagccacagtcagacttgttggggcttattcaggtcatgattgtggtatttggagatgaacctccagtcttctctcgtcctatttcggcatcctatccgccataccaggcaacggggccaccaaatagtaagtagaattgagattttactttaaaactcatataaacaaaagagaacagaaacctttgtaaaaaaataaagaaaaataatgacttctttgctttttagtttatcaagctagtggattttttggaagtattctgaggccccacatctgcatgtacagattcccaccaaagactggcatttgggcttccatttgtaggtagaaatctaagaatggttgtgctggattccaaaatggaggagaaagtgtagaatagagctagaatttttaaaattatgcatgctgcagaatagccttatttgatcagcttggaagcacatataacttgaaaggtagtctgacctctcctttctctttgcaactacaaaatcagtgttgtagataaggattaaggtcaactgaagcgttcacattcagctattctgggtatacacaattggacatctagctcttagctttcttctctttcgtacagccaattcatgattttaccttgtgtggagtggtgggagcatggagagagtgttgcttctcccctaattggaatatattatctctgttatctctattttcttgaataattcttactgatacttaaaaatcactctgaataattgtgagttggttgtacttattttgaatttactaaatctgcattgatttcactgtgttttgagctgtgacttttttttttttggtaaattttctttaagattataattaaccaaacttgtttatcttacaagacaaattatatgtgctttcatttttcttctgctgaaaattatactttttcctttttaatccattctttcctgaggaacatcttggtttataagctgaatgggaatttaacagaaagaatttttgaacccatttctctttccttccctaccttcccagaataagcttgattttaggattactatttcttttagtaaaggtactggtaattcctttggattagaaatttgtttttatcttattaaattctgttgactctagtgcccaagagtagagtatcttgcttaagtttgaaatacgaaatatttggccgggtgtggtagctgtaaccccagcactttgggaggccgaggtgggggtggatcacctgatgtcagaagttcaagaccagcttggccaacatgatgaaaccccatctctactaaaaatacaaaattagccaggtgtggtggtgcatgcctgtagtcccagctactcgggaggctgaggcagatgttgcagtgagctgagatcgcattactgcactccagcctgggtgacagagcaagactctgtatcaaaaaaaaaaaaaaaaaagatatcaaatatttcctagtctcattacctttgtttatttgctcagataatatagcgagtgaccgctatgacaaaggtaaccttttcagaaattcaggtagtctcctaagcaacttttttttttttttgagacagagtctcgctctgttgcccaggccggagtgcagtggtatgatctgggctgactgcaacctctgcctcccaggttcaagtgattctcgagcctcagcctcccaagtcgctgggattacaggcccccaccaccatgcccagctaatttttgtatttttagtagagtcggggtttcaccatgttggccaggctggtctcgaactcctgacctcaagtgatctgcctcggcctcccaaagtgctgggattacaggcgtgagccaccgcggccggcctgcaacattttttttttcctaaatttctttgagttttaaattgacattggaagtgcagtattcaagaaagagaccatactattgttactgttgcaattcaattttgtactcagtcactgtaagtcatgttaaacactctagagcagattctttactatttttttttgtcagttaagctcaagattaacttctctttttcttcctctatgttgattagcctcttggcaccactgatcttagttctttggcattcacgttctctttaaagaatgtataaagtattctttaagcttgctgggttttaaccttttatccctagtatttctaagcttttgttttgtttgtttctttgttttgagatagggtctcactctgtcacctagactagtttttaacagtctggataatgtaagttttgtataggacttctcatagtagtttgaagtctcttgaagtctttaaaccaacaaaatcagctgtgctaattggccaacatagttataaaagaaatatcaaaagatttattagatataataaagaagttactttctaagaagttaaccttggaccgaagaaggccagaattaccttcctctaaatttgaaattgaacttgctcttaggtaatagacttcttgagaactttaaaagctgaccaggttgacctgtttgccagttcttttggtagggattgtcataagtattgtaattcatgtttaatgatttcaggattatgaaagggagaggtatttgttttgttttggtgctgagatttggattttttaactgtgaaattttgctgtgtattgacagtgtgatgtatatcttattcagtagcctacatattcaggccttgtatattatttttacaatgtgaaaaaaattgtttttagcttcctacatgccaggcatgccaggtggaatctctccatacccatccggataccctcccaatcccaggtaatgaaaaacgttcttttgaataattgtattacaaattcttctattagatctagaatcaaaataatttgctaattagggcattaaaataaatttaattgcaatttagtggaagataaaacttggtttattcctggaatttatttatttatttatttattttttttgagatggagtcttgctctgtcacccaggctggagtacagtggcgcaatctcggctcactgcaacctctacttccccagttcaagtgattctcctgcctcagcctccctagcagttgggactacaggctgtgccaccattcccggctaatttttgtatttttagtagagacaggatttcaccatgttggccaggctggtctcaaactcctgaccttgtgatctgcctgcctcagactcccaaagcgctgggattacaggtgtgagccaccatgcccagcctatgtatttttttttttttaaaagaagagagtattataaaatatttttccccttggctgaattcattataactagcattccatttaatatttcagctatctatactagatatacaaatttcttaaaaggacttcaagatcaaaaaccaattgagatcactgtcattactcaacccatttctttcctctttaaaataaaaatgcagcccaggagctgcttttctgtagattgaaagaaactcctttcaaattatacacacacaccttaaaattctagcaataaggccgggtgtggtagctcacacctgtaatcttacccagcactttcggaggccgatgcaggcggatcacctgaggtcctgaggtcaggagttcgagaccagcctggccaacagagtgaaaccccatctctactaaaaatacaaaattagccaggcatggtggcacatgcctgtaatcccagctctttgggaggctgaggtaggagaattgcttgaacccaggaggcagaggttgcagtgagccgagatcgcgccattacactccaccctgggcgacagagcaaaactctctctcaaacaaacaaaaccccacaacctatcttttctatacattgcaggaatcaattaatggttcagataatggggtcaaacttgtcgcatgatatttacttattcagttcatagactacctgtactatcaacctttattatccatttagtaataacataggtaactaaattaaattaacaatgaaatcagtctgttaacacacgctagaaagtcaatgataaataattactaacccatgttttaaatgtgtacttgtttcagtggtaatctaggagtactctccaaaggtggtctatgggctaacttaaaatcccacccagcactttgggaggccgaggtagggattgcttgagcccagaagttggagaccagcctgggcaacatagtagacctcatttctacaaaaaaaattaaaattagccaggcatggtggtgtgaacctgtagtcccagctacttgggagggtgaggtggaaggatcacttgagcctacagatcgaggatgcaatgagccgtaattgcaccactgtactccagtctggccaacagagtgagaacctgtctcaaaaaaaaaaaaaagattggcatatactgatgccaagatgagacttccagctgctctaacaattagcaaggaaaatttaactctactaagtcttcttagtttcatataacccagtcataatcctcatggataaatgcagccagatttctgaacacatgtcataggtaaatatatatatgtacatatataatatctaggatcttgaaagttaatttagcaaacacttcatttctgggttgtcttaatttcacaactttttagaaggtaataagcattctgtcactttggataggtaagcagagattagaagaacatttgtcagggacaatagagaaagattcctttggtagtaatatataagcaggttattcattttagatttcttgaggccctaaattttctgattaagttctagaaatggaatcctacctgaagccttgaaattacaaggctactgaacaattgctagtaaaaagcagctttggacatagagggaataattgttgaaggtacactatggaaatggacttctgaacaataaagctacagatggagatttctctgaagttaatatctgtaggcttagaagagttttataccaagttacaaaaaaattcagcaatgtgatcacattatctttgcaaaggtatgcaaaatgggagaaactccagaaaaaaagagcagtttatcccagttttcagaaaggtggatttagaaatttcagtaggattgacatttctttacagcattatagcatggattactgaagagactagaaacaaaagtactgtgttcagtagcctccagcatgtgtccactaggaacaaaaatgctttcttttttttttgtctgattttgcttttatactgatatataagagaagtaccatgattacattgaatcttcagcaagtcatatataaaacttagttgaggacaagttataaagtggaagctgataatacaaataggagaatctttgaaccactgcattgaaaaaggattattgacgataaactcagaaggagctcttgctccagtgtcctaggctagctttttttttttttttttttttgagatgggggcttcactctgttgcccaggctggagtgcagtggcataatctcagctactgtagccttgacctcctgggctcaggtgatctttcaacttcagcctcccaagtagctgggactacaggtgtgtgcccctacacctagctaatttttctatttttgtagaaatggtttcgccatgttgtctaggcttgccttgaactcctggactcaagtgatctacctgcctcagcctcccaaagtgctaggattacaggtgtgatccactgcacccagcctgggctagctctttttaatcagtaattttaatgcgcttgtaaaaggcaaatgtcatagaattgataattatagctaaaataggattaattgagatttattgtctaactaaccaggtggccagtaatcatcctattctaattttcttcttcgttgtaagggaaacactgactagtaagcattcagaggaaagcaattagatctgaaaatcatgtcctgagacaaatggttaaaggaattaagaatagttagggctgggtgcggtggctcacagctgtaatcccagcagtttgggaggctgaggcgggtgaatcacgaggtcaggagattgagaccatcctggctaacatggtgaaaccccgtctctactaaaaatacaaaaaattagccgggtgtggtggcgggcacctatagtcccagctactcaggaggctgtggcaggagaatggcgtgaacccaggaagtggagcttgcagtgagctgagatcacaccactgcactccagcctgagcaacagggcgagactccgtctcaaaaaaaaaaaaaaaaaaaatttaacctgaagaagagaagcttgagggaaaaatgttagaagttctcaaatattcgagttttaggagtctccaaatagttgagtgtcttccaaaatgcaaatttaggactcctatttataaattatattgaaatgatgtttaatgttaaatagagaaagatgaccatttgtcagggatgttataaatgatgtgtgtagataagagattgttggaaaggtgattggagtagaatacctctaaggaaagttcctctgactttgatacgaatacatgaatgacagaaactgtccagaaagtgagaaaaaaggtttttttttaaactaaagatgagtttggtacgaatgttatcaaaagaggaaaaaaactatttaaagacaagtgttttcgggttaaatatccccaaaggttaccaataagccacaggtacaaattaaatagtatcattttcccacagactgagaaatcggaaaagttctctcacaaattacttgttgcttctgatgctgttggattgtccttagaaatactctagttacatttccgctgctatgagggtgactctcatataactgggaccaagcaagagcatttagccatttaagagtaaatgcagtgtcattaatacaatttccatagagctttacttgaataaacacttgcagctccaagactataaattcatcaactggtaaaacaaccatatgtcaagcttaacttcctgaatggggttcttcaaaatactataaggttgggtcatcttaaatgttaaatgttttttgttcttgtctttagtggttacccaggctgtccttacccacctggtggtccatatcctgccacaacaagttctcagtacccttctcagcctcctgtgaccactgttggtaagtacccttgaaaacttgtgtttcaccatataagcaaagtctaactccctgttgtgaaaagcacatttcacttgtgaattttggactactctttcttcttagaggaaaacctataataatgtactataatcttaaacttgaagtaaatgacttaacatataaatgaaccttctaccagggcatgaaaataaatctgattaactcatcaatctttcttttgatcacatagttttatttgtgagccaaacatgtgttgaactattagcagatacatagattttcctagcttggttatatgtgaaaacagatcaccatcattaagagaagaaagtaaaatgggttaatatgagcaggtcaaatcagacaaatgattgaagaccagtagtttttgctttttgtgtttgcttattagcgttacctgaaatataattttcttcaactaaaaaaactaaggcagtgagagaatttctttagactccagccttcacctatgcctatctcccactacctgcaccaccatatctgccttctccctgttaccataagttggttatctttgcttctatctaaagctgatttctccactagaccttatcccctctaatgtactcaggggcatcacttcagcagttccttcctctcaagttttgttctctactggatgactcatcagcacagagaaccatgccctaaaaaagccttaaagagtccaattgagacaaacaaatggaaagacatttcatgcccatgaagaattaatattgtaaaaatgactatattacccaaagcagtctgtagattcagtgcagtctgtgtcgaaataccaatgtcagtttccatagaaatagaaaaagctatcataaaatgtatatggaaccaaaaaagaagccaaatagccaaagtgatcttgaactaaaagaacaaagctggaagcatcatactacctgacttcaaaatatattacaaggttatagtaaccgaaacagcatggtattggtataaaaacagaaacagaccaatggaacagaataaagaacctagaaataaatctacatatttacagccaactgattttcagcaaaggtgccaagaacatatattgggaaaaagacattgttcataaatggtggtgggaaaactgggtatccatatgcagaagaatgaaaactggacccctatcttgtaccacatacaaaaatcaacttgagatggattaaagacttaatgtaagacccaaagctataaaactactagaagaatacataggggaaacccttcgggacattggcctaggcaaccattttatagttaatatctcaaaagcatagtcaacaaaaatagactactgcgatgatactaaattaaaaagcttgtgagccagatgcagtggctcacgtctgtaatcccagcactttgggaagccaaggcgggcgaatcatttgaggtgaggagttcaagaccagcctggccaacatggtaaaaccccgtctctcctaaaaactaaaaatgcaaaaatctgggcgtggtggtacacccctgtaatcccagctacttgggaggctgaggcaagagaattgcttgaacctgggaggtggaggttgcagtgagctgagatcgcaccactgcactccaccctgggcaacagagcgagaccttgtctcaaaaaaaaaaagcttctgcacaacaaaggagatagtcaacaaagtaaagagacgacctgttgagtgggagaaaatatttgcaaagtacccatctgacaaggaactaataaatatacaaggtattgaaaccactcaacagtaaaacaaaccattaaaaagtgggcaaagaacatgaatagacatttcttaaaggaagacatacaaatggccaacaggtatatgaaaaaatgctcaatatcactcatcatcaggaaaatgcagataaaaaccacaaagaaatataatcttatcccagtttgaatggccattattaaaaagacaaaaaataaaaaaataacaaatgttattgaggatgaggagaaaagggaacttatacaatgttggtgggaatgtaaattaaagccactatggaaaacagtatggcaatttctaaaaaaactaaaattagaactaccagacagttcagcaatcccactgctgggtatttatccaagggaaaggaaatcagtatattaaaggaatacctgtactcccatatttatagcaacagtattcatactagctaagatatggagtgaacctaaatatttatcagcagatgaatggataaagacaatgaggtatgtgtacacagtggaatactgttcagccataaaaagaatgaaaacgtcattgtagcaacatggatggaattggaaataaactaggcgcagaaagacaaatatcaaatgttctcatgtgggagccaaaaaacttgatctcttggaggtagacagtagaatgatagacaccagagacttaagaacggtgtgtgggtgggatagggcttatgaagaaaggttggttaatgagtacaaacatacagttagatagaaggaataagttctaatgtttgatagcagagtagggtgactatagttaacaatgtattgtctatttcagaatagctagaagacttaaaatgttcctaccacatagaaatgataaatactcaaggtgatggataccctaaataccctcacttgaacattacattccgtgcaggtaacaaaatatcacatggtacccacgtaaatatgtacaaatattatgtatctaaaaaaattttttaggccaggcacagtggctcacacctgtaatcccagcactttgggaggccaaggcgggcagattgcgaggtcaggagttggagaccagcctggccaacatggtgaaaccctgtctctactaaaaatacaaaaaaattagccgggcgtggtggcgcacgcctgtaatcctagctactcaagaagctgaggcaggagaattgcttgaaccctggaggcagaggttgcagtgagctgagatcagacaactatactccagcctgggcaatagagtgggactccatctcaggaaaaaaaaaaaaaaaaaaaaaaatatatatatatatatatatatttaaatataaacatatttatatataaacatatataaatatacataaatataaatatataaatatatataaataaatatataaatataaatatatatgatatatataaatatatataaaatatatataatatataaatatataattatatatcatatataaatatatatattttatatatatatatttaaaaaagaatcctcttctctattccacttttcctgccaccactattggatgtcttcattcttctctgaataactccttgaagtaactctctttgttatcttcagtacctcttctccgtttttctcttaaacctccttttggactttttctcataccattttgctaaaactggtcatgattaccaataactttttgaggttacatccaatggatagttactattctcatcttacttgtcctatcagcagcatttgacacagttggttacttcctccttgatacactttcctcttgttttccaaaacaccatgctcattttattttcttcctgtctcatgggtattcatacttagtctcctctgcaagttcttccatttttcttaacattggtgtgaccctggcttagtctccttggcactctctatcctcactctcctgataatttccaccagttcaatagctttaaataccatctctgtgcccccagttctcaaatttatgtctctgacctatacctctctcctgaactcgagattgttatatccagctgccttttcagtatctctacttggatgtttaataggcatctcaaactcaaccaaaaccgaattctcaatcttcctaacacctgccccatctccattgttacctactctatactctttggagtcatccttgactcctcatcaggaaatcctcttgtcttcaaaatatatctagaatctgatcatatccagtgctgatccaagtcaccattatggctcatctaatttacttcaaaagccttccacaagatttctctgcttctttccttgtccccctacatctctcttttttgacacagcagctagagtgatcctaataaaatataaataaattgtatcactcctctgctcaaaaccttcaagtgatttcctgtttcactcagagttcagtccaaagttcttgggcccagaaggccctacatgatcctgccctcttccccattacttttctgacctcatctcctactggtctcctgtcttaggatttgtccacggcctatttctgtgcatggatcagccaggcctatccttaccaatttgctgccaccaccaccaatcccccctccaaccccccacccacacactcaacatccagaagagtgcttggtatatagaagtttgctgttgaagagatttgctgagttcctgaatgaacatagaatcttgtgaagtttatttttctgttatgttttctgataacttgtaaccatcctgaggtctgatgtaaatgtcatccccccaccccataaagggttatttccaccgtttttctcattgatacacactattcaggttccagtggtgtggttttgatttattaaaatgtatttgtcattaatgtaactacaatataatgaaatgattggagttagaaacctaaatgataaaaggtctttaatccataagcaaagcacactaaatctggtgaagctctcttattttggttcagcattatcaataaaataggaatagtgctgtttgtcaccctgtttctcattgaaataatagtataatccttttgatttgtagagaaccttagtttacaaagatcttttttatattaacttgtttcattacattaggtacgaagcatttttttatagcttagatgatttccatatatccaaagaatagaaatgtgtggaaaatggtatatgtggaatcagatctcatgtttatgatttttgaacgggtaatcaaatcaactaatattttactctacattttcaagagtactgtcttaggcatataggctagaggcaaattattttatgataatttaggatatcctttaatatatattgtttttctaccctttgatctttacctacttgatttgatttttttcatcatatttcattagttgaacatttagtagtctgttgaactttagacttaaaggaaagcagaaacataaaagtatcatttagatattagagtccacagtcacattttctcagtatatcaatggtcacgatttgggctgttattctgttactgaggccatgagaaagaatgaatttggttatttatccttgttttttttgttgttgttgtttttgagacagactcgctctgtcgccaaggctggagtgcagtggcgcgatcttggctcactgcaacctccacctctcaggttcaagcagttctactgcctcagcctcccaagtagctgggattagaggagcgtaccaccacacccggctaatttttatatttttagtagagacagggttttaccatgttggccaggctgatctccaactgcaactcctgacctcaccacctgcctcaacccaccaaagtgctggtattacaggcctgagccaccacacctggcgctatccttgttttttgatacaggatcttgctctcttgctcaggctggagtgcagcagtgctgtctgcccactgcaacctccatctcctgggctcaggtgatcctcccacctcagcctcctgagtagctaggactgtagacacataccaccatgcccggctaatttttgtattgcccaggctggccttgaactcctagattcaagtgatccacccgtgctggcctcccggattacagatgtgagtcactgcactaggctcccttgttctttttgaaacttagcagtttcactctgtagatttattttattttattttattttattttattttattttattttattttattttattttattttatttttgagacagagtttcgctctgccacccaggctggagtgcagtggcatgatctcggctcactgtaatctctgcctcctgggttcaagtgattctcctgcctcagcatcctgagtagctgagactataggcatgtgccaccacacccactaatttttgtattttgtatgttagccaggctggtcaatctcctaacctcaggtgatccacctgcctcggcctcccaaagtgctgggattacaggcataagccacctcacccagcctggattttaattttatggtgtaatctgaattaagaaagatttaaaatttaccagatgttcaaaaatattagtatatagtatggtacccagaagagaatggtgttccactcagtgacacttccatatgttgtgaatttatgtgtgaggaatgtcagtggactaattggcccctccctttggaggatgtactgtcagctgtgcttgtgccagaatctccaggtttatttgatctctgtagagtactttttttttttttttgagacggagtctcactctgttgcccaggctggagtgcagtgatgcaatctcagctcactgcaagctccgccctccaggttcacgccattctcctgcctcagccttgatctatgtagagtccttttatcagagtgctatagacatcttcaacctcagtttacatagtgttttgaaaactaactaggggaatgaggaggtggtagtcggtgaataatgaaggaacaaaccaattcatgtagcaaaaaaaaaaaaaaaaacctaactggtagtatgcattgaaacttaacacaaagattctttttcctgttactgtaggagcaaaacataaactgactatacctatcttaatcagtttcacatacaagatccctgaaaaatagtgggtatggatgggcaccaggtgagccaccatgaagtttctctaccacaaccaccacccctgcccctggtaaaaaaagaggaagttaaaaggctttggtgattccttactccagtctcagcagtggtgaaagttctcttttgaaggttgacttattttaaaaagctatatagatgattgtagttgatttatagctctgaatcctaggctttaggcctttaacatatacacagtttgacctttcagtagttgcagtttaataatagtaaaattgaagagtaggtgtttattcccggttaaagccaatacctaccacagaatttttcttggtaaaacttcataaatactgtatatttcaacctctgagttttaaaaatgtcattttaagattttgttcctaaaaatcaaataaacaaggatcagaaacagtaagtttggaagggtgctattaacagagattcagggaccagttttacctttgttaaagtgttgtttaaaaatgtgggagtggaaaaccctgaaaatgctgcagctgaatgatgtgtttctgtagtttccactctttagtccatactgaatatttagataaagaaaggaaaaggtgaagaaaaataagagagcttacctgttaatatttctttgaggacagaagctagtaaacatgacaagtttttcttgactgtcttatccaatgctgttcttccctctggccatcctagattaagtgtttggcctacagaaactgtactttcaggatatggcacccaaggcacccagcccatgtgggtttactagtgcacgcttgcttgtgtgcaggtttgggtgcctcttccccacacctttcacagacttcctttgggaataactgcctcatcttcaggataagtagcgttttcttccaatcctggacagtcagtgagtcatgagtgaaatttaaatgctgagagtttagtctgctaaatgttaaatccttttctgccaaagcaataatgataacagaaataatgataacagaaattcaaagcaataatgatagatttgaaagcttttaaaaaagctattgtgtaagttaacaaatgatttttattttgttagtaaaggaaaggtaggagaagctgattcatttggcttcctgtcgttattcctatagaatacctctaacataatagattcttaaattagtcttttcacaaaacgttaattttaatggaattactttgattctgattcatttttttaagaatagaattttaactctccttcagatttattggcttttgtgcttatgcctaccaggtagcatctttcatcttttatgacttactatgatagctgaatgattttgtcacactgtttcttttttggagtagttattattttgctgtctcattttagcaagacttatacctacttaccttcacttttgaaaactttaatttttatgtaaatgaatttaaactttttttgtggtgtgtgtttattttcaagaagtgtaaacctgctgatagctttctttaaattttttcttattgattgtgttgatagaaactttctagagctcaagtaaagcgcatttttctgagtgtttaaaagataaattgaggccccctaatttctttggaagaaaagctccatagcctgcacaaagcctgtaagtagtattagaagcttacatattcatacactataaataaaaaggacttttgtaagccatgtaatggatttgcagtgtttgcacttaatagcacagatcagaactcctttgctcatacagttgtctgaaatgttcttccttcttcagagatagacctgttttttgttttttattatgaaagaaaaataatcctcatatgttctcggtctagtttctaaatagatggtcagtaagctactgtgtgggattacttgggctccatagtttgctgtgtagcacagatgccagacctaggaccattatgtgggcctgagcaagtaacatccaggagtaaaaatgctgggcaggtagtttacttttgctgattaagggtgaggtcagaaaaattatcgttgagttatagtttactttgggcttatggattctttctctaatataaaatagcttcatttgagttccaggaagtagtgatcgtttgtaaatactcttaggagataaatgaaaccgggtgtcttaagtgtttaaatagtggctttaaatcaggtagtgtatactagtgcactgtgaatatacttgcataaattattcaatgaatttttgggtccattgagtgtagagtgttggtttcctaatactagaaaaattatatcttatttcctaaggattaagtttggagatcagatcctacctgacatttaaaggaagttttgcttaagattgttactcaaagtctgttagctcttcaactgctaatctggaattgtagaagggcacttttgaaatctgactctgcttgagtaaaaaggtcagtgtgttggggacttggggtatggcagtttgccaaaaactcttcttattcttgttatagcaggtatagagaatattcaaatttcttctaagatgtttgagaagaaagtttggtttggtaagtgttcacaaagtagatgagaatcttccaccaaatcttttttcttatttgtttgcataaacattatcttaaagtggcatggttcatcgaattttgaactttgatgagtttttcttttacttctttgaaaaactctgggtttttctttttttactttcttatttcagatcttagttataattcctttttttttttttacaaagtagttcgattttttaaagtttagatatacttcacagtgaagtctatgtgtgatagagataagactaggtctaatcttggtgtttgtaacttcctcaggtgaactgtgacctttataggccaagcgactgctgcctcggcttggttcttattttgagggttaatgactttggctggaaagtcttggcaaggacttatttggtggtattatggtagcatttgcctgaacatattctataaagagaaacagaatgtaaattccaggatttaaatgtgtgtttttaaaaataaggatttaaaaatttagcatcagtataatttgacccattagaccagatataatagctttaacaaagtatgttgatgtgtttatgtgtgaaaaattcactaactataaaaagactcttaagttttcattagttctgataacttctgtgccaatgaatggaataccaccactgttgcatgtgattgaatgcttaattatagacatatcatttaggtacgtaatctatgggagaaggattttccttcctgtctcacaagaaccatcataatatttcatatagattataagacaggttcttctagaaaggttttaaaattccttttgctaatgcagccttactataaactggggacttaatgaaatcttcaatagtcatcatatcatgaatcatcctttggatatgaaattctaaaccaaactcttgtagaaattggctctttttcactttctttaaaggactttttaagtacagtataagaaattagagatttttattcggtctaaattctgtccagatgactgaacagctaagactttaattcatattaagtctgtgaaagagagctcactctctgacgtattttaatctgtatgttcagtgagtgtggaaagatgtgttgcctttttatatggcctcatttgaagtagaccgacttattctacaaattgccatgaagagcaagttcttgattaggtaagaaaatactctttagttaaggacctgtaaagtttggaagttcacaaaaccacctgcacttctgacactcattgcaagttcatggtttcccaaggccaccctaaagttctataattatctagaaggactttaaaagctcactgaaagctattatactcacagttatgacttatggcaaaagatacagattaaaataggctgaggaaagacacgtgggcaacccagaaagtttcaagtgcaaagcttctagttgtcttctcccagtggagtcataggcagtgctgacttttcccagtaacagtatgtatcattatgcatggagtattacccaccaaggtagctcacctgagccttgggtctagagtttttatcaggacttggtcatatagacaccattgactgcctgtgaggctgacctttagtctccagctcctccagaggttgagctgttacctatcactgcatggcccagacccccccataaatcacactgttagactgtctggtgtagataaagaacactctaattagtcaggaagttctgagggcttagacatcacctccaggagccaagggcaaaggcgtggcctctctgggtaaagttaattctttactacacagaaccaagctgtaaggcattttgccttattttgcttgaactttaaaaatatccgaatacaggagctgctgctaccgtcgctgcagccacggcaggcaccgccaccgctgccagaggagtgggcttgggaaagaagtggtcacctcacttggagctttgctcagaagcatcctcgtcccctgcagccctcccacgggaacgactggataaaagtgagctggtacagaaagccaactcactgagcaggctgagcgctatgatgatatggctgtagtcacgaaggcagtcacagaacgaggcatgaatactccaacgaagagagaaatctgctctctgttgcctacaagaacatggttggtgcccgctgctttcctggcatgtcttctccagcattgagcagaaaacagaggaatgagaaacagcagcagatggggagagagtagcatgagaagatagaggcagaactgcaggacatctgcaatgacgttctggagctgttggacaaatatcttgttctcaattctatacaaccattttctatttgaaaatgaaaggagattattttaggtatttttctgaagtggcatctggagacaacaaacaaaccactgtgtggaattcccagcaggcttaccaggaagcatttgaaattagtaagaaagaagaaatgcagcctacacatccagtttgacttggtctggcacttaatttctcagtcttttactatgagattctaaactctactgaaaaggcctgcagcctggcaaaaacagtatttgatgaagcaattactgaattggatacactgaatgaagagtcttataaagacagcactctgatcatgcaattacttgggacagtgttactctgtggacatcggaaaaccaggaagatgaaggagatgctggggagggagagaagtaatgtttcttgtgctttgtaatctgttcaatgtcactctgtaccctccacgtatatcccttgtgtggtaaaaaataattgtatgttgactttggatttttcacagcctcagcctagcaaaaatggttcatgggataaacagctggtgtttgtattctaaaactcagattggtcacataaatgccacggcattctgaagttttgattttgattaacattgacaggattactgtgtgtttaattttttttaattcaacactgtgattatggggttttgtaatttagcaaaactcttacttgtagaaaaaatagacctgaattatgtgtaactttttggaaagtttaatctgataccagaatcattgaaatacaattccattgtaaagttgtacagaaggttatagagattatattatgatgctagaacctggagtgagacacacatcatttggcatttgagtttaatggtaattcatagtaatgctgcctgttgtttggcacttaaagacacttgacctgtttgggctgttgccactcaaaagttcatgaccacagatgtccacagtgtcttcctctgaagaaactcgaatcctgaaatttaaattctttgtggcagataactggcttatgacaccttgaaaagtccaagtgctcatataacacacctgactaaatccccttttctactgcagtgtgttcactttgttaccaatttgcaacttgtgcttcaataatggaatctattttcattgttaacactgagctaaagaaaagccatgtgttttatgaatgaccttatctgtttcctggataatacctttaagaataatcttctgagtcaggcatggtggtgtaggcatatagtcccaactacttgggaggccgaggcaggaggatcgcctgagcgtaggagtttaaggctgcagtgccctgtggttgcacctgtgaaataaccgcactccagcctggacaacgtagggagacctcatctccaaaaaaaaaaaaaaatagaatgatgttctgtagagattgcctttcacttgaggagtactgaatttcctggcttggggcttttaaattttgaaatcaaaacattctttcccaccatccttttttttttttgagatggagtcttgctgtgttgtcaggctggagtgcagtggcatgatctcggctcactgcaacctccgcctcccgggttccagcgattctcctgtctcagcctcccaagtagctgggactacaggcacgcaccaccacgcccagctaatttttgtatttttagtagagatgggttttcaccatgttgatctcgatctctggacctcatgatccacccgccttggcctcccaaagtgctggaattgcaggtgtgagccactgcgcccggccccccatcatcctttttgactgttgactttggttttcccttccctcctctctaaatttctgtccttctgcttccttcctttttttgctttttgaattctatctttacctgtcttttgttcactttttaatgctgtatatgggcaggggtgagagacattagtgagcaacttggtgagcaagcctggctttaaagacttgagaagaacttctagcaccagagctctgtcttcctccagttctcaacacggtgttgctctttagtcataccaggatctgaatcaaaaaagtatttttaaatatccctgacttctccctgtattgaggctggccctgatcatgctttttagtgcccctcaccaggtctcccaagtgcacttatccagctcaactctcagatgtgttttaacgagaccctatattcagggaagttgtgtggacactgcagtggagagaattgataataggcctatcagtctcacaatatcacccctctacctttaacattccatctagctgtagagtccatctgtttgtccatctgctgaaatgagaaaagaaaacctcatgcactgatttaaaacaaaccaaaaaaagaaaaaaaacaaaaatccctcctttctaactgaacaaaaatgtgcagttaatagttggcccttgaaaatgcagtagtgaatgtggagctaagcctgtttgtatatctggtagctcttttcttgctttgtttttccttaaccagtattctgcctaatgttttcttctgtgatggttatattgtctagcaagcacacctgtggttgtgaaaatagtatagcaaaaaagaaaaatcctgttactgatgtactaggtttgtgtatgtcttttaaacagttccagtttcaccttacacagaataatcaggaaaagtgtaaaacttcaaaagtgaaataaaaattttatcagttaaaaacaaaaaatacccaaatacaaaaaaaaaagatctaccaaaagcttcctgcctaatactgtaatttgaagatgagatgggcaacatggagcaatggaaaaggaggatgtatgctcactgaagcatgagctgggccaccactcctgttacaaaccaggaattatagcagattcctatactttgaggtttttttgtttcttttgtttttgttttttgcaatagcaaataggtgggatgccaggcacagtggctcatgcctgtaatcccagcactccaggaggctgaggaaggaggatagcttgagcctggaatttgagaccagcctgagcaacatagtgagactacctctctactagaaaaaaaattttaatggttacagaaacgatctaatgttttttcttccttgtgttaaggtgttttagtaaagttttctcaaattatattgcattttacattttttctaatcctttgaatttgttgtgagagaccaaaattataaatcagttttcccctccctgccaaaaatggaaaccaaagcaagtccaggagattgaattatggtaattatggtagtattctttgttaaagaatttggatgttcccttgggaacagaaatttttttttcttttttttttttattatactttaagttttagggtacatgtgcataacatgcaggttagttacatatgtatacatgtgccatgttgttgtgctgcacctactaactcgtcatttaacattaggtatatctcctaatgctatccctccccccaccccacaacaggtcccgatgtgtgatgttccccttcctgtgtccatgtgttctcattgttcagttcccacctatgagtgagaacatgcagtgtttggtttttttgtccttgtgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaacagtgctgcaataaacatatgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatgatgagcattttttcatgtgtcttttggctgcataagaaatttttaaagaatttaactgccgaaggggcttagccctgaattatggtggctggttgggcagaattgtttgaatgaagtgaagcagtgatagtgttgatgatgcaggattttcttctcagtcactctgcaagccagggacctctgacgagcgacaccctgcctgggcctccctcagccatgctacctgctgccagagacagccctcccattcggcccacttgggccgagtctggcttacccgctggttcccgagttcttgtcctgtgcccacaaagaatggggatgcactgacaatcaagagtgagcaagacagggagttttattgactgatgaaagagctttcactggagaggggatgcaggggtggttcccctacccaaaggtgggaaagtcccctctaagtggctgagtcctgcggcttcttacaggctcagaataggggaagggcaggccataggtagtattggaaaaggcaacatttgattggttaaaaggcattattgaggaagaatcaatgggaaagggtgggcaaacaggaatagaagttctcactctaggtcaggggtttcatccgggaccagcagtccaatctttcagccttcaggctgtttttggcttgaaggtggcgtttcaccggggacccaccccatctgcctcagcatttggctgcctcctgttgctgttaatgaaatccataattttaaatattttactctattaatgacttttcagcactgtttccaaccacatgccttcaaagcagtagagcttcagcagttcatttttctgattttcaggtagagatattgatgagttctttcatttggtttaataccaccataccatttattttggagagcgctcatatatttataaacaattttaataattaccttcttctacattgcagcagaagacaagagaagggaagtttccaaaaaagcacattctaaggacttctaaccatctgaggccttttctctaggactcctagaagataaccaattctgttgatttcaggagatcattcagcaacagtttgccacccttaacatttagtatttaggctgcataataaggattatagagacctttccttcagaaaataggttattaaactaataaatatagtgataactgttaagagagagcagattctagttgttgtgctgacgttttgggaattatggttaatggaggaaagatcattggcaaagattaggtttcaccataatttaatggtagagagaagatgggatctgatgttcgagagcattaaacttttttgttagtttagaatggcttagagtttgttgacagagtttgttgatggttttggtaaaaagcaggatcatctaacaggtaattagaagacccaggtaattcacaaggcccttcaggaagtttgcttcccagctactcgggaggctgaggcaggagaatcgcttgaactcaggaggcagaggttgcagtgagccgagatcatgcgactgcactccagcctgggtgacagagtgagactccatctcaaaaaaaaaaaaaaaaaaaaaggcggcaattaaggttaaatatacttaacgtcctcacgtagtattttataatcaaacataattaaaagtcaaaatgccatttacacatttgctgatttgggacaataactgaagaacactgatagtcataaagaatacccaaacttatattagaaaggggacctttttgaagaaaatatccagaggatgtttatttgatctgaaatatgcatggaaatgatataatatactgattaggaagggacatttggaagagaatagtaaagaatctgggaataaacagtttatcagctgttgaattttttggatgtcattcttttttgttcatctgttctgtcctgttggtaaagggtgaagtagtaaaagtcttacagagggaagccttattaacctgtacattcgtttagggaaactgcccattctcagtcctctcactggcctctacagtgggcacttgtctccttcagcttagcagcgaagcctgatgttggacttggcctgcaccaaatgtttttccttagtggaaattattgtgccatttgttggttatttaggaataattgtaattggtagggacatagcctctgtctcattgagaaaataactaattgtagctaattgtttgggctatgaatagggaaactgggtttaacatggattaatagtaatctcttgtagggcaagtatttctgaatcaactcagatttttacattatttctcatgaaactggtaacataatttttttctttcctcacattttgaaagtgtcggttcatattgcccccttttctgaaggttcctgtgagacaaatagaaggaacttgggaagtaagcaagtgttttttgcctctgtttcctgcaggtcccagtagggatggcacaatcagcgaggacaccatccgagcctctctcatctctgcggtcagtgacaaactgagatggcggatgaaggaggaaatggatcgtgcccaggcagagctcaatgccttgaaacgaacagaagaagacctgaaaaagggtcaccagaaactggaagagatggttacccgtttagatcaagaagtagtaagtgactcattaaagacttaaaatttttggattgaattgtagccatggcagagtgttctatatgttccctggatgttgtgggcatagtaggagttcagaaaattataggcatctttaaacatttgaatgtaattttttatacctttgtttacagtggagcctatgtttggcatttggtcttagattgggaggggtataatatttagaccattttgtttgcaccttgtattagttcgttttcacactgctgataaagacatatccgagacttgagagaaaaagaggtttaattggacttacagttccacatggctggggagacctcagaatcatggtgggaggcaaaaggcactccttttttttttttttttttttgagagtttcactcttgcgctcaggctggagtgaagtggtgcaatcttggctcactgcaacctccaccctccaggttcaagcgattctcctgactcagcctcctgagtagctgggattacaggtgcctgccaccatgcttggctaatttttgtattttttagtagagacggggtatcaccatgttggccaggctcgtcccgaactcctgatctcaggtgatccacccaccttggcctcccaaagtgttgggattacaggagtgagccactgtgcccagccaaaaggcacttcttacatggtggtggcaagaggaaatgaggaggaagcaaaagctggaacccctgataaacccatcagatcttgtgagacttactatcacgagaatagaaagaccggctcccatgattcaattaccacccctgcgtgccatccctccccaccccctgctacacacacacacacacgcacacaggtccctttctgtgagatacaattcaagttgagatttgggtggggacacagccaaaccttatcacacctttgccctaggaaatgttttaggcaaaggatgttttaacccaaaggaggactgtttgagtgcttgatgttgccagttactaggaaataagtttagagagttctaagccatgataaagatctgcacatcttaggagcagacttaaaaggacagtactattttattgtttccaaaggttgtgtgagccattttttaaaagtatgttcagggaactttctcaataatccagagatacttggttggctaaagagctacatataaacatagcatatgcaaccttcagctctttaagctttctcataacagacagctatgccttggacagtccgtgtgtaagtcagccctatggctttgcttaatgatgataaagtggaagcatcagcataattgaagtgccaatttcacgctccattttcatccccatgagggagaatttattccagtaaatgtgtgtttttgatggaatagtaaagaattcttagaaggttgagggctttgtggaaagtgatttgtatgtacccattagccttacaaagtggttctagattgtaaaatgagcctcgaagtagccaatttttagaattcaggaaagtgacaccaatacaactcagagcctacaaccagcacctgcgtgtgatactttgtgattagaatgcagacatttgggcctctatgcattgaatcctcttcatagactgaggaaagttactctcctatggcaggtgcccatttgttgggaagaaaaacctcttatgattttctatgtaaaggaaccttctgctggaaagtatcttgtctgatggcttagtttgcagtatcatttgtcgctgacaggtgacaagcttgttactgtcactgaaagtgctgtcacctcaggatatctccatcattactctatttcactcagcatagtagatcacatcttttcctctacctttgaccagggtgttatttgaaacattattctcatccatgagttgtttaaacatggttgttagcctgtcttttcctgtgaagtgttgtaggtgtctgacaagtggataattatgtacagttattaatgcttggactgttctgttttcaggccgaggttgataaaaacatagaacttttgaaaaagaaggatgaagaactcagttctgctctggaaaaaatggaaaatcagtctgaaaacaatgatatcgatgaagttatcattcccacagctcccttatacaaacagatcctgaatctgtatgcagaagaaaacgctattgaagacactatcttttacttgggagaagccttgagaaggggcgtgatagacctggatgtcttcctgaaggtatttcttcattttacgttccaagattttttaacttgggttgtagaggcactgaccttgcaaaccacaaaccaagagagtttctttgtagtatggattaagattctttatcttcccaaaaaacactaaatgagatgtagggttttgcaccatctttttacctacagagtactgaggattggtctgagcaggggaagagaagtgggctggtggctgcagttctctgcccacaggcagcattaagatgagtgtaactcttctgtgcctgggtggatcaggaggtacgatcagatttccattggttctttgaggtcataccacctaaattgagatcactgattgtgccacctccattttttatctgttaattttcttagagttatataactttagaccagttttcccacatcaaagtatcaggctgccctttcaagccctcttgtatgaaagttgtctcaagcttaatgctgttgtacagaggaaaatctagtaagcgaagtttggctactgctgtctcttgggtcatggagaacatggttttagggataatagcagccacccttgggatatctgatccagctgtagctggagcctggtcaggtcatgtgctgatcttgcctatctcctctcactgtgggggaatggccaaaccatgtgcctcagaagtggtacaaccacatgaatggctggatataaaccagagacccaagagaggactctttttctgtacaatctcttgcttgagtggcatggcttaggaaaagaaagtgtaggtcaaactcctgagccagatcctgcaatgtaatgctttccctgttgagtaagcctttataatatgcagcttaaaagccacatataatgaggtattcattccaaaggttggcaggtcatgagttagggttcttagatcccatctaggttacaaattgtctattttatgcctgggcctaaatcaaagccattctaaactattcaaacttttctcccctcccagcatgtacgtcttctgtcccgtaaacagttccagctgagggcactaatgcaaaaagcaagaaagactgccggtctcagtgacctctactgacttctctgataccagctggaggttgagctcttcttaaagtattcttctcttccttttatcagtaggtgcccagaataagttattgcagtttatcattcaagtgtaaaatattttgaatcaataatatattttctgttttcttttggtaaagactggcttttattaatgcactttctatcctctgtaaactttttgtgctgaatgttgggactgctaaataaaatttgttgcat

SEQ ID NO: 35972 - DNA, 28453 bp, Homo sapiens
ggcctggccggggcgggcggcgcgggggcggcatgagggcccgcggcccggggggctgaggcgcccgccgcctgccgcgggggccgctcgcgtcctccatggaggccggaggtgagtggggccgggcgcgcccgttcccgcccggcggggccctggcccgttctccccggggaggggggaggcgaccccggggcgggctgggcggggtggggcgggggctggacgcggcgggggcgtccggcctgggaggtccgcgcggggccggcgggggtgcgcgcccggcgaccagctttgtttcactttcgttgtcagtggccgccaccctgactcccgccggcgacaggatcgggaagatcgggcttctgcgggaggagatcccccgaccgggacagagggggctcccgggtgggactcggggcggggggcaccaagccctaaaacggagatccccaagggggtgggtgcccctgggtacccaggtgccaggggacgcacttgcatgtctggatgggagtcacctctgtccctcacaagctgtgtgatcgtgacagtggacaagccactgaaccaccgccacccacgtctcagttttgatctgcaaaatgggataatcctagtaccttcctcggagggtggctgggacccggtaaaaatggggtctggggtctgggttccctattgaaacaatctattcccagcctctcccactggagattaagtcagtggaggtggggcgggactggagacgctgatccctggtgacatgtatgatcaggcaaatttaggatacactgatgggtggggaccttgcctctattcttgttaactgccatccccatcagaagacagcgtggaagtcagaggatattggatatacctcaagccagcccagatgaacataaaatctcagtgggaaaggtgtgtctcttatgcaaggggaaaaaaaccccaagacgcatgcacgccttggccctctcccctccaacgaccttccctcggaaccccacttgggatagatttagaattgattccgggagtcccaggtcttgaaggacccgagtttaaatgtaatttccttaggagaaattttcagagcaggttcaaggcctagggctcagaatttgttccagaacttcatggtaatcttgcagccaagttcaagcttcatcctggtctggagggttctgattgctgatggcttgttactgtgggtgggaaggttgaaatctgggtattccctggggtggtgttactttttaatttaggaaatgacatttctttgtttgctgaagtcaggcattgagttaaaggcagctctctctccttcccatctagataagggctttcttttcagtgagtgttacccgtagaattctttttaaaagggcccctactgtttgtgtagatcctatgtgaatctttttatagcttccgtttgatttccattgcctccttacagttcaatctgaaagcaatctgtagctagcctgcctttttaacagaaatctgtttccagttctggggttttcctaaagattgacaacttcgttttgagggtgtgggcagggttgttgagagctgccaagttactgtacaaaaaaggccagagttttaacttattttcaaatggaataaagcccattgtaaaggaaatacaatgggcaacagttgaaatcttcagagcaatggttagacttcacttattcattcagcaaatatttgttgaacgtctactatgtgccaggcaccctctaggccagccccgaccaacagaagtctaatgtgagccacgtatgtaatttaaaatgttcaagtagccacattaaaaaaaagaaaaaagaactaggtgacaatttaaaaactctttcaatacaacatgtctaaaatattcctgctacatgtaatcaaataaattgtaatgtaatgttttagatttttttttgtgctaagtgttcaaaacgtgttgtgtattttttacttacagcccatctgaattctgacttgccacatttcaagtggttggtaaccacatgtgatttccctattagacagtgtagcccaatagcagtgaactggcaagtttgggtgggttcagaaagagacagacaataaatacgtaaaaatgacaggcaatcaagaaaatatcaaccaaatgcgccggggtggctcacgtctgtaatctcagcactttgggaggctgaggcgggcagatcacttgaggccaggagttcgagaccagcctcaccaacataatgaaactccgtctctactaaaaatacaaaattaaccaggcgtggtggtgcatacctgtaatcccagctactcaggaggctgaggcaggagaaccgcttgaactggagaggtggaggttgcagtgaaccaagatctcgccattgcactccagcctgggcaacaagagtgaaactccatctcaaaaaaaaaaaaagaagaagaaaatatctaagtgatggttataaagaaaatcaaatggttaaaggaaagtgaatggtgccaggcgcagtggcccagcagtttgggaggccaacttgggtagatcacttgagctcaggagtttgagaccagtctaggcagcatggcaaaaccccatctctgcaaaaaataccgaactataggcgcgtgcatggtagaatgtgcctgtagtcccagctactggggaggctgagatgggaggatcatctgagcctggggaggtcgaggttgcagtgagccgtgatggtgctactgcattccagcctgggcaacagagcaagaccctgtctcaaaaaaaataaaaaataaaaaaggaaagtgtatggtcgctttagatagtgaggccaggatggtctctgagaaggtgacatgaggaccaatccctgaatgataagatggagcaactgaggaaagcttttgaggccggtggaatatctaatgtacatgtcctgatacaggaaaaatcacctagcttcctgctggctggggtcatagctttcatctctgtgttaaggctaactgctttgcctagaagaggcttataatatatacctttccattcagcctgattgtccaaacacatcccattgtttaattagaacaccctgatccagggccaggtgcaatggctcatgcctgcaggagaatcgcttgagctcaggagatcaaaaccagcttggtcaacatagccagacccccatctctactaaaaatttaatttaaaaaaaaaaaaaatgctgagtgtggtggtacgcccccgtagcccgatacacaggaggctgaggcgggaggatcacttgaatctgggtgggagattgaggctgcagtgagctgtgattcagccactgcaccccagcctgggtctcaaaaaaaaaaaaaacccaaatatatatatgaatatgatatacttgaaatttgctaagagtagattttaagtgttctcaccacacaaaaataagtatgtgaggtaatgcatatatggtaatgagcttgactgagccattccacaatgtatacatatatcaaaacatgttatattccataatatatacaatttttatttatcagtttaaaaaagaagaggctggacgcggtgactcacgcctgcaatcccagcactttgggaggccgaggtgggcagatcacctgaggtcaggagttcgagaccagcctggccaaaatggtgaaaccccatctctactaaaaatacaaaaattagccaggtgtggtggcgcatgcctgtaattctagctactcgggaggctgaggcaggagaatcacttgaacccagggggcggaggttgcaatgagccgagatggcgccactgcactccagcctgggcagcagagtgagactctgtctcaaaaaaaaaaggagaaaacaaagaaaccctgattcataggccttttcaccaagaaggatctacaagtaccataccagttgaagctagataccccacccccagctctgtttttgtttgtttgttttgtttttaagttctgcactaattagggctttctctccgtgtagccaagtttagtttgggcccagactccaagagacaggagtcactgggtttgttcttcttttagctcctggattcctgaacctgaaatagcaagagattaaatccctaaatcacagaaatagagtgtgaattctgagtagggcttgtgtttaagaagcatttcatgtgaaatgtttggcataagcatcatcagagtttaaggggctttatttattttttattttttggggacagagtcttgctctgtcacccaggctggagtacagtggtgcaatcttggctcactgcaacctgcacctcccgggttcaagtgattctcctgcctcagcctcccgagtagctgcgactacaggcgcccgccactatgcccggctaatttttgtattttaagtagagacggggtttcaccacgttggccaggctggtcttgaactcctggccccaagtgacctgcctgcctcggcctcccaaagtgttgggattacaagcatgagctaccatgcctggccagctttatgttacttttttgtttaaagagttataccatatgtatttattagacaaatatttactcactgcctgccctccaccaggaactctgccagctctggggataaatatacaaagttcttgctccctggagttgatatcctagtggaggggagacagatggcgatcaaatggtgatagagctgtaaagaaaataaagtgaggggttgtgaaggagattgactaggggtcagaagagttctctaagcagttgtcatttgagccagacctgaataagagtagatgccagccgaggagaggcattccaggtgaagggcatggttggtgcaaaggcctagggtcagaactaattgagcattggcagagggtagagagaagggcaatgtgttggagccaggggcagggagagaagtacaagcccagggaagttcagattatgctggattttgagggcagggtgaggagctagagttttattctaacagtgtttgaaactgaccactctggaggcaaggagaaccgatggtgcggggctagaggggaagccgggagagcagctggaaggttgcctactgggccaggcgggagatgatgctgcatagatgagagtagagatggagaggggttagatttggcaagtcttttgtaaacagacttgatagaacttgctaatggatttggtttgggagatttaaaaaaaaaaaaacagacgtggtggtttacacctgtaatcccagcactttgggagtccgaggtgggcggattgcttcagtctaggagtttgagaccagcctggccaagatagcaaaaacctgtctctactaaaaatacaaaaattagctgggtgtggtggtgcacgcctgtaatcccagcttcttggaaggctgaggcataagaatttcttgaacccaggaggccgaggttgcagtgagccgagattgtgccattgcagtccagcctgggtgacagagtgagactccatctcaaaaaaaaaaaaaaaaaaaaaaaaaggataatgtagaggaagtgaaccaattgtgaatgttatcaggatggaaaaaaaaaagacattttcatcctggtcatttgatccggaattcctggtctcaagcaattcttccacctctgcctcccagagcactgggattacaggcatgagccactaccccaggccatccaggtcatttgaaaatgtttctctagatcagtcaatgtcatttaatacttgactgcatctgggtttctcagccttggcattgttgacattttgggccagatgattctttgctgggggctgtcctgtgcgctgtagagtgttgagcagcatccctggcctccacccactagatggcagtagtagcaactccagttgtgacaaccaaaaatgttactgccaaatgtccttaaggggcaaactagcccccagttgagaaccctgggtctatagaaatagctatacacatgtgattgtataaatgaaactgtcacacatacaaacatacagatttctaggaggatttacctgggtctatacaaatagctatttactcagaccatatatataaaaatatatttctttcttttttctttttttttttttttaaagagatggagtcttaccatgttgaccaggctggtcttgaactcctggcctcaagctatcatcccatctcggcctaccaaagtgctaggattataggcgtgagccaccgtgcctggcctagacctaatacattaaacccaaatttacacatagaacctctgagaatgaatagtctctttacaaaggcttgatatgatttattaacattctatttaaagacagaaacttcaggaacacacacctattttatataacaagatatacctatgttattattttcctataaatgcatatactagaattattattattattattattattattattattttttgagacagagtttcactcttgttgcccaggctggagtgcaatgacaccatctcagctcaccgcaacctctgccttccgcctcccgggttcaagcgattctcctgcctcagccctctgagtagctgggattacaggcatgcgccaccaagcccggcttattttgtatttttagtagagatggggtttctccatgttggtcaggctggtctcgaactcccgacctcaggtgatctgcccgccttggcctcacaaagtgctgggattacaggcatgagccaatttttttttgagacagagtctcgctctgtcacccaggctggagtgcagtggcacgatctcggctcactgtaacctccgcctcctgggttcaagtgcttctcctgcttcagcttcccgagtagctgggactgcaggtgcccgccaccatgtctggctaattttttttttttttttttttttttggatttttagtagagacatggtttcaccatgtttgccaggctggtcttaaactcctgtcctcaagtgatctgcctgccttggcctcccaaagtgctgggattacagatgtgagccactgcacctggcaaaaatattttataaatatacacatatgcatctctaccatctgttttattgaatccaagataccatggattgtattatcatcatgtataactgagaaaaaaatactacctatttaactatgaaaagtcattgattataagatacatcctgatttcagcgaggtcaaaatgtaagatatataaagatgtgtcttaaaatatatgaaatacgggttttaaaaatgaatatctatctggtaacagccagggtcaaagtcttccacattccacattccttgtgtggaatggacacatcaggaagtgaccttattcaggatggaagccagtttttatattagtaagtatcacagtcataatggtcaaaaaattcattctgaaggcctttaacttataagcttcatcagccatgagaatcttccatcagagtagagaactgaactaggaactgtgggtcagtcaatgaagaagctccaatctggtgcctactctttcacaagatggtgtgctaggtcctgggagaaacaaagacaaaatgatctgggtgttggaacaaggtgcttagacactgatgacgagggcggggggcagagagaaattggttacataagagagaatgaaataaacaaggtgcgacttatttccgttttgatagtgtgagatcagggtacgcttcttagttgtgaatctaggtgggattattacttttttctttctttcttgttactttgagaagctagggattctcataagcaaaagtgggtccaggtgtgaacgtaaataagccccttgcatgtcaaggagattttgtggccagagtgtggcctgcagggaggggacaagggaaggaggttggaccgatgggctggggcagatggcatgtggtgaaagtcctggtctcagttgcctttatgatgtaggcaggcgggagctttctaatgtatttgaaagaaatgatgtgatgtgtgggtatttcagctttagcagcatctctaggggtaggaagactgatcaggagactgtagcaaaagatctgggtgagatgagatgaaggtttaaccccagacagaggacgtggaagcgggagagatggggagatggaatccatacttctgagtgtgaggaagcagggcaagggctgaacgtttttagccttgatgatggggaggatgcaggcgagtgagagggagcctttgagtttcacatattccttctttgacagcagcaggttcttctgaagaaacctgaaatgcattggaaggccttgctattttggccccataatcagcaccgtctagcatattcctggtctggctgtctctccactttcctccccttcaagtattcataggaaaatgaggcctccattcactgggttcatgggcacaaaggttactgtgagtcatggttaaccagcagtgaggagtgccaggattgagtaaccgtggtggaatgtggcctgtggctgctgttattgccctgggtcatttaagtgacaactccctctgggaatggatagtgtggctctttgccacagggagacagtggctttcctgtgtctgggtggtcagggagcaagggggtgtgtgtttgaagcatgttgtctcctgccccagaggaaccgctgctgctggccgaactcaagcccgggcgcccccaccagtttgattggaagtccagctgtgaaacctggagcgtcgccttctccccagatggctcctggtttgcttggtctcaaggacactgcatcgtcaaactgatcccctggccgttggaggagcagttgtaagtattctcgtactggggccccatccggcgcatttccaaacactccttgttcttttgccatctctgtgcccaagaaccagagagagggaaggtggctcatggttcaggaattgatcatgggggtttccagagccccaagttctgtatatgtgaaagtcaattctgtcaagattatgttagccccaagttggctttttttcccatagctttattgagatgtaatttatataccacacagtttgtccatttaagtatacaatacagtggcttttagtctatccacagagttgtgcatccatcaccatcatcagtcttactttatttatttattttttgagacagtctccctctgtctcctaggctggagtgcaatggcgcaatcttggctcactacaacctctgcctcctgggttcaagcgattctcctgcctcagcctcctgagtagctgggattacaggcacacaccaccacgcctggctaagttttgtattattagtagagacgaggtttcgccatgttggccaggctggtctcaaactcctgacctcaagtgattcacccacctcggcctcccgaagtgctgggattacacatttctcccatgagccactgtgcctggcacataatcaattttagaatatctttatttcctcagaaagaaaccctgtaccccttaatttagatcccccaacccccctgcactctccaggcaaccactaatctactttgtctctctagattggcctattctagacatttcctattaatggagtcatacaacacgtagccttttttgactagctcctttcattttacataatgttttcacagttcatccgtattctagcatatactagtatttcatttccttttattgcatcatatggagatgccaaattttgttcgtacatttatcagttgatggacattgggttgttttcatgttttggttattacaaatagtgctgctatgaacatttatagaaaacctgtgttttctatgtttaactatttgaggaggtgtcagactgttttccagagtggctgcaccattttactttcccaccagcagtggattcaggttccagattctctacatccagccgttgttattgtctgtctttttttattatcctagcaggcagccatcctagtggtatgaagtggcatttcatagtggtttcgatttgcatttccttgatggctatggatgtcaagcgtcttttctttctttctttttttttttctttttttgagacagagtctcactctgttgttcaggctggagtacagtggcatgatctcagcttattgcaacctccacctcctgggttcaagcaattctcctgcctcagcctcccaagtagctgggactacaggcacataccaccacgcctagataatttttgtatttttagtagagacgagatttcactatgttggccaggctggtctcaaactcctgacctcaggtgatccacctgccttggcctcccaaagtgttgggattacaggtgtgagccaccacacctggccgagcatcttttcaggtgcttactggtcctttgtatacgttctttggataaatgtctactcagagcctttgctcgtttttgtctttttattatcaaccaagtttattttattcatttattttttttgagagagagagagggtcttgctctgttgtccaggcttgagtgcagtagctcagtcacggctcactgcagcctcaacctgctggtctcaagctatcctcctgccctagcctcccaagtacctgatactacaggcgcgccaccatgcccagccaacttttaaattttttgtagagacagggtcttgcctaggctggtcttgaactcctggcctcaagaaatcctcccgcctcagcctcccaagtagctgggattacaggtgtgagccatggcgcttggccaagtttagtttctaataccagtttttctttctttgggatggacaagccccagtgtcagaatgccgtgagctcccattcagatggcccagcatctgtatgttttcatttgtcccagggcaactctatgtctgtatttattcattcagccagccttggttgcgtagtttctttttttttcttttgagatggagtctcgctctgtcgcccgggctggagtgcgatggtgcgatctcggctcactgcaacctccacttccctcctgcctcagcctcctgagtagctgggattacaggcatgcgccaccacccctagctaatttttttgtatttttagtagagatggggttttactatgttggccagccttggttacatagtttctttgcgtaacactgagttagggactgagagtcgttagataaatcagacatggcccttgcccttgaggctttcatttatttttctttaagcattttttataaataacattagatttaaggtttttataagttggatatgaaacttgccttgataagagggaatgttgacaggagtttgttgagatgggtactctgcatgctgctagagttgagggggataaatttgtgcagtttttggaaggaagcctggcaaaatgcatcaaggacctgaaaaatgttcttctgggctgggcgcggtacctgatgcctgtaatcccagcactttgggaggccgaggcaggcagatcacttgaggtcaggagtttgagactagtctggccaacatggtgaaaccctgtctctattaaaaatacaaaaagttagccaggtgtggtggtgtgcacctgtaatcccagctactcaggaggctgaggtaggagaatcgcgtgaacctgggaggcggaggttgcagtgagctgagatcgcgccactgcactccagcctgggtaacagagcgagattccatctcaaaaaaaaaaaaatctcagaaatggtgtcatctatttatatacactgatcttcatcatgaaattagttgcatgttaagaaaattggaaacagtttgaaatccagggatgagaggatggttacgaaaattttaccatttccatatgatatttttgcagccatcaaattttgttatgtgtttttaatcagagttttcagtttcttctgtggtcagtttaatgataatgccaaggtcatacattgtttactaattccctacctgaaatacaagggatgcaccttcatttctagacttgacatgtaagtaaatttactatatgaattataaattctatagtctgctctttttaaaaagcacaacatggaagatctgtcagtttcctgaaaatcactcttgttttcaaatttgtatagataaatatgtcttttttctgtcacatgacctagagctgctcccgggtagaaggaagggcctgggcttgcatctccctaagggcactgtgggtggctcagggtctagtgtggagcatgtgtcggttggggaaagctcctttactttaattactggtatcagtaaatgaaaacaataacaatttttttttctgaatcctatttctgaacaaaccataaatttaaatcctatttctgaacaaaacataaatttgtatagatgaatatatcttttcactattagctaaggaaaatgaaaaaaggtatttgagtattaaccattttttttcatatttattatttaacataatgagcaaagtgttattgtttcatatgttaagtgagaagttactggttttggagaaaaatcacatttttttttttttttgagagagtcttgctctgtcatccaggccagagtgtagtggcgcatctcggctcactttaacctctgcctcctggattcaagtggtcctcctgcttcagcctcctaactgggattacaggcgtgtgccaccacactcagctaatttttttgtatttttagaagagacaagttttcaccatgttgcccaggccagtctttgactcctggcctcaagggatctacctgccttggcctcccaaagtgctgggattacaggcgtgagccattgcacctggcaaaatcacatattttgaagaacagtattctgaggaaatgtttgcagtatgaggcttattgaaaaaaaacaggctatatggccgggtgcggtggctcacgcctgtaatcccagcacattgggaggcagaagtgggaggatcacttgaggctaggagttctagatcagcatgggcaacgtaacaagacttggtttctacaaaaaagttttaaaaattagcctggcgtggtggcaggtgcatgtggtcctagctactcaggaggctgagatgggaggatcacctgcacccaggaattagaggctgcagtgagctctgatcataccaggccactccagcctgggcaacagtaagacactgtctcttaaaaaaacaaaaaaaagcagtttgtaaaaccatgtatgcagtatgatatcagatttgtttttaaaagacatttgtgtatatacacaaaaatttatagtgagacgtttagaatggtggtgttaggattataggtaatttttactttgtctcattttcacatttctcccatgtttcgctactatttttatttattatttttataatttaaaataatcgggctttttggggggcagagaaaaggtcttgctctgtcacccaggctggagtacagtggcatgatcatagctcactgcagccttgaactccttgtctcaagtgatcctcccacctcagcttcctaaaggcgtagccgccacaccctgccaacaatagctattttaaaagtattttaaaagagagaatttggggcatttatattctagttagggtagttatacattttttaaaaatcatgtagtgcttttgatattgagcaaataattgatattaaccaaataattatactgctttttgaaataaagtttttagaaactttaacttcagtgaagctaaattctgccaatgaatctgtcttgcctcatcagctctttcccacggtacgacctccctgcttttcacgtaactcatcccttgattcattagcaaactcaaagtatttgttgagcattaggccaggatacctaagaccttagttccagttctgcccctgattttgtgaccccaggaaagttaataacccataaaatggagattttagtatctctttctagaaaaattaaatttaggatattaaaatgaaataataaatatgccttaattcttttggaataaagtagctacaggtgtattccttaattcaaatacagaaattagggccaggtttggtgtcacacgcctgtaatctcagcactttgggaggctgaggtggggtggattgcttgaggccaggatttagtgactaacctgggcagcatagtgagaccctgtctctgcaaaaattaaaaaattagctgggtatggtggcatgcgcctgtagtcccagctactcaggaggctgagatggaaggactgctcgagccctggagttcaaggctgctgtaagctatggtcacaccactgcactgcagcctgggtgccagagagagaccctgtctttaaaaaaaaccaaaataaataaaacaaatacagaaatcaggattttataacaaataaaacaaatttaactggtggttccaagctgtcttaaacctcttcccatagcctgcctcttaagtgctgcttctcgtgacaacaaactcaggggccagtgccagggccagagccaggcaggtctggacagtctgtggagaggcagccgatcgaagtgacattcatggtcacattcagattgtttggccagaataacaagttttagcctatatttggcgatttagacccagaggttgacaaattttttctttctttttttttttttttttgagatggagtcttgctctgtcatccaggctggagtgcaggcagtggtgcaacctcggttcactgcaacctctgcctcctgggctcaagtgattctcctgcttcagcctcccgagtagctgggactataggcaccccccaccaggcctggctagtttttttgtatttttagtagagatggggtatcaccatgttggccaggctggtctcaaactcccgacctcaagtgatccgcccgcctcagcctcccaaagtgctgggattacaggcgtgagccatggtacctggccaactttttctataaatagtttaggctttgtgggccataaggtccctgtcttgactgttgaactccgctgtcacagtgtgaaagcagcctcagacaatacctaaccaaatgcctgtggctgcgttccaataaaactttattgacaagaacaaaatcctgtcatttgctacaacatggatgaacctgagggactttatcctaagtgaaatgcactaggcacagagagacaaatactgcatgatctcacttacatgtagaatctaaaaatatctaactcatagaaacagagagtagaatggtggttaccgggggtgggagagggagtggggagatattgatcaaaggtataaagtttcagctaagcagggtaagttcagaagatctattgtatggcatgatgactgtggttattaataatgtacacttgacaattgctaagagtgtagaccttttttttttttttttctttgagacagtgtctgactctgtcacccaggctggagtgcagtggtgtgatcttggctcagtgcaacctccgcctcctggctcaagcaatcctcccacatcagcctcctgagtagctgggattacaggcatgcgccaccaggtccctgccaccacgtccagctaatttttgtatttttagtagagatggggtttcaccatattggtcaggctggtctcgaactcctgacctcaggtgatccacccacctcagcctcccaaattgctggaattacaggtgtgagccaccgtgcccggcccctcccttctaattttgtaaatgagcttggttaaaattcttttttttttttgagatggagtcttgctctgttgcccaggctggagtgcagtggtgcgatctcagctcactgcaagctccgcctcccgggttcacgccattctcctgcctcagcctctccgagtagctgggactacaggcacccgccaccacgcccggctaattttttgtatttttagtagagaaggggtttcaccgtggtctcgatctcctgacctcgtgatctgcccaccttggcctcccaaagtgctgggattacaagcatgagccaccgcacccggccagttaaaattcttttgtgtatttcaccacacaattgacaaaaatgtgatttacttagaatttttcaggaacatctataatattgggttggtgcaaaagtaatggtggtaattgcaaatactgcaattattttcgcaccaattaatacataaagatgttcaactacgtatgcattgagtttaggatttctcatggaatcaaatctgacctcatcctggcgttcagctttctcatctccatttccgccagtttaaccaaccagagtgtggtcagggtcacatggagacctttgtgctgtgtaccgcaaacagtaagcttcatgttttcaggctcaaccccagggccggccaagtgcttgtgcatttgagacattgtttcctgggcgcagtggtggccagggcctcatgttttagcttatctgggcctgtttcactgtaagttgaattgtaggagagggtgggattaagagatcttccaggacaggatacctctacacagccctgtgaattcgttttctctcttgactaccttgctgtttgatccttgtgcgggttaccatcagttaggaagtaaatgaaggagcctcattaatcagttgcaacatcgtgagtgaaggtggaaattaacatgtaccaaacaaacggtgttggcaagatgagtttattttccaactccttggggatttctaagctagtgataagggaactcatcaggcaggagagtggtggatattcagcctctaagttctgccctagttccaaacctgcagtatgctttcttactcatgggaaaaactgagtgtctttttccttccactcatcaaaacctgagagaactttctgagcaagcatgtgactccctggagcatctgttatttagttatcccacaaggcaggtcaccccattgcagggctgttgcaaatagattgagccatggccagtatagcctgtgttaacatcaactctttttttttttgagatagagttttgccttcgttccccaggctggagtgcaatggtgcggtcttggttcactgcaacctccacccactgggttcaagcgattctcctgcctcagcctcctaagtagctggggttacaggcacccgccactacgcccggcgaattgttttttttttttagtagagatggggtttcaccatgttggccaggctggtctcgaattctagacctcaggcgatccacctgccttagcctcccaaagtgctgggattacgggcatgagccaccacgcctggcctacatcaactcttaaaaagaaacaaaaagaaaagtcacagcagatttcaccgaaggccagcttgtttctaggatttaaagtcttatgtggccgggtggggtggcttatgccagtaatcccagcactttgggagggcaaggtgggcagatcacttgagctcaggagtttgagaccagcctgggcaacatgacaaaactccgtcctacaaaaaatacaaacaaagttaacagagcctaatggcacatgcctgtcgtcctagctacttggtggatctgaggcaggaggatcagttgaacagggaggtcgaggctgcagtgagccatgattgtgtcactgtacgccagcttgggtgacagacccttccctccactccccaaaagtcttacgtgtcccaggatgaaaagttgatagactggtaacaattgcagattcattaagaaatctctgcttctcccagcatccctaaagggtttgaagccaaaagccgaagtagcaaaaatgagacgaaagggcggggcagcccaaaagagaagacgctggactgtggtcagattgtctgggggctggccttcagcccgtggccttccccacccagcaggaagctctgggcacgccaccacccccaagtgcccgatgtctcttgcctggttcttgctacgggactcaacgatgggcagatcaagatctgggaggtgcagacaggtaggtcattcctggctggcacaaggttctgggaggctcgggtgcatgttctgactatgtcgcctccctgccccactcacgttggccaaggggtgtggccgtggcaggcacacctcgtgccccctctctggctgactcagtgcccctgctcccatgccagggctcctgcttttgaatctttccggccaccaagatgtcgtgagagatctgagcttcacacccagtggcagtttgattttggtctccgcgtcacgggataagactcttcgcatctgggacctgaataaacacggtatgggaagtgaaggaactactcggcaactccaaaaatactgtatttgctttctccactttaccagtgtcatttttatctaaaacagtgtttcttgatgtttttttctgtgattgccccttaaggagccttttagacagttttttcctaatcgcccctgcccgccccaaagataatactataccaaatagagtttaataccgaacatatactgtgtgtctatttaggctattttaatatcgaagatatattgtatatctacttatgtgctgaatgcatgtctatgctttgtatgtaaaaaaatgttaagatttttttggctaccaagaactagtttgtaccctcttggggtgaattgcccctgttaaaaatatttgatctagaacaggttttctcatcggcactatggatattttgggctggataaccctttgtcgtgggctctcctgtgcattctaagacactgagcagcgtgcctggtctcttctcttttgatgccagtagcatcctctccagttgtgacaagcaaaaaagtccccatgtcctgtgaagggcaaggtctccccaggttgagaaccactgatctagaagtccctgttgggtgcttcctgttagaaagaaagactttctttttgaagcagactctaagcctagaataattctctcaggctatggggcatcaggttttgtgaaattctgcctcgagcaaactatatacaggggtggcccaataaggaattccatacatttctggattgatccttaactagaaaggtgatataagaggccaggcacagtggctcacgcctgtaatcccagtactttgggaggctgaggcgggtggatcacctgaggtcaggagttcaagaccagcctggccaacatggccaaaccccatctctactaaaaaatacaaaaatgagctgggcgtggtggtgggcgcctgtagtcccagctactcgggaggctgaggcaggagaatcacttgaacctgggaggcagaagttgcagtgagctgagatcgcatcactgcactccagcctgggcaacagagcaagactctgtctcaaaaaaaaaaaaaaaaaaaaaaaagtgacataagagaggggaatttattgcaatgccatctttcaattcctccagccctggatggggctcaggggctggagggattggaaggaggcagtggtaaagggtcatgaagaggatcaggggctggagggattggaaggagggtcatgaagaggccacttgtccccatggtgtgaaggcactggcactctctcccaagctatgactgtccagctccacacagccatgggagggacctttctcctgctcttttagcaatgagcctgaaaacttgtatcttagtcaatgccagagactgggtggcttaaacaacagacatttatttctcacagttctgaaggttggggagtccgtgagcgaagtgctagtagttttggtgtctgtgagcacctgctgcctggcttgtaaacagccaccttctctctgcatcctcatctggcagggatctctctctttcatgtctcttcttctaagggcactaatcccattcctgaggcttcaccctcatgacctattgacttctcaaaagccccgcctcctaataccatcacattggggattagggctttatgtgtggggggcacatttagtccatagcaacttgtcagacaaactaaggcagtgcacatgcatcctcatctgaaggcatctgatcaccaagataactctaggtgtttttttggtttgtttgttttttcttgagacggagtctcactgtgtcacccaggctggagtgcagtggcacgatctcagctcactgcaacctccgcctcccaggttcaagtcattcttgtgtctcagcctcccaagtagctgggactacaggcgtaagccaccatacctggctaatgttttgtatttttagtagagacagggtttcaccacgttggccaggctggtctcaaactcctgacctcaagtgatctgcctacctgggcttcctaaagtgctgggattacaggcgtgagccactgcgcctggcctactctaggtggtttctgcccagtactgtggaacctgtaatcccacagtctaagatgtgctgctgatcaggacagcttctccaaggcagtgcctcttttttttttttttttgagacagagcctcctccaggtgtgtgccaccatgcctggctaattttcgtatttttagtagagacggggttttgccatgaaggtcaggctggtcttgcactcctgacctgaagggatctgcccacctcggcctcccaaagtgctgggattacaggtatgaggtaccacgctcggctggcagtgcctttttaaatgctggcttaatgtgtgtactgaggcagcttgccaccatctcaggaaggtccatgcagtggctctggaaatcacttgatgacttggaaggaaagaccaagtgagagtgaccaagagtgggcgggatggagtaggccaattatgagagcttttcaaggagaggaggggaataaagttggttcccagctgacaggcgctgccccactgacctaacatgccttaatttattcagtactcccagcaccctgagatttgacagctgaagaaaccatgattgacctttattttttgagacagagtctcactgtgttgcatgggctggagtgcaatgctgcgatctcggcttattgtagcctctgcctcctgggctccagtgatcctcctgcctcagtctctggagtagctgggactacaggcaccatgactaactttttaaaaatattaattaaagcactttgggaggccaaggcgggcggatcactcgaggtcaggagttcgagaccagcctagccaacatggtgaaactccggctctactaaaaatatgtaaaaattagcagggcatggtggcagatacctgtaatcccagctactcgggaggctgaggcaggagaatcgcttgaacccaggaggcagaggttgcagtgagccgggatcatgccattgcactcccacctaggcaacagaacaagactctgtctcaaaaaaataaaaaaaaataaaaaagaaatattaatttttgtggatccatacatccgcataaacttaaataaattcatatatatgaccatgtacaggcgtataacaattattttttcttctttcttgcttggctctttccttcccaattctctctcttgccctccctgctgttgccatcctcccttcttcccctgcatcctggtaccctgtgttaggagtatatacccttccatatttttctgtctacttgtataatcctgtgcacacacgtttgcattcatggcttttgggtcattgtttgacaaaaatggaatcatacatcttcacgatttttccctgcatctcgcatttttcattaaactgtaggtaccccatggaaaatctctctctaattccaactgcattaatggggtagatataccaccatttattcacccatcctctatatggacgggcttttttatttttaaagcaagagctggagagattgtgtgagacaccctgggttatctgctgaattagcaggggagtcaggattcaaacccaagctgtctgactctagaatgtgtgcccctagtgactccacaccactgctcatctggacatcctggcaaggctgggagggtgacagtctggagcaggatccttgtgattacagagaaaccattacagagtttaaatgaagataaacactctcttaaaattgggaatgatgcttcagggtacttgaggtggttggggagcctaaaaagaacattctctgctatcaaaggtccctttgatatggtttcctatgaggaaacctttaatgcaattcaagattatataaaaaaagtgatcagcacctgaggtcaggtgtccgagaccagcctggccaatatggtgaaaccctgtctctactaaaagtacaaaaatgagctgggcgcagtggcacatccctgtaatcccagctactcaggaggctgaggcaggagaatcgcttcaacttgggaggcagaggttgcagtgagctgagatcgcgccactgtattctagtctgggagacagagcaagagcaagactccatctcagaaacaaacaacaaaaaagtgatcaatgtaccccttcacccttactgatcttatagattgtgttgaagccataggtactggtttccgtggggaattagaatatcatattcatagattacaggtgtttaaatgacaaatctggtcatatttcttactctgaattaaaaattggacccttgggcccagctgataggagctgatgggtatactgggctgggggctgttaccaccccagttctcccgttctccagtcttcctgctttgttgaggactggctcattgtttgcttctttttcctgccaggtaaacagattcaagtgttatcgggccacctgcagtgggtttactgctgttccatctccccagactgcagcatgctgtgctctgcagctggagagaagtcggtgagtctccagcgttattgctttaattcactgagacatggaggtctgaagtggtggcctggtgtgtgtgagtgttctcaaaatcgtccgcaaatccaccccaatagaaggcatgctggtgggccatggccaccacctgcaaaagtcccttgtgacttgcactttaacacgaacccaaagacaggagggatttggaaacaggttgctcctgtcatcagagggctgtttccctttataaaatgggaaaacaattgctttttaaatttcttttcttcttggagtctaagattttaaaagttgcagcccacatgtgaatccaaatttcctttgaaccatcaaatttgaatccctctaattcggatttcccattcaaatcatgtcagtgcagttacttgttgaactttgtcctgaaatcctgttaattgaaaaaacaaacaggtattagaaatccaagaacaatttgagaacagttctgtttgaattttgtgttgcgttgagtcacttgctgtgactgaagggaaggttgagagttcaccatttggtacagcccaggtggttcatcatttatttttgtggtttggagggttttcttttcttttcttttctttttttttttttttagacagagtttcgctgttgttgcccaagctggagtgcaatgacgcaatctcggcttactgcaacctccgcttcccgggttcaagcgattctcctgcctcagcctcccgagtagctgggattataggcgtgctacaccacgcctggctaattttttgtatttttagtagaaatgaggtttcaccatattagccaggctggtcttgaactcctgacctcaggtgatccgcccgcctgggcctcccaaagtgctgggattgcaggcgtgagccaccgcgcctggcctgagggttttcttaaaggaataaaaataaaatcctcttaatgcttctcacaaaggtttaaagtgatgagctaggtcagaggcccagtcttgggacagatttccatggttccatacacaaggtggggggtgtaaaatgccttggcagcctgccactactttgtggggtggccgcagatttcacttctgaccctttaaaaaaaatttgagacagtcttactctttcgcccaagctggagtgcagtgacgtgatctcaggtcactgcaacctccacctaccaggctcaagtgattcttctgcctcaacctcccaaatagctgggcttacaggcgtgcaccaccatgcctggctaatttttgtattttcagtagagatggggttttgccatgttgaccaagctggtcttgaactcctggcctcatgtgatccacccacctcagccacccaaagtgctgagattacaggcatgagccatcgtgcctggccgctgacatttatttttaagtggaataagatagcacttggctcaggtcttcatcagcacatacgactaccctattggcaaacaggactcagaagcagactcagaagtctctgcacatgcgtttcagcaggggtcttcctaaggctgatctggtttattctctcttatagtgagctccttgagcatgcccattgttttaaatcctcaagaatccagaccagttgccttatttaaacctacaccacacgttctggaagagctgtagaaaagggatagagaatcagccctggctgcagggcctgcagatttggtggtggtacctttccctccctccgtttgagtcctaagcactttgcttctgccctaaccaggcacttcttactttccacaggtctttctatggagcatgaggtcctacacgttaattcggaagctagagggccatcaaagcagtgttgtctcttgtgacttctcccccgactctgccctgcttgtcacggcttcttacgataccaatgtgattatgtgggacccctacaccggcgaaaggctgaggtcactccagtaaggactgaatccctgctatgacttttttgtggggggactgatgaggaacctgcctgggattagacatgtctcttttagaatctgggacatgggaggggacaagctggataaaaaggcacagtgggtctcttttgagacggagtctcgctctgtcacccaggctggagtgcagtggcgcaatcttggatcactgcaacctccacctcccgggttcaagcgattctgctgcctgagcctcccgagtagctaggactacaagcgtgcgccaccaggcctggctaatttttgtatttttattagagatggggtttcaccatgttggccaggctagtctcaaactcctgacctcaggtgatccaccgcctcagtctcccaaactgctattataggcatgagccactgcgcctggcctggttcattgcttcttagtgatgccttgtcaattaagccctctcaagtagctttgagtgtcttccagtctcctgattcaggtggctgtgtgtacttcttcggaatcagcattatgaagcctcaatatgactctttatttccatttactaataactgtagtaacaagttcagaaagagcctcttatcgaaactgtgctttccaaaatgagtttcatgttctcacaaacttggtctcctttttccttttgtgtctgttgttttatgaagcaaataataggcagtcctataattatcatgtatcttagcctaaaaaagacttgcagtttctactgtggcattaaagtgagggctgacctactttgcataagcaaattagcacaaggaagtgttagtaacccttcatccacaggacacctggagccttctgagatacccttttttttcccagtgtgcaaatcccaagcttttccacgaggggcacacaatgcatcttgagcccttttgtagccagggcagtttggcttcctgcctagggtgatgatggagggtggagagcagccatcactccaggcctgccatcctgtttctttccttcccagccacacccaggttgaccccgccatggatgacagtgacgtccacattagctcactgagatctgtgtgcttctctccagaaggcttgtaccttgccacggtggcagatgacaggtaacgaagagaactctctttacatggcctcagaacaagtgcttgcaagtaatggcagcaaggccctcttggtctggccctgggtcagctaatatccagatgttctctctccccatccagactcctcaggatctgggccctggaactgaaaactcccattgcatttgctcctatgaccaatgggctttgctgcacattttttccacatggtggagtcattgccacagggtatgtatttgttagctgaacagatgggtggtgctttctgctgagtataccatggagctttttaaggaaagaaaccatctagaattttcttgcctatgaggaaagctttaaggcaattcaagattatataaaactcaaatgatcgattttgctaataacggtgtcccattttctctgaatatttaacctaaatgtaattaaagatctgtaagtcatgccacctaatgggccaagttcacaagggagaataaaattgagatgatgcataatatatgggaaaccatttagggctaaaagaccactttacaggtaacatctataattcagtaggtggcactcttcccccttatacttttgaactaactgtggtcagatttagaaagggctgtgccgagagagagacagagagagcgctttggtatcacaggtgtcttgagtttttctaatcctatcagcagctttaattattcagcaccacaattttacatccatttccacagtcagggttacatttcactctccgaagtctcctgctctttgcagtcaaaacagaaacatgagtattcatcctcatgaaaacatgaacatccaagctctgtcttagcatcggtttctgtttcattttaggacaagagatggccacgtccagttctggacagctcctagggtcctgtcctcactgaagcacttatgccggaaagcccttcgaagtttcctaacaacttaccaagtcctagcactgccaatccccaagaaaatgaaagagttcctcacatacaggactttttaagcaacaccacatcttgtgcttctttgtagcagggtaaatcgtcctgtcaaagggagttgctggaataatgggccaaacatctggtcttgcattgaaatagcatttctttgggattgtgaatagaatgtagcaaaaccagattccagtgtactagtcatggatctttctctccctggcatgtgaaagtcagtcttagaggaagagattccacttgcacggcaacagagccttacgttaaattttcagtccagttatgaacagcaagtgttgaactctttctgcttgttttgattcaaagtgcagttactgatgttgttttgattatgcaactaagtaggcctccagagcctctctagtggcagagcagctcacactccctccgctgggaacgatggcttctgcctagtacctatccttgtgtttctgatgcagtggtagcattggttcaagttctctcctgctgtggtcagagttgcttcgatgttggccaagtgcttttcttcttgggctcccttctgacctgcaggacagttttcctggagccatttggtatgaggtattaatttagcttaactaaattacaggggactcagaggccgtgctcctgaccgatccagacactattactggctttttttttttttttttaacaatggtgtgcatgtgcaggaaatgacaaatttgtatgtcagattatacaaggatgtattcttaaaccgcatgactattcagatggctactgagttatcagtggccatttattagcatcatatttatttgtattttctcaacagatgttaaggtacaactgtgtttttctcgattatctaaaaaccatagtacttaaattgaacagttgcaaagatgtcttaattgtgtaaagaattggtgtagtcatgactttagctgatactcttatgtacgagatctgtctctgctgtttaacttcattggattaatcagctggtttcaactctactgcgaaacaaaaatagctccttaaaagtactgttctccttcagtggcatgtagttatctaatcaagacacctcattcaaacaaaacctgccttaggaaaatttaatatattttaaattattttaaaagaaatacaacatcttattctttagctttcttaatcggtgctttatggaggccagtgtaacgttacatgactcgttgagaaagttgaggaatttcctctaccacctttgttgcttgaagaaaaacatgtcttttcaaaatgagaggctttcattgaagaaaagaaaaaaacaacagttaaaagcttttggctctctgtttcatttttttccattaagaaaaaaaaaagtccccttttaaaacaagcagggctgggtgtgacggcacatgcctgtaatcccagcactttgggaggctgaggtgggaggactgcttgagcccaggagttcaagatcagcctgggcaacagagtgagataagacccaatctttatttaaaaaataaataaataaatagcc

SEQ ID NO: 35973 - DNA, 16701 bp, Homo sapiens
tataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcggtaagagggtcacagagctcggtcagcgcggaaagctgaggggaacggagggcgaggggcacgccgggcccccgagggacaccgagggaagtccttcccgaacatctccgccccggcggtggtggccgctgaggggtgtggcggggcgacgtggcaccgagcgccgccgcagctctcgactggggcgcttcctcggcgcggagggctggtacccgaagcccgcctttcggagggagccgctctcctgcgactcggggcgtcgccggggcccgtggccagtcggcgggcgggacgggggtggcgtgcggaacgcgaaggcatcagtttacgcggagccttccgacagcgccggccgcctctggctgggatgctgagagtcgtctgggggagaacaggcgagggttccaaaagagcagccctcggcgagttgtccttgcggggaccctagcggcggagggcgctgctgcagctgatgaaatcgcggagccgacttgctcggggtccccgcgccgccctcctccctccgccggtgggagtggcccgcgctgcctccgctctgccaggaacatgaacggactctgggcaccctagctttggctgcagcccaccagagcctgtcagtgccgggctgcgtacatagaggtggcaaacatccgggaggctcccagggccttagggaaagggggaatggagagtgacaagtacccatatttcagcggtacttgcagaatttcagttttacaagatgaagagttctgaagatggatggtggtgatggttgcacaacatatgaacgtatttaataccactgaactgcacttaaaaatggttaagatgggccgggcgtggtgacacgcgccgaggctgaggcacgagaatcgcttgagcccaggagttcgaggctgcagtgagccgtgattgcaccactgccctccagtctgggcgacagagcgagaccctgtctcaaaaaaaaaaaaaaaaaaaaaagttgataaggtttatgttatgtgaattttaccacaataacaaaattgggaaaaatatacaggggaggaggaaaggaaaagctctgtttgcatttttgggtttccttgggaaggtgatttggtcggtcattagagcgctggcattgttggcattgttagagccctgcaccttacaacatcagccccttctttttttcatctaacgttcactgtgtaccagacactatgccaagctgtgcgaattcaaagatgagaaaaactgttcttaatggagctcatgttcctgacaaggggcagaacacgcgtgtaatttccagtcagtgcggaaatgctgttagaaatatttcaaaggcgctgcttgttggagcaatgagttcttgaaggaaaacgtgggaggggactttcagggttttccctggtctgactcttgacctcccccatgtttcgttactgtgtgttttctccccttctccctcttcctgagtgctggcctcatgtgactgtggaccagacctttcctaggcttccatggtccaaaagagatttataaagatgctctcattcattacctaaagaactgggccagtttgtctacactctccaataacaaatgctcttttcactacctttctgaaagaacaagtaagcttcatccacatctctgaaagcaatccatattatctgtactgcacatttgctatttacaattcccacatattgctttcttactgctgcttattttttaaaatactgtttatttttaaatactgcttatttttaaaaagttgtatccttttaaaaatatgagtctgcattctttttttttttttctttgttggatggtatgagagtttcaggaacataaacctatggttggagaaatagtagcctaggagacagtgggattaggaagtcaatggactttagaggcagaagtttgcctttgaatcttgtttctactatcctcagtttcatcttctgtattacagtgttattataatagtcccaaggtaacagagtaatatatgttaaagtgtaagcaaaacacctagtgtttaatagatgtttgttcctttctccattatgtcttccttcactcattatttttcccattaataattgataacaactcttccctaaatcacttgattatgaattgtaaaatgtcctgatactaatttctcatggaaaattacagtactgtaagctattgaattaaaaggaaagtgaagatgctactcacttggattttagttttgaattttattttattttttgagacggagtcttactttgttgcccaggctggagtgcaatggtgcaatcttggctcactgcaacctctgcctcctgggttcaagctgttctcctacctcagcctcccaaacagctgggactataggcgcacaccaccatgccctgctaatttttgtatttttagtagagacagggtttcaccatgttggccaggctggtctcgacctcctgacctcaaatgatccacccaccttgacctcccaaaatgcagggattacaggcatgagccacagttttggattttatttgaacagtcctcttgacttcttcctattctgttgattacctatcttaatgggatttttttctttcctttttttttttcttttttggcaggggaatctctccctaggtcaggttggagtgcagtgctgcaatcacggcttactgcagccttgacctcctgggctcaagtgatcctcccacctcagcttgtgagtaactgggaccacaggagcataccaccatgcctggctaattttttttttttttaacttttagtagagatggggtctcaccatgttgcccacgctagtcttgaacttggcctcccaaaatgctgggattacaaggcctgtgccaccatgcccagccctgggaattttttctaaacacatctgtgaatgcatttaattctgggataaatgttagctaatatagttacaattttggattccccgtgggacttagctgactctccatttccctgtttattttggggtagcagttaatctgccccttggcaaaagagatgatgctaaattagttaatgactcactcccaaggctgtatttcacattttgcagagttgtgggaagcagaggagggctgacagttatactatgaaagatattcattgcatgtgactttgtttttggttcttgttactctttgactgtttttctttcttttctttttttttttttaagcaaattggcataacatccagaacctgcttttggaagcaaagtttgggacttggaacactggcttttcccagaaccctgtgtccttaacttcagtatatgattttatctgaatgtgctaataccattttctctaagtttactgctttcaaaagaaactttttatgaggtgcaagctaagtcattctcactgactagatatacatatagtgtatatacttatatatatctccttatgtgtaagtgtatctattttaaggatacatgtgtatgtgtgtgtatatatacatatatatataaaaccaagagaaaagagtaagaaattagttttattgaacatatatgcctggcacattatatatgtttgttatttcattcaacataaatgactgttctaagccgttttaaagtagtctttcactctgtagtgttccaggattaggaatgtatttttggcctgcggtgggcattccaggtactaatacaaatcaggaatgaggaatgttgccaggtgtatttgtatcagcaaaacccccctattttaattttttttttttgagatggagtctgactctgttgcccaggctggagtgcagtggcacgatctccgctcacggcagtctctgctcactgcaacctctgcctcccgggttcaatcgattctcctgcctcagcctcccaagtagctgggtctacaggtgcgtgccaccatgcccggctaattttttgtatttttagtagagacggggtttcaccatatgagccaggatggtctcaatctcctgacctcatgatctgcctaccttggcttcccgaagtgttgggattacagatgtgagccaccatgcccggcctgcaaaacccttttaatgaagtcctcttcgactctaattctgaaatggaattgtgaatattaatatgttttcaatttcttcatataccatgggtataattaaatgctattatatgttgtgccatgctagtattatataaaatcagggtaaaagtatttgatttgctgtaagattgtaacttttttctttttttgagatggagtcttgccctgttacacagtctggagtgcagtggcgtgatcttggctcactgcaacctatgcctcctgggttcgagatattctcctacctcagctcccgagtagctgagattacaattacagggtcctgccaccatgcctggcaaatttttgtatttttagtagaggcggggttttgccatgttggccaggctggtctcaaacccctgacctcaagtgatctgcccaccttggcctcccaaaatgctaggattacaggcatgagccaccgtgcctggccagattataataatttaatacttcacaagatgcaatacagattaagataaagtttatatataagattattgcattatatctaagatgttgagatttggtttaaagttggtatttaatcataatgcaataaaaaacacttattgaaggcctaaagattgtgaaagctttaaaatcccatttaaattagcagttactggccgggtgcagtggtgggtgcctgtattctcagctatggaggcaaaagctggagaattgcatgaacttgggaggctgcagtgagctgagattgctccagcctgggcaacagagcaagactctgtctcaaaaaaaataaataaataaattagcagttatcttgagaattaattttatctgaccctacaggatattcagtaccttgatgttaggttttagaatataagaggagattacttcattggtcttgaggttagagcagtcttcatgacaccaaggacagagatctaaagggaaaggctttttttaatgggatcattttacttaaggaagagatgctcatctagtttagtttagtttagtttagtttagtttagtttagtttagtttagtttagtttagtttagttagtttagtttagtttagttttttgagatgcagtctttctctgtcgcccaggctagagtgcagtggggtgatatcagctcactgtaacctctgcctcctgggttcaagcaattctcctgcctcagcctcctgagtagctgggattataggcgcgcaccaccatgcctggctaatttttgtatttttagcagagacggggttttgccatgttgaccaggctggtctggaactcctgacctcaagcaatccaccctcctcggcctcctaaagtgctgggattacaggcttgagctaccacgctgggccagatgctcatctttaagtaatgggcactttactgtaaggacatgtgtgaaaataggaaaactgggactcttccacatttgggtttcatggaacccaggaagagttgcataagcagttctctttgggaagagacagcctttcgggcagctgaacatggttttgggaactggaggttcttctagatcctgatttttcttcttgctccccacctcagcaacagttttctgatttcttgccctgttgtctcccattggtgtgactattattctgcctattctttctgtctttgttctgtggttctagtttgaactgcctcagggacgagctcttactggttcaactaactctcactgctctgttgagctaagcttttgcgccaactggaccactggccagcctagagattgttgcccttggcgtcacatactcactcctggtctgtcagctttggatgatatggtggggtccctgggaagagcacattgccaactgtgagaaggagcttcctccagtcccctgccctgcccctattcttaccaggaaagtcttccccagaagggactgtggggagtggtggtcattttgatgtttgacctgtccagtatgttgtttgtttgtttgtttatttttgagacggagtctagctctgtcaccgaggctggagtgcagtggcacaatctcagctcaccgcaacctctgcctcctggtttcaagtgattctcctgcctcagccacctgagtagctgggattacaggagcccaccactacgcccagctaatttttgtatttttagtagagacagggtttcatgtgttggccaggctggtctcgaactccttaccttgtgatctgccctcctcggcctcccaaagtgctgggattacaaacgtgagccatcgtgcccggcctatattgtttgtttattcaactacagaatataatttatcgatttaaaccaccataaaaatgaagtcagttgactgggaaatgatttgaaatacatgcctggctgctaacaacagggacaaaacacgaactacaaatggcatataagcagataagaaaaactatttaacctcatggtgaggggtcaaacaattgcaaattaaaactgtaaaacacttagtaatgatcagggcgcagggtggtgtagcagttaagagcccagactgatgtgagactcagcttgaccaagcgctgtcagtcacttaaactccctgagcttcaaattaatgataataatgatttctatcaactttatccccctccatatgtagctggatatattcattcatttatttatttatttagcagagacagggttttgccatgttgcccaggccagtctcaaactcctgggctcaagccatcctcctgccccggcctcccgaagtgctgggattacaggcataagccactacacctggcagagttttagtttttataaaaattcaagttatttggttttgtgactctgttgccttctgcagaaatgaagctgttgtcatttctggaaggaaactggcccagcagatcaagcaggaagtgcggcaggaggtagaagagtgggtggcctcaggcaacaaacggccacacctgagtgtgatcctggttggcgagaatcctgcaagtcactcctatgtcctcaacaaaaccagggcagctgcagttgtgggtatgtgtccttctgagacctcgactgcggttcagttgaggtttatatgaggcaaagtccattctaatttatgatttcttttttctgattaggaaacccaagcagaggaggctaatgtgattgaactgtatcccaaaactttgtcataggaaatcagactatatctttcggggtttatacagtaggacaggagatactggttggtattctctgtggcttctggaaagaatataagctacattctgttcttagtctttatatttgataggtgaccctgaatgcattttacatttgctttccttgagcaataatgggtctccagtggaggtgtttgagtgtttgcagcttaaagccttagaggcttagggggcatgattgagcaatacagtattaggtgacctcagtgatgaggtcaggaacacagtcgtagatttgaaggaaatgactctgacttctgggaaatagctttcaagttcttcaccgattggttctaaagccaaacatgcagtttagaagcagttcaggtctggatgatggggtttgtgttctaggtctcacggtaccacagattactgtgtctctgtggacaagaggtgggtgggcaggctcagatatgcctctgcctgcccatctgtgggcctgtggtctgagcagcaggtggcctttccttcgaagggctgtgaaaccactcgcgtggctgggtggggttactggcctgtaagcctgtggttttctctgttctttattattgaggagtgaggcctcctgctcttttaattgaaagcctttagaaacctctagataatggcaagccatggcattttgttttgttttttgagacggcatttcgctcttgttgcccaggctggagtgcaacggcgtgatctcggctctccgcaacctccgcctcccgggttcaagtaattctcctgcctcagcctaccgagtagctgggattataggcatgggccaccatgcctggcgaattttgtatttttagtagagatggggtttctccatgttggtcaggctggtgtcgaactcccgaccttaggtgatccacctgcctcaggtgatctgcgcctgcctcagcctcccaaagtgctgggattacaggcgtgagccactgtgcctggccaagccatggcattttaagacattgggaggtagtgtggtgcagaaaaaaagaacatggattttggaaccagaaagactggctgtattattagctcgcttatttatttatttatttatttagagacggagtctcgctctgttgcgcaggctggaatgcagtggtgcgatctcagctcactgcaacccccgcctcccaggttcaagcgattctcctgcctcagcctcccaagtagctgggactacaggcgcgttccaccaagcctggctaattttttgtatttttagtagagacgggttttcaccgtgttagccaggatggtctccatctcctgacctcgtgatccgctggccttggcctcccaaagtgctgggattacaggcgtgagctactgtgcctggcctagctcgcttatttttaaacctctctgagcctcagtctgtctgtaaaataaggttaatgaagattgcatagaatgaggtatacaggatgtgttaagctagtattctctggtgtatatatttgtgaagttacttttttaggttccttgagctacttcagcttttagggatgagtgtgatgatacaaaacccgtatggtagccaagtatggtaggcaacatagcagtgctcattaaatgcctcaaaaatttttttaacctcaaaatttcttataataggaatcaacagtgagacaattatgaaaccagcttcaatttcagaggaagaattgttgaatttaatcaataaactgaataatgatgataatgtagatggcctccttgttcagttgcctcttccaggtgagttttggactccatttaacatgattgctgctgcttctgctcctttccctctccctccctctctctctccctccccatccccctcctcctccctctcctttccttgtctcactctgtcacccaggctagagtgcaatggtacaatcatagctcattgcatgctcaagctcctgggttcaagggatcctcctgccttagcctcccaaatagctaggactataggcatgtccaccatgcccagctaatttttacatttttcctagaaatgaaagtctgtctgtgttgcctgggctggtcttggactctgtgcttcccaaagtgctgggattacaggcatgaactaccatgccctacctaaaatggtttctgaggggtaaaaaggccttgttactttatacacctggttcttcatgtggatttggcttaaaggcaaaataaactcaaaagagtgaatattttattagaaatgggacagaccaactcagaataccaattacgccttgatttagtattgtggtcttgatacaaaggacagtggagggaagcagctgtgatagacgatattggctttgctattggtgtttggctttgcttatgcgagttccttccatgcagatgaagtacatctcagaggcaagctgtagaagaatagatttccttgcgaagcagataagctggagtcaggcagtgctgactatgcggtggtgatttaaggcaactgtgccaatttctttttcagagcatattgatgagagaaggatctgcaatgctgtttctccagacaaggatgttgatggctttcatgtaattaatgtaggacgaatgtgtttggatcagtattccatgttaccggctactccatggggtgtgtgggaaataatcaagcgaactggtaggtatatcccagaattgcatgtctgtgttaatattataaaagtagtactggcaaatggtaaaaactcatacagtcccaaagagtggaaaccctactgcatatcctctagtcttactccccaaagtttacctctcttaacagttttttttttgttttttgttttttttgagacagggtcttgctctgtcacccaggctggagtgcagtggcgcgatcttggctcactgcagcctctgcctcctgagttcaagcgattctcatgcctcagcctcctgagtagctgggattacaggcacgtgccaccatgcccagctaatttttttatttctagtagagacaggtttcaccatattgaccaagctggtctcgaactaggcctcaggtgatccgccccctcagcctcccagagtgctgggattataggcatgagccatcgtgcctgcccttaacagttgcctatgacagtttttgctttttaatccagaagtctcagtgaaggaaattttctatttttctttttctttttttttgtttttgagacggagtcttgctctgttgcccaggctggagtgcagtggcgtgatctcgactcactgcaagctccacctcctgagttcatgccattctcctgcctcagcctcctgagtagctgggactacaggtgcccaccaccatgcctggctaactttttttttttctcgtatttttagtacagacggggtttcaccgtgttagccaggatggtcttgatctcctgaccttgtgatccacctgccttggcctcccaaagtgctgggattacaggtgtgagccatcgcgcgtggcctctatttttctttttaattttttctttaagagtcagaggtttcatcatgctgcccaggctggtctcaaactcctggcctcaagcaattctcctaccttagcctccctggcctcaagcaatcctccctcctgctgggattacaggtgtgagccaccgccccagccctcagtgaaggaaatttaagatttgatagtggtgacagtgcacattcctgtaacattttgtagcctgtagtatgctttctcctgttttcttttagcccttattatgtgtagcaagttacagctccagttgactgatgaggcaaaattgggttcatgttctaggccatctgactttgttttcctttggactggcactacttttaatgtcaatacatatatttttataggcattccaaccctagggaagaatgtggttgtggctggaaggtcaaaaaacgttggaatgcccattgcaatgttactgcacacagatggggcgcatgaacgtcccggaggtaaggaaattgctttcagggaacactgtccttttttccccatgtaagaactttcagaagccatcctgtgcatgtttggaagtattaactctgttatactttgtatttgttgaaattttgttaacagacaattcagggagtaacctttgtagagaagctgcacccagtgtcacctgagtttctttattattcatttatcatgtaactagcttcagaaataaatttaagttttgagtataagcatggttgtaggcaattagaaaatttcagctatagctttgatagctggagctaaggagcaattcttattcaaagatactgtgtcatttagtggaaaaaaatctttagccgttgcaaaggattggattggtatgactgtaatgtgtcctgtcaggttctgttaattggttctaaggtaaagcctcgtcaatcagttatcacataattattgtaataatgaccttacatgattatatcagaaataaaggcaaaactatatactttcaactatctttcaacatacttaaaacaaccttgagtaattttagtgatattttgcttagaaaaggtaaaattcttgaaaggctttaaaaataggatgaataaatttaattatatgactcaaaacagtcgagctgggaccaatgggttaaagctatatgatattaggtattaattttaaaaaagtaaatgacaattagctgttcagaaaacatggcacaagccattaagtcagtttttttttttttttttcctggagatggagtcttgccctgttgcccaggctagtgcagtggcacaatcttggctcactgcaacctccaccttccaggttcaagtgattctcatgcctcagcctcccaagtagctgggattacaggcatgcgccaccacgcccagctaatttttgtatttttagtagagacggggtttcaccatgttggccaggttggcctcgaactcctgacctggtgatctgcccacctcggcctcccaaagtgctgggattacaggcgtgagccactgcacctggccgtaagtcaattatttttcagagatgttgagtttctacaatgacttgactagttgagacctaatccaatcccagctttgtgtcagaaatcaagacatctatttttttctttctaggtgatgccactgttacaatatctcatcgatatactcccaaagagcagttgaagaaacatacaattcttgcagatattgtaatatctgctgcaggtaagaacacaagggggatggagggaaggacttcacctcagaagaggaggttgtacccctcatcttagaattcgcctgcctagctgctattcatcattccccttgtaatgattctttgagctgcctacaaagatgaggatagagttgtgattggaataccggtttctggcagtccattatagtctagatgggtgaatgttattcctaaagcttcaaaatatttatattaatatttactgtataaagtttaaatggttccttttgtttcctgtcaggagccaaaataaaaaaataataaaagtaaatagttccttagttaatatttttaacaggttttaataaaacatgttgattagttcttcagggtctcttgaaattgaagttagacaagaatctgacaggtagactgttttcagtactaagttgatctttcctttctccatttccaggtattccaaatctgatcacagcagatatgatcaaggaaggagcagcagtcattgatgtgggaataaatagagttcacgatcctgtaactgccaaacccaagttggttggagatgtggattttgaaggtaaatggtgaaattttatttttaaaaatgaaatcaataaatactacctttcatggacatttaggatagattatttacttttttttttttttttttttttgagatgggagtctcactctgttgcccaggctggagtgcagtggcgcgatctcggctcactgcaacctctgcctcctgggttcaagctattcttctgcctcagcctcccgagtagctgggactcccaaagtgttgggattataggtgtgagccactgcgcccagtcagtatgcttttccctccctctctccttcccttccttctttctttccttccttccctccatctctctcccttccttccttcccctcccctcccctcctctccccccacccctttcttccttcgtttctttctcttttttttttttttttttttttgagacagtctcactctgtcacccaggctggagtgcagtggcaccatctcggctcactgcagcctccacctcacagcttcaagcgattcttgtgcttcaagcctccccagtagccaggactacaggcatgggccaccacgcccaactaattttgtgtatttttagtagagacggggtttcaccatgttggccaggctggtctggaactcctggcctcaagtgatccacccgtcttggcctcccaaagtgccgggattacaggtatgagccactgcacctggccttagtaggcttttcataagaattagagaaacctttttaaaattatggcttttctagaattattttaggtgttttatcatagtgatggagagcagttataaacttttcagggaattgtttttttccttagacttatttcataattcaagcaatttcttgacttttaacaagtttgaaaatttgatgaagtgatttttctaaaccatggagtttcccaaaaagtgttagagatttctcattttcacactgagagatcacaggcctagaaagttaaaatggtccaggaaaaaaccatacccctgaaatactagaatatactagtagatttcttctttcagttctgtttttttttttaagaggcagagtctcactctgttgcccaggctgtagtgcagtggtgtgatctctgctcactgcaacctccacctcccaggttcaagtgattcttctgccttagccacccaagtagctgggattacagacatgagccaccatgccggctaattttttgtattttcagtagagatgaatttggctgtgttggccaggttggtcttgaactcctggcctcaagtgatccgcctgcctcagcctttaacagtgctaggattacaggtgtgagccactgcacctggcctctcctttcagttcttaagatagaatgtttatccgagttttatgctgataatcctttttttctttccttttttttttttttttttttttttgagacaggatccctctctgttgcccaggctggagtacagtggcaggatctcagcttactgcaacctctgcctcctgggcttgagcaattctcctgcctcagcttcctgagtagctgggactataggcacatgtcacctcacttggctaatttttgtattttttgtagagatggggtttcaccatgttgcccaggctggtttcaaactcctggcctcaaacaatctcccccacctcacaccctgcctcagccccccagagtgctgggattactggcatgaaccactgtacccggcctatgctgataatcctattcctagctttctgtttttattaaagcagtcaaacccatgcctaggtatgtaaggattttcactttaacattaggttaattttttttttaacttctcacttttaaaaaattactgtgctttctgctttggacaaattatacttaaaattaaattaagaaaatgctataggcaggtattgaggtaatgcttattattgttatacttacaactcccacacagttaacctactagatatttctttaatagatttctttataggttacttagatgtataaatattccttgaacaactctgtatgtgcatgttattttactagtgtgttcacaaaaccttgaatgatgtagatgtgatttttgagttttatgcttatgtatgttactttttccttgcatgcttgtttaataatatattaaagtacacacatgtcctttgccataactaaagcagcctgcctgtcttgtttctatgtaggagtcagacaaaaagctgggtatatcactccagttcctggaggtgttggccccatgacagtggcaatgctaatgaagaataccattattgctgcaaaaaaggtgctgaggcttgaagagcgagaagtgctgaagtctaaagagcttggggtagccactaattaactactgtgtcttctgtgtcacaaacagcactccaggccagctcaagaagcaaagcaggccaatagaaatgcaatatttttaatttattctactgaaatggtttaaaatgatgccttgtatttattgaaagcttaaatgggtgggtgtttctgcacatacctctgcagtacctcaccagggagcattccagtatcatgcagggtcctgtgatctagccaggagcagccattaacctagtgattaatatgggagacattaccatatggaggatggatgcttcactttgtcaagcacctcagttacacattcgccttttctaggattgcatttcccaagtgctattgcaataacagttgatactcattttaggtaccaaaccttttgagttcaactgatcaaaccaaaggaaaagtgttgctagagaaaattagggaaaaggtgaaaaagaaaaaatggtagtaattgagcagaaaaaaattaatttatatatgtattgattggcaaccagatttatctaagtagaactgaattggctaggaaaaaagaaaaactgcatgttaatcattttcctaagctgtccttttgaggcttagtcagtttattgggaaaatgtttaggattattccttgctattagtactcattttatgtatgttacccttcagtaagttctccccattttagttttctaggactgaaaggattcttttctacattatacatgtgtgttgtcatatttggcttttgctatatactttaacttcattgttaaatttttgtattgtatagtttctttggtgtatcttaaaacctatttttgaaaaacaaacttggcttgataatcatttgggcagcttgggtaagtacgcaacttacttttccaccaaagaactgtcagcagctgcctgcttttctgtgatgtatgtatcctgttgacttttccagaaattttttaagagtttgagttactattgaatttaatcagactttctgattaaagggttttctttcttttttaataaaacacatctgtctggtatggta

SEQ ID NO: 35974 - DNA, 4669 bp, Homo sapiens
gacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacaggtgatcatggagggatgattccctgatgagaatcccaaggtaccctcggagttctcctgtctgcccagacaacttttcttctaggcagtaataccataatagagacagtgccctggacaggagccagctcaactgacttaatacacttgggcagttctgcaacttctcttcctctccttatttttccaaccctttcttttctttaccgccactcttgttcttttcctgaggtttggaacattcagttcgctctgtgttgtgggatttgttgacaggcacatttctttatcgctgtcacaaggattgggacagctttgcgggggaaccatcttggaagctgcttttcaaggaaatgggtagctaatccttaacagcctaaggtcagaaaaatatatcaggtcaagagagagagacaaatacttagccttggtacaggatcatctattactattaacaaattggccctcagaaagtctttaacagtttagctggagagtcacagaaatttagagctggttaggaccttcaaaatcatttactccaaagcttccatatgaaaggcaaggaaaccatggccttgagagattcgacgactctgccaagcccatgcagtaaagccagaacaggatcccaggtttttcaacttccacatcactaccctggcagcactgatagatgttttataatttgtggcactctcttgtttcttgttcattagacccaacatgtgaatttcactagtattttttaaaatgtctcattccagaagaatatttgttgtggcaggctcaagtgagacgtgaaggaagtactgccaacacatgggatttacaaaataattgtttggctcttttctagagcaagtaaatgagttggtggctttgatcccacacagtgatcagagattgcgccctcagcgaacgtgagttacctgcttctcacctgttaatacctacttctgtccctaatctctttctgtatgtatgaatgccagttaattctttgaaaactacacatgttcttataagttccccattttccttataactgtttgcccaagcaagatatctctgcccccatcacaatctggggaaagaaacttgaagctggaaatgctttgaaggtcaaggaatggaatcagaagaaactgggaaagtggagtgttctgggaggtgtgggactgtctctgtccacatagctcctttcttcagcttttcttcccagagtgcaaacagtgtttaaaggagttttaaaaggtttctcctgcttcactgcttcttaactggtttatggttcctggctcttggaacttccctttcagctcccttctctttcctggttttgtgtttaatcttgacacattgaaccttgatatctgactgcctgggtcggtcatgtgctgtgtcatttgcagtaagcaatatgtcctcctgtccatcctgctttgtctcctggcatctggtttggtggttttcttcctgtttccgcattcagtccttgtggatgatgacggcatcaaagtggtgaaagtcacatttaataagcaagactcccttgtaattctcaccatcatggtaagccttagggtttcattccctgggttgtgcacctgccaggctgggacccaggacacttacacttgtttcctgacttgccctgatgtaggccaccctgaaaatcaggaactccaacttctacacggtggcagtgaccagcctgtccagccagattcagtacatgaacacagtggtcagtacatatgtgactactaacgtctcccttattccacctcggagtgagcaactggtatgctgttcttttaggaatcttgccccacaggcctaagagaagagtagggggctgtaggaatgccatagctgtgtcactttcctttttgtctcctcatttctacttgtaggaactggtgatgaggaagacctgttgggccctgtaattataaataattgtgagaaaaaacagctatcatttaagcatttggggagcagaataatttgtaagagacaaagatttgctacaaaataagaagcagcagtgttacagcctgaggtccattggcctctcaaaagggaagaggttggcagtatcaattagaggctcatagactatattagggacaatctcagggaagtattttgcatgtgatggaagaatgacccaaggtctttggattgctaataataatactgttctgtgtcaagcctgcttggccacagaccaactctggtatcttattttcaggtgaattttaccgggaaggccgagatgggaggaccgttttcctatgtgtagtaaggacactgttctctctgtgtgtgctctctactggaggaaagggattcaaagtcatactccattgattggggcctggtcctgccttagatctcagcttttgacttataggttccctggctttggatgtcttgagatttatttgaagaatgtattattattatgtgtgtatttgaagaatgtattatttgatatgtgacagaagtgctggaatttctaaaagagaacattaagccactaaaaacgttaccaagctccagcacttatgtgatgggtttgaaaaaacagaaagtggtatgacgctgtgggaggatgaaaatgacagtggcagggactgagagctgacaagccttggcagcacttaggtcggaagggggaggggggcaccccaaacaggacagtgtaactctgcactcttctactgaggctttaaaaaaaaaaaaactgactatttccatatttgctgtttggtagcttcttctgcacggtacctgagatcctggtgcacaacatagtgatcttcatgcggtgcgtctctcttccctatcccgatggcctgtccggccatgtgagcctaccacctttgctcaggaggcccctgtgtgaccacagggcagaggcacctagcccgaggggacaccctgtgcctcacaggcacagatacagtagacccttggtgttctctaaacacagtgtccacatgcccttcacaaatcaccagtcaccctgagcagtcaaacattttctccataaaatgggtctagtttaactaaacacttgatcccctcagaatcctaatgagacagtcatgaacagaaaagctttctcaagatgttaagtactgggcatttgaccagacttcctctctagccacacaaattaccacatgtcatggacctttagggttgttttctggaagcatggctgttaaatttgcaagtgacaagactctgctgcagacatgaaatatgaggggttagagcagagtttctcagccttggcactacgaacattttgggccagacctttgttgtagggggctgttctgtgcattataggatgtttaacagtattcctggcatctgcccactagatcccagtagtaaaccctccatcccttagttgtgacaacccagaatgtcttcaggcattgccagaagtctcctgtggggtaaaatcattctcgattgagaagccttgtttggaaggccacctcctggcacagtatctctgtgaaagtggaaagatcttctggcctcctggttacataaccatgaggatatgtgcctggggcccgtgggtattgttctctgaacttgcaaaaaatttcctgggacatttttctggcttatttcatcccccaaacataattaattcttcttggttttcttttccctagaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtggcagcagagagggaccatccaaatacctaagagaaaacagacctagtcaggatatgaatttgtttcagctgttcccaaaggcctgggagctttttgaaaagaaagaaaaaagtgtgttggctttttttttttttagaaagttagaattgtttttaccaagagtctatgtggggcttgattcacccttcatccattggctggaacatggattggggatttgatagaaaaataaaccctgcttttgattc

SEQ ID NO: 35975 - DNA, 6425 bp, Homo sapiens
ggtagttggttgtgggcactgggttagaggtatcacgtgggggcactttcgtcttagcttttggacaagacgcaggcgcaacccacggctgctgcggggatccttgtggcccttccggtcggtggaaccaatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggtgacttgcgccagtcggcctcttttgggcggtcaggttgattcttcccggttctgtagggtcgggctaacttgtatccccatttgtgacatttgatcctgggaagagccgccacgtggggtgacagtgactccagaccagtgagcactctggggggcgggccctgccccttaatgggctggtgctggcagtgttggatgatggatttgaggtaaatgttgtcccagtcctgggacaacggcgtggccccgaaggtgcagtacttggagccacaggcagtttgggaatggtccctgggaattcccctaggtggcactgggtgccagctgagacccgggtctctgccctcaggacccagctgtgatccagcaccgacccagccggcagtatgccacgcttgacgtctacaacccttttgagacccgggaggtgagctactggagagcataggagttcaaggaagggaagggtttgccagtgagacaagttagcttgggtacaggggacttttctgcatgcacaggaaggaagaggcactgtgatcttagttccctgagagaggctagtcagccatgggatgcctcatccttctagggccaccagggccaccaacccaaatggtttgagctctaaaagtcagtcctgggaagatctggaggctggcaaggccttaaccaatgttctgtatgggaaggctttcttgaagaaaataaaggttggggctggttggagtttaggttaggtgtgcagtttgaaagcaaggaatgaggaggactacacctgtttgtcccactggattagaagatggtgagttgtaagaatttaaggggttttcatggtacttaaaacttaaaaaaaaaagccaagcatggtgtgcatgcctgtaatcccacttgggaggctgaggtgggaggattgcttgagcccaggaatttgatggagaccatcctgggcaacagcgagacccccatctcttgaaacgttttaaaaattggctaggtgtagtggcacatgcctgtagtccttgctacttgggaggctgggatggaaagactgcttgggcccaggagtttgaggcttcgatgagtgatgattgcaccactgcactccagcctgggtggcagagagacaaccccacactccatccccagaagaaaagaaaaaaaaaaaacacagttaagtggggagatatggtaaatgagtgatttgagtcctcactaaggaattggatatgagggatgataaggctgctacaggtcatcatagagttctctgacagaaattcaacagaagaactagcttcctaacaaatgggggaaaggctgcttccttacatcatgagttctgggtctaaaggtattcaagcagactctagattcctgtgttatgagggactagatgatcactaaggtcttttcctcaacagccaccaccagcctatgagcctccagcccctgccccattgcctccaccctcagctccctccttgcagccctcgagaaagctcagccccacagaacctaagaactatggctcatacagcactcaggtacaggaggtgtgcaggtgagggctggggagaagggccagtcctggggcccagggctcacatctccgtctgctcacactgggcaggcctcagctgcagcagccacagctgagctgctgaagaaacaggaggagctcaaccggaaggcagaggagttggaccgaagggagcgagagctgcagcatgctgccctggggggcacagctagtaagtaatagagtggggaagagcatctgagagtttgggaggagcaaaaacaggtcttaagggcctgggctcggctgggtgcggtggctcacacctataatcccagcactttgggaggctgaggtgggcggatcacgaggtcaagagatcgagaccatcctagccaacatggtgaaaccctgtatctactaaaaatacacacacacaaaaattagctgggcatggtggcgcgcacctgtagtcccagctactcgggaggctgaggcaggagaatcgcttgaacccgggaggtggaggttgcagtgagccgagatagcgccactgcactccagcctggtgacagagtgagactccatctcaaaaaaaaaaaaaaacacaaacctgggctctggagtcagactgctgagtttgaattttagagatactgcttactaaccatgagcttttagggaagttacttaatcttgaatgcctcagtttccctatttataaaatgaaaaccacgtttgcatccgtttgacagggttgttgtgaaggttaaacaaaatatatgtgaagtacttggtacagtgcttagatgttttaaataataataaacagtattaatttttccactctcacttgtctccttggaccccaaattggagataaaagagaggatccagggctgggtatggtgcctcacgcctgtaattccaacactttgggaggccgaggcaggcaggttgcttgagctcaggagttagagaccaacctggacaacatagtgagatcctgcctccaaaacattaatgaaaaaaattagcagggcatgatggtacctgtctgtagtcctagctcctcaagaagctgaggtggacggccaggcgccggggctcatgcctgtaatcccagcactctgggaggccaaggcgggtggatcacctgaggtcaggagttcaggaccagccaacatggtgaaaccctgtctctactaaaaatacaaaaattagctgggcgtggtggcatgtgcccataatcccagctactcaggagactgaggcaggagaattacttgaacccgggaggcggagattgcactgagccaagatcacaccactgcactccaacctgggcaacaagagcgaaactctatctcaggagaaaaaaaaaaaaaaaaaaaagctgaggtgggagggttgcttgagcccaggaggttgaggctacagtgaaccatgatcataccactaccttccagcctgaacaacagagaccctatctcaaaaaaaaaaaaaaaaaaaaaagagaggatccagggatggagagaagggggagtgattcctttgttggtctctgttttacttctggggtccacctgtttttttgtgccttacagctcgacagaacaattggccccctctaccttctttttgtccagttcagccctgctttttccaggacatctccatggagatcccccaagaatttcagaagactgtatccaccatgtactacctctggatgtgtgagtagtgagaagccttttggaggaagttacaggtagatctcttaactgccctggggtccgctcaccaagaaccaaacacttcacctctatttagaactcaccagcctgctagcaaatgttcttgccctctccccactttttattgtccatatgcaggaatatattttgaattctttagatgtctttgggctgggtgcagtggtatacgcctgtaatcccagcactttgggaagctgaggtgggtggataacctgaggtcagaagtttgagactagcctgatcaacatggagaaaccccatctctactaaaaatacaaaattacctgggcgtggtggcacatgcctgtaatcctagctactcaggaggctgaagcaggagaatcacttgaacccgggaagtggaggttgcaatgagccaagatcatgccattgcactccagcctgggcaacaagagcaaaactccatctcaaaaaaaaaaaaaaaaaaaaaaaaaaaaaaaaaaaggccgggcacggtggctcacacctgtaatcccagcactttgggaggcccaggtgggcagaacatgaggttaggagatcaagaccatcctggctaacacggtgaaaccccgtctctactacaaatacaaaaaattagccgggcgtggtggcgggtgcctgtagtcccagctacttaggaggctgaggtaggagaatgggcgtgaacccaggaggcagagcttgcagtgagccgagatcctgccactgcactccagcctgggcgacagagcgagattccatctcaaaaaaaaaaaaagaaaaaaaaaaattagctgggcgtggtggcgggcgcctgtagtcccagctactctggaggctgaggcaggagaatggcgtgaaccggggaggcggagcttgcagtaagctgagattgcgccactgcactccagcctgcgcgacagagccagactccgtctcaaaaaaaaaaatgtctttgcaaggggatcacacattattgacatttgctttctccatctcccctgttgaggattccatgaaggcagcagctgccttcatttccttactctgccatgtttggtgaatattataggatgagcatagatgggaaggagccttcattgcagtccagaagggctcctcatcctgtccctctgccccttaggcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggtaagtgtgttagtggtgggagagtgatggagacctgggatgggccccacgtctgcccatccttcagctctaattcttctcccaccctccccatttttttcctctttgtaggagtgacagttcattcaatttcttcgttttcttcttcattttcttcgtccaggatgtgctctttgtcctccaggccattggtatcccaggttggggattcaggtttgtgaggctgttatccaccctcacctttccctctagatccagccagcactgggtgctgggataggagttgttcagaaaaaggaaatgtggttttaatccttgggaggtactagtttaatgagatacaagacatacttccaggatagagcgcagacagcactcttgacacatatagattgaagggaagaatgctgcatttggccaatctaaggtggcttcctggaggaggcatagaaccatggttgaaaggaggaagaagaatccccagatgagtgcctggaagagcttggagagctcagggctaatggttcagaaactggaattaaactatgaagagattagatacagtttgggattgtggtgcttggaatgctgctcgattgacagggagccactgctgatgggaagggtaggaacaggggatgctggtgacataaccagtggagaagctgaggagcccctcttcactggtacatccttccctttacagtggctggatctctgctctggtggtgccgaagggcaacacagcagtatccgtgctcatgctgctggtcgccctgctcttcactggcattgctgtgctaggaattgtcatgctgaaacgggtgagggctgtgtcgaaggtggggccgggatggtgagatcatgggtccccaggggcgtgggtggaacattcaggagcaactggcacaggtcaggctgctgggttgttctcagctaatggacctctggggtgtgtgtttctgtgtgtgagtgtgtgtgctgggcagcaggctgctgagtggtagtgatgctgttaggctggggtggggaaccagtggctggaatgggcggtaatgtctttgtcctctacttgcagatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactgac

SEQ ID NO: 35976 - DNA, 37767 bp, Homo sapiens
gccttctcacactttcaggctctgatcgcggccgcagtttttccttttttcttctgccgtcgccttctctgcctcttctcatcctttctcgctctgctgctctgcagtgtgacgagtccgaatcctcttcccacccagcccgcgcctttcttcttttgcctgcgctgttctatttctccttcggccgccgccgccactgctgcacacagctggtgtcggtgccgcgcttttacccccaagtcgttcccgcagcctatggcccaggccgccttgggtatttctgctcaaggtaaccacatccctctttaaaaattccgccgaaaaagagaagacgctttacccgactctttgggccgttatctcacgtgagtaccgagccgaggagcgcgggaggggccaggacgcggggctggccttggggggcggctggggggctccggctgggccccgccgcccttaagacgtccccgcagcgccccgcggccggccgcctcgaacatggcggcggcggctgtctgtgcccccggcggcggcggcggcggcggggctgggcggcgggccgcgcctcaggaccttcgggcggctgctggacgcttggcggagccggagccgcagcagttggggcgagggggcgtgtgccagtgggggagcgcgcgggggtctcgccgccgggggtcgccgtcccctcctggcggcgtgcggcccccacccctctcccgtggtgcattgctgtttccggggagggggcccggccgcagccctgaggggccggggtcccgcagcccctactccgcggtgcgccgccgccacctttgcctcccgaagcccggcgggcgggcggcgctgtgggctgcaacggctggggtcctggttatgaatggagcggggcgggccccgcgccggcctctggtgacagctgcggaggaagtcggattcctggggggcgcggggagcgcggtccccctctggtggaggaaagttgacgccacttggggcctggcggcggggaagccccggtgtcaggtagccagcgagaggcttttggccccttctggaagcctcgaggctgctgctccgcccctgcggcgctcctgattgggtcaagtcgccttcactcaccccagtcacctcctggagcctgaggattagtcaccatggcttcgtttttccgtccgcgccatggttcctaggcagaaagagggagattggtagacgggtggcttatcaactactgtcttgactgccaacagttggtggtggtaacatgttctaacccttacacggtatcctgaatgtgtgtttcgtagacaaagctgctggttcagaaacccgaaacagtcggggacacagtttaccgcctcatgtttcagcacatttaactgaattttgtggtggcatcttggttatattagttctgtgtcccgtcgtgtttctatcgtgaattcccagactgggtgggaatctaaggactcaaaggagggggaattgccttgtgctcagcgaaggttgatgtagaggtgcatcaaagcacaaagtagaagtacatcaaagcacatcaaatacagcaagggttggcagaaacatggctcatgattgtctagaaaggccctcataattcattaatttcttttacatatacgagagcgtgcagatgctgatcatgattagaaataagccccaaggagtttaggaaagactccaaaagaaaatgattatcggtggtgataagtgaggtcgagtagtcagtgcctttctcccccaaggttttatcacatacgttttcaaacagaaggtgaaaaagagttatacttccacctagattctgtaattaacattttaccttatttgtcgatgcatttcaaagtaaagttggagacccctccaactttagtatgtgcatattaaatagagctcagtaccgcttactattttttaaatcttagagggtaaaattcacatcagtataaacccacaagtcttaagtatgcaatttgatgaacgttgacaaaaatacagctgtgtaacctaaaccttttgtcaagatgtagaacatcgccatcaccctcaaaagttttttcttgtcctttcaaatcgtcttccagtcaccacagagccaaccacgatcttggttttttttttttggagtctagctctgtcgcccaggctggagtgcagtggcacaatctcggcttactgcaacctccgcttcccaggttcaagcgattctccttcctcagcctcccgagcagctgggattacaggcgcccaccacgcccagctaatttttgtatttttagtagaaaaggggtttcactgttggtcaggctggtctggaactcctgacctcatgatccgcccatctcggcctcccagagtgctgggattacaagcgtgagccactgcgcccggctgatcttgatttttttttttaaacccatagattattttcgtctattccagactttccacatgaatggaatcatacagtatgcattctttggtataaaaggcttcttttaactcagcacatttttaatattcatccctgttgtctttatctgtagattatcagtagattatttgtgttgctgagtagtagcccattaggtgactgtcccttggttgttttttttaaaaataaactttattaggccgggcgcggtggctcaagcctgtaatcccagcactttgggaggctgaggcgggtggattgcctgaggtcaggagaccagcctggctaacatgctgaaactccatctctactaaaaatacaaaaattagccgggcgtggtggctggctcctgtaatcccagctcctcgggaggctgagtcaggagaatcgcttgaactggggaggcagaggttgcagtgagccgagatctcaccagggcactccagcctgggggacaagagcagcgggacttcatctcaaaaaataataataataatgaaaaataaactttattttggagtatcttagttgcgcagcaaagtcacaaagatacagtttcttcatacttcccacccagttattagtaacatcttacgttattacagtacatttgttaaaactaagaaactgactttggcactatgaaacgttcgagacttttatttggatttcgccaatttttctttaatgtctttttctgttccagaatccaagttaccacattgtatttagttgtcatgtcttcccagttttctttggtttgtgacagtttctcagtcttcctttgtttttcattaccatcacagtctagaaaagtgctgccagatatctggtagaatactcccctcccctaaacttggggtttacctgatgtttttctcatgattagactggggtttggagtttttacaaagaataccacagaacgattttaaaaatcattggtaaaggcattgtgttttcagagacgtactgataattttgagatactaagtttgtaatagttactgtcaaagtgatagaaagtttttgtagttgggcacggtggtttgcacctgtaatcccagcacttcggaaggctgatgcaggcggatcacttgagctcaggaattcaaggccagcttgaattcctattttatttttaagaaaataaaataggccaggcgtggtggctcatgcctgtaatcccagcactttgggaggtcgaggtgggtggatcgcaaggtcaggagttcgagaccagcctggccaatatgatgaaaccccatctctactaaaaatacaaaaaaattagccgggcatggtggcacatgcctgtaatccgagctactcggaaggctgaggcaggagaattgcttgaatctgagaggcagaggttgcagtgagccaagatcgcgccactgcactccagcctgggtgacagagcgagactccgtctcaaaaaaataaaataaaataaattacataaaatgcttcttgtttcttactgaccaaccgagccctctctgtgctattctctaaggtgttagagaatttgcagtgtttacatacaccattctaagtgaaaataatttatttttttccatactgccttttctccgcatttccatttaacaagtccttcttcatgcttttttatcctaactgtccggataaacattctatctatcctgtatgtaagtgcttataagaagtgcttatctatcctgtatgtgtttataagaagtgcttatcctatgcaccttttgggtcttgctgtgttgcccaggctggactcaaattcctgggctcaagcagtcctcctgccttaacctcctcagtagttgagactataggtgcatactgtcacatctggctcattttttcttttcttttctttttttggagacaggttctccctctgttgcctgggctggagtacagtggcacaatctcggctcactgcaacctccgcctcttgagttcaagcaattcttgtgcctcaggctcctgagtagctgggattacaggtgtgcaccgccatgcccagctgatttttgtatttttagtagaagatgggatttcactgtgttgaccagactgatcttgaactcctggcctcaagtgatccactggctcagagccactgcgcctagccctattttttgtatttaaataatgcctttcaaattctagagccttcattccctactagtatctttttgttaaatggaaatgttgtagggttctcactgaggaacattctggaatgtctgacgtttaatgtccataatgtttcacatcattgctcttgggttgcattaagcagcaaaatagctgtggatatatgtattgagaaaaagatgaataatgtcttacctagggtatctgatcctattccttaggataattgagaatgatctgtccccagcatgactcaactttttatttatttagaaaattacgttggtgttgaaagaatcagaatgttatggagtagtacattatttggaatctaatgtaagattattatcatcattgcatgtttgtaggagttctttcctcatcatccataaatgtcattcattgagcatgtgatcagcttctcctagatagatgaaacattttgcctccaccaggagtgccttgatcctggtgagatacactttaggtatgcctacagtgcttctgaaatccctccaactcttgactttataatttctggttttctggcttccttcttaccacccctttctagcaaacactgtcagattattttacttgaaaacagtaaccactgaattatacatagaaacataggtatatcattttagcttagaagtgatgagtggtaacaatgtctaaaactcacctaccatgttgtatagtgtgctgtgcacttatcacatttatttgttcctggtgataatagaatgaattatgtccaaataggttagatatgagaagataaatcttaagagattagttgcttaatattataaggaagttctcaagttattttatgtttttcaaaagttatgttagatacatatataatgcattagctaagtcataaaatcttttggtattgtggtggatttttacatttaaaatgtaaaagacaaatatttgaggagtaaaagagtgttctgggtggttccaaactattgggtcatgctagtacattattcatataaagtcttgtatatacactaggttggtgagggtacttggaattttttaaattctggaccacttaaaaatgtggaattttagaggacaaataaaagcaaaaatgaagttttcatcttcaaaaatgaaggctggtaactcttgagtaggcagataaaacgacttggtaagatggctatgacatcaagttctgtgaattttttatagcagcttggaaatgtttactgcataaagtacttggtactgtggtaaaccctttgaaaatatcacttgtgtaatgtgactttaatgaaacattgttataaaatgaacacgtattctacagttcatgtttaagtcagcctaaacatttttttaacataggactatcttctgctacttttatttccttcttttagggcgaactttctgaccaagtatacaactacccagagggcctaggagaagtgctgtatagagagcagttcgacttcaacgctgagccaccttgggaacctagctgatgataggggggttccatctcccaacttgtccatgtaagtatttgcacatttgttggtggggaggaggtctttaaaatcgaaggaagagtgctgccttgcttagtatttttcagaatttgaaattgcatttacctcttaaagtgcagtgacttttaaatttctgaaatagagataagacagttactggttacagacttgactgatttagttgtgtgcattgtttaccaatgactggatcatttaaaactatcttgtatgcataacttagaaaatatacgttgaagagggcttttgggaaataaggtatagtttatcacatcattcaaccatttaacttagtgaaatgatttttgctactcagctggtaggaacaactaactgattgtttttagaggacttgctgaaagatgatagagatagatagagatacatatatatatctcaatttatatatgtatctaaatatgtatatggtattaaaatatatgtatggtattaaaatatagatatttaacagattttcaaggatagtttttgactatacttggttttctatgtgtgaattttactttagaattgagcccctgtgcaaaatgtaattccacagtaaactgaatttgggctactagatttgtgtgggttcatttaaaaattttgtggtatatagacttattgttacggaaattcagattttgttattaaaatttaagtgtttttaagtttggtcagagacttagaggtaagttttcaggaaagctgagggtatcagttttagtgtttctttaatctgatcttgttaaacagatccctattcgataaaagtgtttgctctaagcaaacatttgatgttaatacaaattagaattttagactcaggtttttaaggctaaagagaaggaaacacagtttaaatagtaagatttcttgaaacctttgacttagaatgttggctagagggtttcctatactggctttctcctacctgtgtaaatttgagcaaatgtgaatcccagctataacataatgttggactggaacagttctttttgtgttaaactggcataatttctttttttgagtgtattactgtccttggttatgcagtgtagtcttcggacgaattgcattagcatcctcacctagaacagaaatacagaatctcagcctcacccaaacctgaatcagagtctatatccaggtggcttgtgtgcacattaaagagaagcagggtcattgctgtttcaatactaagtcagttgcctaatttttgttagtccatctgttctatttgcaacatacctgatgtttttctcccaagttgacttggagatataaaacctttttgggtggtgcaatctgttaaagttaacatcatagttgtgaatccattctaaggcagaaatttaagaacaagcttcgtcttttgaggaagaccgtaataaaagataatccttcttttaattcgtgtctcttgctttaaagaaaagttaccttgcattatagttaatatttctactggtgtttcctcttagaaacttgagagactattgtcagtgagctgaatgattctgcaaaatcagggaaaagtagtctttagattaataatgtaggattcagaaagtctatagtgtctccctctttgtgggtaggagggaatgggagcagatagaagctaaagataatttattctgcaggttctggcagtcagaataactggcttttaactttattatgcccgggtacaatgcatattatgtcaaacaaatataacttctttaaatattcacatgtaatcttctcattttgcatgtctagtatttgatgctttgctataaagctacaggtccacaatccctttttcatagaattctgaaatccaaaaagtctttaaaaaaatttttttatagcttccttgatgtgaccttaactgatttgggaaaaaaaaaaaaaaacaaaaaaaacttgacctggatctgtgctgatttgaggctatttttgtctttacttatcccatttagtgttaatattcctaaattttgcttcagaaatattgtggttgcagggtgctgactcattctcctgaagaatattacataacatatgtaaagtatgtgtactacattatggttcaaaatctggagaattctgaattcacaaagatacctagtcccaaaggtttcttgactagaatttgtaaaattggcaagagaaaattccgcattccagaaatgtgttatccttacaaatcaataagagtttgctctattggacaccgaaatcctggggttaattttctgtagatcaacaatattatttgaaaaccattaaaaggagttaaaacagcttcatggaaattatttggcccatagcattgcaaagcatgtagctatatgaactctgcttgaactggtccactaggattcccgtgcaggtagtctgagatccagaattggcttcagagttaggttttaaatcaaccacctgaattttgatggaataaactaagtatctggaaattttggaagttgcttacataatccttttctttcataatttagaatgtgtgtatgatgtagtacgcaaacactgtaaaaatgtcttaacaaaatattttaaggtcaatatcaaagattaatgggcccctaattgtgaaaaagtttttgtgagccttttgagaaatcccctaggccaggtgaggtggctcacacctgtaatcccagcactttgggaggccaaggcgggcggattacatgaggtcaggagttcaagaccagcttggccaacatggtgaaaccctgtctctactaaaaaaaaatataaaattagtcgagcgtcgtggcaggtgcctgtaatgccaactactcgtgggaggctgaggcaggagaatcacttgaatctgggaggcggaggctgcagtgagccgagatcgtgccattgcacttcagcctaggctacaacagcaaatctccgtctcaaaaaaaaagaaatcccctaggtcttgatgctggagtaaaggttttccagtgggctagttttctatttattttggttgtaggtttaattataattaatgaattagcctaatggaaaatattttaaaacttaaaaagctaagtttgcttctcatagtggatccagtgatgtggtcagattcattatcacataccctttaatgttgtgcagtatggaaaagggattcagttaattgatttgcttaaatgggctcttaacaagtttgctttaaaaagtttttttttttacctggttgtcattagtcggctctatatattcatgtaggaacttcagaagaacatcagcattttaaatattcacattttgtctcctaatctttagtatttacacatgccttagtaggagctccctacctaattaggattattttaactagggaaaaaaaatatatatatatatatatattttttttttttttgacagagtctcctcctttcgcccaggctggagtgcagtggcacaatcttggctcactgcaacctccgcctccctggttcaactgattcttccgcctcagcctcccaagtagttgggattacaggcacccaccattatgcccggctaaattttgtatttttgtggagatgggtttcaccatgtggccaggctggtcttgaactccagacctcaggtgatccgccccccttgcctcccaaaatgctgggattataggcgtgagccaccgcgcctggctggaaagatgttctttacgaatttgctagtactccttcctcatgtttcactgtaagttatcagtaggaaagggaggttgtccgctgggtgcggtgcctcacacctataatcccagcactttgggaggctgaggccggcagatcatctgaagtcaggagtttgagaccagcctggccaatatggtgaaaccttgtctctactaaaaatacaaaaataaattagttgggcatggtggtgcacgcatgtaatcccagctactagggaggctgaggcctgcttgaacccgggaggcggaggttgcagtgagccaagatggtgccaccgcactgtagactaggagacagtgcaagactgtctcaagggaaagggaggttgttgaccctgactgcagagaaaggggaaaatttcagttttgatatttggtacttttttttcttttctccccccaccccccgatttaatttctcacagatgatatttggtactttaaggatactgtgatatgagcaaatgtaacagaacattcattaatggcggttgatactctttgaccaaaaagatgagtaaaaccactatcgttgaaatacacagtctgtatatccccttggcatacataaagtagagtcaatggtgtgtcagtgcttgtgtaaagtagcagaaaaatattctgtaaaagcacaatgtgaatactagcatattaatggataaacaaggttttagagacatggtatttcttgctttgagcaaatttagcattttttttaggaaggtcaaaaagattggaaagcaacgtagaccagttttttctttcttttttgagacgaagtttcgctcttgttgcccaggctagagtgcagtggcgcgatttcagctcactgcaaactccacctcccgggttccatcaattctcctgcctcagcgtcctgagtggctggtattataggcatgcaccaccatgcccgactaattttgtatttctagtagagacagggtttcaccatattggtcagacttgtctcgaactcctgaccccatgatccgccttccttggcctcccaaagttctaggattacaggcatgcgccactgcgcccgaccatagaccagtttttaaacgggataaatggcttttgcatttattacagaggttagtttagctgagaaaattaatactgactaccaatctgtgtgttccatcacagtcttcacccaacctgatcttgtttcagagttttccagtttgggtctccccataccccaccccaggtaaaccaatcccttttgcgatatttaacttccattagaataaatgagatattgcatctatgaaaaaggcttgtaaaccttaaaatctagtatatggcaggctactgttctaaactggccattgttcagataagcctaaggagactcttccaagttgaagtgcttacatactggtgaggccccagggagcacagatattttgtccttcctccattccagggacatccatgcccagtcaaatcaagcaatttgtcacaagttaactaaagcagatatttagctctccttttcgttaatccactgttttttacattatgcatgagtagaaaatactgtgtagcatactgggttacggggattaggatagtcaggttcaacctgcccaggccatagccagccatcatgaggtccagccacgttgtgcatgccaccacgccctgctaatttttgtattaaaaaattttttttttactattatttttttgagatggagtttcacctttgttgcccaggctggagtgcagtggttcagtctcactgcaacttctgcctccttagttcaagcaattctcctgcctcagcctcccaagtagctggaattacaggcacacaccaccatgcccagctaattttgtatttttagtagagacaaggtttcgccatgttggtcaggctggtctcgaactcctgacctcaggtgatctgccctcctcagcctcccaaagtgctgggattacaggcgtgagccaccatgcttggcagtatgagctttatgttgacttcagattactttttatctgcttcttgctctttactgcaaggatcctctgatgcccagtttgcaaagatctcctaaacaagtatggtatcttcttagctcatgtaggttcagcatgaacatgttatatttggcatgaccaaaggtaggatggggttatcctggtatgttcaacatggaaattctgacaaaacaatcaccccaaaaataatactcctaatgagaggtttgctatcctaaattcatgaagagctccttcagataaataaaaggcaaaaacaagaaactgagcaaaagacttgaaaactgtttgccactaacaatctagcagttccagtcccaggtatagactgtagtccctagatcagtgctacttaaactgccagccagtggaataaggactctagtactagaatgtaaagtaccacattgcccaacactgttttagggtcacatagaagaataaaaccattaagtaacaaaggaatgatgattagagaaggtctaaacaaattctaagggagaggtacaggggcctctgagatattacatcttatttctttctttttttttgttttctgagacagtcttgctctgtcacccagggcagtggcgtgatcttggcccactgcaacctccacctcccaggttcaagcgattctcctgcctcagcctcccaagtagctgggattacaggtgcccaccaccacgcccagctaatttttgtatttttagtagagacagggtttcaccatcttggccaggctggtctggaactcctgatctcatgatccacctgcgtcagcctcccaaagtgctgggattacaggcgtgagccaccatgtccggccagcatctgatttcttaataacctgcttaacttggtcttggttgcaattactgtattgcacatgtattctatatgttttccttgggtgagtagtggacaggcaggcaatgagctctgccttaaggtaaccaaaatagtgtgtctctttaaaggattattccctatgcttaattgtaatcaggaaagctagaaaacttgaaattaatatgattgtgtacttcatgttgtattgtaatagttatctttaatgttatcacatcttaattgccaaaagggatataaatatttcacttgagtgcaggtacacacacactttagtacacacacattttctccagaaaaaaaatttagtcttcacattgaatagtcaagacatttttaagggagtctaattgtgttaattccacgtgcaaaaataatattgctgtgagaattgtgtattttgttttctcattaagctacattttaatatttatggtgaggcagttcattgggcagtctttacacaggcacttcaaacttagcctgttgggcttataacttttgggattttttgcccccttatatatttcctattcattcttgttcttctcttttaaaataaatctttagcagtcacctttagtcttcttcctctaaggttactcagttttttcaacctcatcacctgaaaaataagtttaggggtatgcattgtgattactggctttcttattgaagcaagccttgtcctgatttatcctgagtactcaatgtaggctgttgttattgtctatcacttattttggggtccagggtggcagaagtttacctgatcttatgatcactaaatttataggatttcctaccagtttcagtatatagcttcctggaattcttttgtagtgtttcagacctactcaaggtctcacatctatggtagatgtcattctttagaagcttctagtgctcttctggtcaattacttttaaaggtattctatgtggtaagtaacattttctgttgtaggtagaatgcagaggggacttaagcaacgttgtatatttttaaagctgtgagctgggtgctaagtcatcaaatgcctatgtaaaaataaaagtagaaatgcacctaggcatcttcagagtaacagtaatagtgtaaatttcagaatatcttttctcatttttaatgagtaaaaatccttttagaaaaatggttgatgtattaaggttgggtttcctgcttaggtatctctgaaacagtattctcaacctttcagctctccctgttctacttccagggaggtcttcacttcagaaatccaagactcatattcatccagcttggtgtcaagtgggctgttgctgccagaattatcttgtgattatttgagagatgtatcagtttcttctgaagtacaatcaactgtagaagcctttgtagcaggtgtgtaacaaggcaagtgcccagctcctgcagccactactcttggagctaccctgtcgatgaacatgaggactcagcggcctcatgaaaggctccagggagcagtgtgtggttctttggagccttttgtttcttttggcagctcttcatggaaaaatgtattaaaaaaacacccatatgaaggtgtgaataagggatgttacatattttttcttctcagttatgagtctaagaggaaattattaataaaagtagtattgtggttatacgctactgtattagtgtaaaataacctgagctttctcaaccgtatgttaataaggtggttgaaaatagcttaaaagtgcttgtgagtagagaatactttctagtgtctattgataatactagacatcagagctagatttgctgttcagttctaatgaagagaatctaagatttacatggagtagtttttttttcaagtttaatataattagttcaaggtccaatagcaccagaatgtgttgcagccagtaaatcagtcctgtttctgatctgtaagccagaagaagtggtacagtttcttttgggaattatttccactcagaattgcaaggagatacttgatatatcaccttggtttgagtctgcattcttagtggagggtatggagacgtcctggaaagagtccctgtgcgggggtttttgtttcttgtttttgttttgagatggagtcttgctctgtcaccaggctggagtgctgtggcacaatctcagctcactgtaacctccgcctcctgggttcaagtgattctcctgcctcatcctcctgagtacctgggactacaggtgtgcaccaccacacccagctaatttttatatttttagtagagacaagtttcaccatgttggccaggatggtctcgatctcaacctcgtgatctgcctgcctcggcctcccagagtgctgggattacactgtgcccagccccctgtggtgttgaagattgaggtagattaacttagtgaatctggagtaaggtataaactgctcacccccgaaacatgcacacttattttcatgcttgctccctagaacatgctgtgtcttaagacttttggtttgacatattgtcgccaattaactttaatacctcctgaaaacgttttggcaaaatatttcttagtgctttcagtaaggcataaatgtcacaacataaacctttcttttttttaacaatggaactgtaaactatttttgctaatatattaagaaaactgcaagcagtgatcccagaggtatgatttgagctgcttttttaggactctttcagtgagattggggcacaacatatgaaagactcaagcaacctacctcacccacctacttgtcccttttcagttggaaatactgggtttccaagtggcatttcatttgaacaaagagtttgttgcctcaagatatattagaaaatttgaccaggcatagtggctcacactggtaatatcagcacttaagagaggcagagacaggaggatagcttgagcccaagaattagagactagcctggccaatatagtgagaccccattctccataaagagaaaaacaaaaaaagaaaacttgttgctgcagatgtttgtgttttacagattcttttgaggaattggcttttttttttttttttttttttggccttttagtctttaacagtagctgatagttgagctttgcattcacaggcatgggtagcttaatgacagagatagattctgagaaatgtgtcgttaggtgacattgtggttgtttgaacatcatagtgtacatacagaaacctagatagtacagcctacgacacacccaagctgtatggtgtagcttactgctcctaggctaccatcctgtataccgagttactgtactgaatactgttgacagttgtaacacagtggtaagtatctgtgtatctaaacatagaaaaggtacagtaaaaatatggtattatgagaccaccttcatatatttgatctgtccttattaaaaatgttgttatgcaacgcatgactatacatctggattgcttgcatatcaaagttacgggcttcttttaagaatgtgaaagagctggacagagtggctcatgccggtaattgcaacactttgggaggccatggtgggaggattgcttgaggccaggagcttgagaccagcctggggcaacatagtgagacactatgaacaaagagttttctacaaaaaataaaaaattagctggacatgatggcatgtgcctgtagtctcagctacagggactgactgagtggaggtgggactgaaggctgtggtgggaggatcgcctgagtggttgaggcttcggtgggctgtgatgccactgcactccagtctgggtgacaagagtgagaccttttctcaaaaaaaaaaaaaatgggaaaaattgagctactttttcaatacacttccagggagttcattaccaccacccctaagtttaagaactccccactgtttgttgtgaagtcttttgtccatttgtttctgagtacctattctgggctaggaatttacagcaatctcaaagccttcaagagagcatcaaagaaaataaacctccattagagctttattgtttttttttttttttttttaagagatgggttctccctatattgctcaggctgatctcaaacttctggcctcacaaaatcttgcctcagcttcccaaagtattgggttcaatcaactactttattgtagttctctgtataatgaaagaaaacaaatgttaatgtactacatctgtggattcaggtgatccttaatccattttgtcaagtactgccaatatagcaaatgaattttatttcatttttgcaacagaatgattttgtcactcagctgggacgtggttaacaactctgctgttacttctgaagtaacagttccatttcaaagatgaatagtcaactccacaaacattttatctttcctttagaagaggtcatattttttcactatttttatttatattgataatgacactatatgtcagctgttttggtttagccttcagttgattaaaattatttagcttctataaaagtcttaatttatagtgacaagaagctggtcagtggttgcctggggtggagttggggatttgctgcaaaagggacatcatatgaagaaaggctgtgagtaggcgtgataatgtttttataccagtgtgaataaacttagcatttttcaacaagtatgagtgttcatatgtctgaaaggggttagttgattatgtggatatgataaagttcttttaaagagactgagaactgtgttggatttcccaaaaaaaaaaggagtcctgtgttttatagggatggggtgctggggaagcaaggttttcatattgttttaaatgtagtttgatcattagtatctctagagctaacctacttaattattctattcctcagtatatcaatggagataataccgtcattgtggttttaagggttaagagaattaatattgaatagatgaaacacttaggctgggagactgctataaacatgtttactgttagatttaagctagcttagcaggcagtcagagttgaacctatgaaattatatggtttgaaaatatttgggaaaaaatatctttatccatatcatcatactactgtagcagaagctctgaagaatgtaggtagtcagccagtaagacttgatccagtgggcctgatgtttttataagtactgaggatcctgactgttaaaggaaaattacccttcctaagaacactatggttgtaggaaatggaggtttatcttatcctgacttaaaagctagaccttctgtatttggcagcagttgtgtgttgtcgtttataatcaataaccaaaggttttcaactaagtactaaatactacatatatattagactatgcccagagacttagcaacagcaactgagatacaattaagtcctcattgaacatcatcagtaggttcttggaaactgcgactttaagcaaaaagacatagacagcaagccctcaaataacatttcattataatgttaagaaaaaaaatggtttcgttttacctcttacttaaaagacacagtttgcaagaagctattgacataaagtgaggacacaatttacttatttttttttccatttcaaagtattttatttaggccaaaagtcttgatttcgtattttttcatttattaatagtaagataaatgaaaactggctgctatgccaaaaaggttagtgatgttaaacttaacaggaagtttctaccttattttcttatatttatctttttaaatgagtgacctttatttttttaattgttcttagtgctcagttgaatatccccccaaaattggtgctttaaattgcttaaaataaacatgtattcttagcctaaaatgtctatattttctgggcacagatttacagcagtcctgttataacagtctttagagaatgtgcaggctgtgatttgacgtcactgcacaggtattaggtctatttagataggcctcaattaacttggtaaaataaaaacatcctaaacttttcagtctgtgctatatggcatgaaagatctgatgagttgaactgaatgtagttggcttcttggaaatgaagctgttagtgtttgaaaagttaaaactgagtatttgtatttcatgaaatttgactaatacagcttattaaggactgttttggtgcagccaaaatgctgacacttttaagaaccatcgaaatggagtatactttcaggacagtggccatcacccaagggtgaactctagtttggggcattagggagggtggaggggggtggtgggaggaatcaaggacacaggaaaggatgtgcaggttttaaaacaggctgcccagacagctggtcaatggccattattaatgtggcaaccagaaattagtaccagatattgagtagtatcctgtctggtggacctgttttatctcatttatgtcgaagttatttcctaaagtaacctaaggaccagtgaagttcaacaaagaagataaacctttatgtcagtatagtatgtgctgccttaggacaatgagtgctccgggggagtgggcaggtttatttcattgatttgagtggagagggataggatttagcctaaagtctttttaaaaatcagattacttagtaactggctcaggatgtacagatacctaatttacaaatgtagtttctaattgtgttatttttgcatttctggtaattgacaattttagctctattctagccagcactgaaacagatgtttttaatttatatgctctatgatttttttttttttttacaacaacctgttgaagaaataattaaggtagttaactgaggtttagagaaattgatgtagattctcctaaatgatatagccaggacgaggtcttctgactcctagtccagtgatttcaccaaagcaactcacctcataacattgctaacttgatacagctagtactattttagcttgaggtaaggcttaggcagtctgtatcaaagcttcagattgttccctcaagccaccctccactctcacccatttttattactttcacctatttgggaattttttttttttttttaggagagacggagtcttgctatgttgtccaggccggtctcaaactcctaggctcatgcaatctaccggcctgggcctctcaaagtgctgggattacaggcatgggccaccatgcccggccaggacttttatttataagacatttatctgcaattacctggcagtgctaatacgtggctgacagtatattggaagttgagactggtattttgatttcttggatgcagatacttatttcactagctttctttactcttaaaatgggtaaaattatgtgtgttataggaacgcaaaacaagataataatacagattgggtctgcaactctgtaagtaaggtgaccatataggcttgtaatacattgtgtatatatgtgagttaccccttcaaattatattgacctttttgggtaaatgtattttaattcatgtatttgcttttttaaatgggcgttaaaggaaattaataatctgatgtttctgaaattgtaaaattgcgtaaattcctcactaaattaggcacttagcacactttcattgactcgtacattatgtctattgaaataatacagacttttatataacttatattttgacagtttgttgcatattctaaggacccagacataggcttggtggcccgtctcttgtctttcctggtttatgactttcggctttgtggaatacggctgagatgaaaggatttattgatgatgcaaactactccgttggcctgttggatgaaggaacaaaccttggaaatgttattgataactatgtttatgaacataccctggtaagtgccatttctcaaatacagtgtttgtcattttccaagctctgaaacgagtgctttttaatttccaagatggtaatctgatcagaagtacttggttcatatgctatctgatttaacttgaccttcctcccccacacccactccccttgagtagtgatccatttttctttccaatccacattattttaaaatcctccctatggccctttaccttctatgccttttagcatctggcacccacatatgttctgtttattctgttgatgtgatgccagccaaccttctaatcagtacatggcttcttactcatttttctcaattttcttttttttttttttttttggagacgagtctcacgctgtcgcccaggctggagtgcagtggcgtgatcttggctcacgtgcaaccctcgcctcctgggctcaagcagttctctctcagcctcctgaattagctagaattacaggcgcacaccaccacacccggctaatttttgtattttagtagagacgaggtttcgccatgctggtcttgaactcctgacctcaggtgatctacccacctcagcctcctgaagtgctgggattacaggcacgagccaccgcgcccagcctcaattctttttttttgcttgcttgtttgagatggattcttacactgttgcccaggctggagttcagtggcacgatctcagctcactgtgacctctgcctcctgcgttcaagcaattgatttaggatccttatgcctcagcctcccgagtagctgggattacaggtctgtgccaccatgcccagctaagtggttttttttttgttttttgttttttgtttttttttttgagatggagtctccctctgtatcccaggctggagggcaatggcagtatctcggctcactgcaacctccgcctcccaggttcaagcgattctcctgcctcagcctcccaagtagctgggattacaggcgcccgccaccatgcccagctaattttttgtatttttagtagaggtggggtttcaccatgttggccaggctggtctcgaactcctgacctgaggtgatccgcccaccttggcctcccaaagggctgggattacaggcgtgagccactgcgcctggcctaagtttttgtatttttagtagatggggttttgccatgttggccaggctggtattgaacgcctgaccaacatgtgatctgcccgcctcagcctcccagagtgttggattaacaggcgtgagccactgtgcctggtctcagttgtattcttcagtggatattaatttactttcagataattttggttgtgtatgttcattgagaatttgataatttatcctgagtacttactctctgctgctctaggagtcaacttctacagaatcatatactcactgctacttaaggtgattttctttttttttttctctttgagacgaagtttcactcttgttgcccaggctggagcgcagtggtgcgatctcaactcactacaacctcggcctccctggttcaagcgattctcctgccttagcctcccaagtagctgggattacaggcgcccagcaccaggcccagctgatttttgtatttttagtagagacagggtttcaccgtgttgaccagtctggtctcaaactcctgacctcaggtgatccacccaccttggcctcccaaagtgctgggattacaggcgcgagccaccgcgcccagcctggtcttttttttttttttttttatatatatatatattagacttaactgatacaatctttctttattggaggaaatttcctgtattcaaccaaacttgttagataattgttttcatgttaccggtgttcagtaattgaatatccaaaattttctccttctcttgaccttaagtctgcagacgtgttcatcttcccctcatcctagcaaaaatccctttgtcttcctctgccattcaacttgttaaaacttgacatattggtcatgaaacttgtcatattggtcaaccaatttctgccaagccattcttcagttgccactgggaagctcctagtcaaattctgatgatcatttttatcacttaactttattcttctgactttttgcaacacttttcgggggtcagatataatctttgaaatattccttccatcccacatctaaattaacccacgtttagtagcattcaatgaggattactcctcaaccccattcttttctggctctggggtgacacttctgtgttctctaagtcattcagtccaccttttgtttgtcctctcttatttaaccttggtcttgccttcataacatcctggtattcatctcctccattcccactatctatccgtctttgcacatgtcattatagtgacctcctaacttatttcccttttcatcgtcctattgtttgcccaagcctgcttaattttgttgaatattcattaaatacaaggcttccctgctccctaaatttgtttttcgttgcctactgagaattttccagactcacatcatgcctaagaaaggaagctgaataccttgttgtttcatcccatttctcttgtggttcccgtaaataccttattttttcccaaattaaatataaactttgtgtctccggaataccatagatatcatatcttgggaggatggataacttaatacaactgttaaaattctgctgcacataatgtgcgttttgcatttatatcagttgggcactatattctaatgacattttcaaatactgtgaattaaagagttgaaaacagtaacattgtcttcatggattctcaaacagtatttggatgttgtacgtcctaaataagatttttttgcctgctatctaacactgagtaatatatgttctgtccaactgcataagtcatctctctagtcctagaatagccacaactttaaggaagattattcttattcaggcttatctgatatttggtagacttatgtacttttaaaatctaattttgacatctccatgtgcagactaacaaccttgtctttttaaaaatggtttcctggttggtcacggtggctcacacctgtaatcccagcactttgggaggcctaacatgggaggatagcttgagctccaggagttggaggctgtagtaagctatgattgcaccactgccctccagtctgttgctacagagcaagacctcaactcttgaaaaagtaataaaataagaggtttcccagtgaagatggtctcttattttaccatgttgtcttaaggtgcagttttaatggcgatatatagcttgttttatttagcatttctgattctacttactgtattaggaaattatatcctgaactgccaaagtattttaaacagtgggggaagcatgggagaaaataggttcccttccttcaactgccaaaaagtaaaatcaaggcagtttcattctgacttttgtcactgtaattgataatagtttttttatctcaaaggggagaatattttatatgctagtgtagcacagcaaaagtaatcaaatataagaagaaagaacaaatgtattcagagtctcttttaatgtttactaaatctagttaacaagctttaaatgtattactgtatgtaaatatatgtcttgacccatatatttgtggaggaaaagaggtgttctttcctgttttgatacttgattttcaatggttttttgttcatatttgtctttttttttataaccataatagacagggaaaaatgcattttttgtgggagatcttggaaagattgtgaagaaacacagtcaatggcagaatgtagtggctcagataaagccattctacacagtgaagtgcaactctgctccagctgtacttgagattttggcagctcttggaaccggatttgcttgttccagtaaagtaagtatttttcattttttaactaaactgaaacattgaataatttaacttaatgtagttacagcggttagagaacaaatgcaaggaagtttgacttttggatggagtttcaaaataattgtttaaatctccagcctcatgttggaaaattacaagcttttcaagtgcaccaatgaaagggaagtttcagtgtaatgagcctttgaaacgttttatctttattaattgaaaactttaatttgttcctcattcttaggctagagctacttctagaccaaactacagcagatatctaaactctgagatttctttggtgcttctttttagtaatgtttaggccaggagcgatggctaacacctgtaatcccaccactttgagaggctgaggtgagagttgcttgagccaggagtttaggatcagcctgggcaacatagtgagacctcgtctcactttttatttatttatgtttttaaataaaaatattggtttggctaggcacagtgactcatacctgtactcgtagcactttgggaggctgaggcaggaggatcacttgagcagccccagagatggaggctgcattgagctatgattgtgctattgcacttcagcctggaatacaaagagtgagaccctggttttaaaaggggtgggggtaatagtattagaggaagcattaccagaatatgaactgtgacattatgtattctcactttaacctcattttcacagaatgaaatggctttagtgcaagagttgggtgtacctccagaaaacattatttacataagtccttgcaagcaagtgtctcagataaagtatgcagcaaaagttggagtgaatatcctgacatgtgacaatgaaattgaattgaagaaaattgcacgtaatcacccaaatgccaagtaagtataaaattaagtacttgaaaatattatttagcacttagagggttgggtttgtcttttgtctgggaagaaaggagcatttgtggtagggcaatgatgtgtatcataattataacttatttaaagggcctctgtgggaaacactagtaacattttattggctctctacctctgatccttcatgtggaattggaatttaaaaaaataagagcagtttggggatatgatctaataatcttcaaggaatccttgatagttggtgtgataatcaaattagggccatggctgtattttcattatttctataactttgtttgatgtttgataacgttaggaacaggataaactttggtcagcattttttcctgtttagctgaggatttaatctaccctaggccatagttcttgaatggtcatctttactgacagtgtcttcgaagcctagaccatagatttggggggttttgtttttaaggctaatacttttatttttgaacatgaagtttaattttttacttgcatcttcatgtatccagagaattttttttttttcttgattagaaagtttactttttaaaggctgggcgcagtggctcacacctgtaatcccagcactttaggagactgaggctggtggatcatttaaggtcaaggtggcctgcgcctgtaatcccagctacttgggaagctgaggcaagagaatcccttgaacccaggagccggaggctgcagtgagccaagatcgagccactgcactccagcctgggcaacagagcaagactccctcataaaaaggtttacttttttaaaagcaaaaagatttaaggcaaattttatgttttcacaaactggtatatcgagagggcttaagaatatgctaaaagcatattgaattatgcagttgttggcttactttttaatgagttatgtgtgtttccggaaatgaattctatctgtattttctttgtatgtctataattttcatactgactttaatggtgtacttaagatatcctgacagcattgattactctggtaaatctttgtgtggataaaagccttgttgggaaaattctagggaaccacttgtttttctaaaaaatattgttctgtgatcctctgaagacaagctgtgatttgtgatgtttagtatgttagattgtggactggcatcttcttgatggagctgattctaaccttagaataatttttgctttcatcaatcttgtcctctgattatcaaattagggccatagctgtattttcatggccatattattaaccttcttagtttatgtaattattacatccataggaaaacagttacacaaaaagaatttgtatattttcaacttctagcagtttgtaattactcagctcctgaaattaaagaaatttaatcagttttagtcatcttgtcttggttgccatggtttggaaggaaataccaaatagatttgaatcagtagactagaaggctgctgtttaaacacatgaaataattttttaaaaagctttctgggttgggcgcagtagctcatgcctgtaatcccagcacttggggaggccgaggcgggtggatcacttgaagtcaggagtttgagaccagcctggccaacatggtgaaaccctgtctccactaaaaataaaaaaaattagctgggcgtggtggtgcacccttgtatttccagctactttgggaggctgaggcaggagaattgcttgaactcaggaggcactctcatgaggcggaggttgcagtgagctgaaattgcgccactgcactccagcctgggcgacagagtgaaactccatctcagaaaaaaaagaaaaaaaaatttaaaaaatgcttcctatttttttccagttagagacctgctgggatgtaacaatgttagtaggaagaatgtttgcagtaaccatggaggtttagctagttagcacaatcaaagaaatttgaagacatttaaagccctgatatttttattgaaagacaatgatggcattgctattcaatttagtcttcctaggtggatttatggactgatggacttcatttgaaagtaatgtcgtctttcattacagagcccaaccaactcttgatgctacaacagagtcttaacttgctgcattttccaaaatcccatccttgtaagcttcatgctttaggccctaattgctagttttttctctatacaggattgtttttcattaggttcacttgattcatccgtcgctggatttgggagcactggcaacataatcaacacacttcctacaatcttcaggcttcacatgtgctgatgatgatgtaaaccaactctgccccaatcatctccccttctcttagggtcttactacatattgcaacagaagataatattggaggtgaagagggtaacatgaagtttggcactaccctgaagaactgtaggcatctcttggaatgtgctaaggaacttgatgtccaaataattggggttaagtgagtatttgttttaaacttttaaagctgtgaacattttatggtggtaacctgtctttctggttattgatttaagactttatttgcatgaaatctaagatgcaattttttctagtcttttaacacacatgtatgtgttttcttcttagtttaggcaaaacaacttaaatatgccttgtcccttttcatactgttttgtgactgtacctccttccccacaataaaaagaatagcaaataatattttgattcagttagtgcagagtaacttaaatcgccgccttttaaattggatgggaggggatttgctagaattcttaatgaaaataaaagtgtcagacttttttgtccttttaacgattactctgggggacttcaataaattagactttgctttagccttttaattttatatgtgaggaaaccgagactccaagaggttcaaatacttgataatagcctcagaactaattacaggcatagtaacactaagccctagatgttatttgccagcccattgctacttttactaaagtaaaaaggtcttgctttttcaaacactcacaaagatgtattgtgtatctttctttaattttattatttattttttgagatagtatctcattctgtctcccatgctggagtgcagtggcacgatcacggctcactgcagcctcaaactcctggctcaagcaatcttcctgccttggcctcccaaagtggtgggattacagatgtgagcctctgtgcctggccttattgtgtatctttctatactactttgtacataaataggtggtagtcttttaaacaaagaatgggatcatgctgtgccttacacaatagataacattccatgtcagtctagttttaagttttaatttaagtcaacataaaaattaatgaagtactatctcgaatagatgaagggaaaagaagaatggactttacgggtacagttctatggattttagtacttgtgtgaccactgccacaatcaggaagtattctattctgaaactttatcactagtaatactagtgaataatagtaatgctgttactcagcttgattaatgttcatttttatttatttcacaacagacacatttttgtatttggttgggtaaaattgaatgttcagttttatgctcaactgaatgtgatacgatttggtagtgcttgttacttcactatataaacataaaagtgccacatatacataaaagcacaccttattgtataaccgtggaacagtactgataattgacttattgttaagaatttttgtttatagaattacagttttatcttggcattgccttttctataaagctggtactgtaacttttgggtaattagaagctaatgcttctaatactttaaatatttggtaaagttaatggggatacttaatggtatgaatatgatgagtgacagttgaaagaaattacaggaggtgtctctacaactttctgctcctttaaatttagtattctatgtgtttcagatttcatgtttcgagtgcttgcaaagaatctcaagtatatgtacatgctctatctgatgctcgatgtgtgtttgacatggctgtaagttctttcttttaagttattttgatattttattttagccaggatgttaagttaaagactaagtattttctgcctgtgtgaattactctgactacattcaacgtgacacacacctcatttttattatataagcattcagagctctgtacagtcacaccttttaagcaggtaaaggagtgaaatagtaatttacttgcataagtctagaagagagtacaaataaaatcaaagagacagcatacctaacattgaataatctgtttctatcagtaaaaaaccaagaatttgctgtactaaagatcagaacagatatttacctccctaggagggggtttttaaaatgttctcatatccattacaatttggaaaaacatttaaattttttttttccatctctagggagaaattggctttacgatgaacatgttagacattggtggaggattcacgggaactgaatttcaattggaagaggtaaacttctcagtagatgacattaacagaataattgctttctttgttacttaagtggtggatgtgtagagcaggatttttacaatggcagaaactaaaccctataacatctctttaaaattatgttcttagaaaaggaataggcagttagtagacctagctaactttgaaaagtttgatagaattctttgaacattatcataaaacattttctatttcagttgtgtttctgtacttaatggcacaaatgatttaatacttagaaaacttcactactacctttttttttttttttttaaagtcttcctgtgttgcccaggctggagtggagtggcgcaattatagctcactatagcttccaactcctgggctcaagcgatcctcctgcttcaacctcccaagtagctgggacttaaaaaaaaaaaaaaaaaaaaattgagtctttctatattgcccaggctggtctcggaactcctggcctcaaatgatcctcctgtccccaagtgatcctcctgccccagcctcccaaagttttggggttacaggtgtgagccaccactcccagccaactttagcatttaggccagatacacgtcacacctgtttctcaccttcctgctctgccctccttccttctgtgatatctagaaactatgatttgaaaattttacttctgtttttagtgatcaagtatagaaaaatgacttaaaaaaaaacaaaaacaaataccagtgggtatttgttattagagctatttttaaaattaatgccattctgatagttacaaaataaactgacttgaaagcatgcctaattaattgcttggagataactacaaagttgctaaggttcatgatctgtgattggaactgcttcattttcctagaaaattttgttaatatcaatctctgaatattgcgaattatctaatccaatattgaaaccatactgtggcatttaaaatccataggttaatcatgttatcagccctctgttggatatctactttcctgaaggatctggtgttaagataatttcagaacccggaagctactatgtgtcttctgcatttacactcgcagttaatatcatagcaaagaaagttgttgaaaatgataaatttccctctggaggtaagttataaagtttatagttttatttttgttggtagataattgcagttagtctggaaatgagcagatggtcatgaagttgtaggtggttttcagcttttaaaaatcttaaaactggccgggcgtggtggctcacgcctataatcccagcactttgggaggcagagccaggtggatcacaaggtcaggagttcgagaccagcctggccaatatggtggaaaccccatctctactaaaaatataaaacttagctggtcatggtggcgcacacctgtaatcccggctactcgggaggctgaggcacaaaaatcgcttgaatccgggaggcagaggttgcagtgagccaagattgtgccactggactccagcctgggtgacaagagtgagactccgtctcaaaaaaaaaaaaaatcttaaagccaaggtcccattccgtaagacttccaaatccaactttcttggtactgatgtttagatacgtgtgttttagataaatgtctagcagatgattaattctcatccattattcagaactacttttattgtgatcttttctgttctccttacctcacatgggtcagagggaggctctgttttcacactttctcacataagggccacaaagagtccctgtaatctaactcaagtcaaaccaacaaaaaggcactagacagtaccatcttgttggctaatattgtaggaaatactgttttacattaagaagacttttttttttggctgtggactaatccacagcccataggaaagttgtccatttccccaatattgtcttttttttacagctttgtttttccttgcttagaatccagtccaggaccacattgaattcgtcatttctccttgaatctagataaagtttctcagctcattactttgtattttttaactttgacatttttgaagagtagaaatttcatagctgatccttagtttgggtttgttggatgattcctcatgattaattttttaggctatgcatttggggcatgaagtccactaaagtgttactctgttcttctcacttcatcatgttaggaggcacatgatagtggccaattctaatattgatgatgctaggtgttttttcttgttgttttgtcgcccaggctggagtacagtggctccatcagggctcattgcagtctccacctcccggcttaagcagtcctcctaccttcaacctcttgcatagctgggactacaggcatatgccaccatgcctggctaggtttttttctatttttattttgtagagggtttcgtcgtgtttctcaggctggtctcaaactcctgagctcaagtgatccacctgcctcagcctcccaaagtgctgggattacaaacttgagtcaatacacctggccttatgattttttttttttttttttttttgagactgttttgctcttgttgcccaagctggaatgcagtggcatgatctcagctcactgcaacctccacctcccaggttcaagcaattctcctgcctcagcctcccaagtagctgggattacaggtgcgtgccaccacacccggctagatttttttttttttttttaatttaaatgctagttttgagcacttgtttaaggttgtgtcaggcaggtttctttccattgtgaagtggcaagtttaaattagagactctgtaaactacctgtttttaaccagattttcaccccattagttttagcatctattgttgaatttctaacttcattattgtttatattagttggcctttacttaaagaatatcttttccttccctcctgtttatgagtttagactcatagatctttattcaataggtttatataatctgttactcttatttttcccttgacatgtctccattattctcagagcaattcgttattttttggtatatcaagatgttccaggctcattttaaccttttaaatgagcctcagtcccgtaatcagttgtttctccagggagccttggtttgttttcgtggagagtgatattttaaaaacctgaaaattagtattggttgtgctaagagtagagtagctgtgagtagaatgggcgttttcaaaggtttcaaagtgaggtgagaggatctattgatccctgaagctcgaggctgcggtgacctgtgatcacgctactgcactgtagcctgagtaacagtgaggccctgtctctacacacacacacagattcccactggcagtgtatacatgtgagctctggttgctcctcctgctctctgatgttttgtagtgtcagtctttaagttgatccagtcagtaggttggtggtaatggtagtccattgtggttttaatttgcatttacctgatgactaacgatgtagagcactgttttctttttctttttcttttcttttttttttttgtttttgagacagggtttttgctctgttatccaggctggaatgagtggcacaatctcaacttttatttttaattctacattcaaacacatatttaactccttgtgcatatattgccttccccttgctgatttgaaaagaaactaaaaagtgtttttccttgctgcttcatttcctctttttttgaaacagcaactatcagaaagtcttctagaatcttaatacttttttctttttttttttttttttttgagacagggtctcattctgtcacccaggctggagtgcagtagcacagccttggctcactgtctcactgtcttactgtaacctccgcctcccggattcaagggattctagtgcctcagcctcccaagtagctgtgattacaggcatgcaccaccacacctggctaatttttgtatttttagtagagatggagttttgccatgttgttcaggctgatcttgaactcctgacctcaagtgatcctcccacctcagcctcacaaagtgctaggattacaggtatgagccaccgcatccagccctagagcactcttttcttgtgctcattggttatcttcctttgtgaaatgcgtgctctatgtgtctttttaagtttaaatagtttgagaaatgtgaaaattacattaatttgtttcatatgagccattttattaaaaattcattttcccctttcctgttttattccagtagaaaaaaccggaagtgatgaaccagccttcatgtattatatgaatgatggtgtttatggttcttttgcaagtaaactgtctgaggacttaaataccattccagaggttcacaaggcaagttttatcagaaatatcaaaacctatttggcattttataagctgagctgttatttttaagatgcttcccagttttttgaaaaacatcttagaatggggaaaaatgtcctttttgaggatttgcgttcttctggtggagtcccttttttagtttgttgcctttacgtggagttaatggtaccatcgaggcttaagtagcaccctgcccttggctctaggccttttttccatgagcacattggatctgagacagtgaaaatacttatttactcacaaattcaatacctgcgtaagtatgagtaaaaattaaattgtaaaacttttcctacagaaatacaaggaagatgagcctctgtttacaagcagcctttggggtccatcctgtgatgagcttgatcaaattgtggaaagctgtcttcttcctgagctgaatgtgggagattggcttatctttgataacatgggagcagattctttccatgaaccatctgcttttaatgattttcagaggccagccatttattacatgatgtcattcagtgattggtaaggtgattttattttaaggcagatgggatatttgaactgtccttttagacttgctaataagttttaattctgtaatgaatgctaaacttagaagtacagtcatgtattgcctatacagtgtagttacttaatgatgggaatttgttctgacaaatacaacattaggcgattgtatgatggcataacctactacataatctaggccatgtggtatattgatcctaggctacaaacctgtacagcatgttactctgtttaatactgttggcagttgtaatgcagtggcgtttgtgtatcttaagttacttaaacatagaaaggataatacattgtgctatgacatgattgctgcgatgtaacgaggtgataggactttttaaacttcactgtaattttacggtataccacagtcatatgtgtagtctttgaccaaaacatcactctgcagtgcatgactatcatagaaaaatgatgatcttttaaaggtttttggaagactagttataatcctgttttattatccatttgttatgtgattacgtggtctttgggcttaaactgagaatttagctgattttttttctacgtaggtatgagatgcaagatgctggaattacttcagactcaatgatgaagaacttcttctttgtgccttcttgcattcagctgagccaagaagacagcttttccgctgaagcttaaacaggcattaacgcttctttagatctgaagttgcaggttaagcttgtctggtcaacattccagtgtggaaaaataatttaaacaatcttattctcttaattcttttggcaacaaaaactattagtaatagctatttgggaccagacaaaatcagctttcatctataattcattggggataatgggagatttagataatgtatccagatttaaacctaccagtttgtcctaccccttaagcgtttaaaataaaatatgcaacaaaatggatgacttagtggagatggaagcccattaattgggttccccattaaatcgtttacatacaagaacacagtttttatactaaggatttgtgtttaaagtcttgtaaagttcatgtctttcacccagatatatcaaatgttagaagaccagtgtgacttcattagataacgtttagtgtatttagaatgtgtaaatttgtgctttgaactgtagtttaataaatgtaaaattgcatcatagtatttgttgacctaatgtaacccttgtatgattgcaataaaattttgtgtagattttactgttttttcaggctaaaactttgggaaaggggctagctagcaaaggtagttttgaaatagatgtgtatatggactgttttgaagggtttttttctttatagcccagttaagttttgtttggctcggtgcatttttcatttatttaattagtaatttaagtaaagtgtttggtaaatcattgtgaagttcagattcattatggagagttgatgtgcagtaagcatgatgtttaacaattttaacaccaaaaatgttaatcctgcataaatcaactgtaataataaataggtgtttctgtatagatagaatgcatagagtaccttagtaaatctttgaatcacaatcttttggctgaaatggaagattctgttaaatactttgaataaacttggggggagggaaataaaattgcagaaaactgcagagcactaaaacttaaagaagggctacatctttatccagaaacctgttgctcttttgcacggaatgtttaaattcagagttgggatgggggttggggtgaagcacacttattatcttcagttgcagtgatttcaaatttaggattttttgttgttggtttgaactgtccccttagtttcttgttatttccaatttgttctgcttagtcattacttttaattcttttcttactaaaattttatggtggttgggggaagggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccagtaggtgcttaatattttttgatttgattaatgcccatttaaatctcatgggttctattaaaaatatatatatatagggccccaatccattgccatcaaattgcccttggacttttccaaggtatattatggggttttatgcaaaattccaagctaccatgtaactttttttaaccatttaacaaggagggggaactgtttcctaccttctttacatgttgtgcattgttgtggtccagaaatgccaaacctttttaaagatggtgcaactttgagtccttggcttgactatacaggccttgaacttcatggcatatcaactttgccatatctgcaggagagctgttctataagaaatagctcagagttgcaaatatcacatgtgaatgatacggtaacttttaagaaatgtctgtattgtatttgaagactgtttgccataaatctgaaatttgaacctatgtatttcaatttggtatgctaaaaagttctgaattaatgtaaagttttttgttataatattgtaatctcagttcaaaagttaactgcaaatataaaacccaatgatttctatatagtaaattgaactgtaaagg

SEQ ID NO: 35977 - DNA, 40645 bp, Homo sapiens
cggccgcggcgcgagccggagtccgccgagccggagcgcgacgaggccccgggcgcgccctccccgctgccgccaccgccgtgccgccgccatccgcccgccgccgccgccgctgtccggcccccgagcacgccggccccgcgcgcgcctcgaggccgagtcaaggtaagcccggcgccgccgcgcgcggacccgcggccctgccctgcctggcttcccgaccccggcccgcgcggccgccagtgcagcctggccccgggcgcgggcgcattgttgttcgcatcgccgccctccagccgcacacacgctcctttgcacaccccggcgccgacgggtcccccgtcccggcacggaccgctacccgactctgctccggaggtccaggcgcctcctcctgcagcccgacccccttctccgccctgtgagcccaccgaggccagcactctgcctggccgcccggagcttttgcagctaagggcatctcccccagccagaaccgagcttctcccatcctggaactaatcccgtccgccccccacccccaaaaggagcccccccacgcacacccccatgccttgaaccagccttctgccaggtctgcccacccttacctgggggaggggggacggggttggggggggcggggagcatgcatggcatggagtgagtctttgcctcccctgtgcaatccttcttccccaacctgccagctttcctcttatcctgaccacagttcaccaccatcccttttccccaatctcagctgcctggtcagcacctctttcgaacattctgagccccaactttgcagtaaggtggtagaaaatggaaatccagagagctgcaaaaagatttttttttaatgtaatgaatggggagtagttttgtgaacacactcgtattcacctcttctttcctctgggaggcctgcctgccttcccctcccccccaaccttgatccctgtctgctggaaaaggcgcgattgcttctcttcctcttctgcccaagaccaagactctaggtctgatatcctttttagccacacacacacaccccccacacacgaagtcttcttaatcttcttgaatttaccagttactctggacacttcttgccataaccccatttcacagacaaaggcttaggagggaaaaagaaccaaactgtttctgtgtttgtcatgttaatgatgtccatccccacacacccagttcccatccctgatgcttcttgtgcctgtatcttgaaccttcagaatgaaaaaaaaaaaaatctcttggatagcttgatacagtttctttagaaatctgcattgttgcttctggtttatggccatggagaaaataccagcccccacccaaaatgcaccgcagccaagtcggctaaaggcgatgagtgttggagtcagtagggggcgcattctctgcactgggtaaggctgcagaggggggaagggcccccgagctagaacaggatgtgcttcacagcgccttctacagaccatgggaaaatgggcccagcaagacacactcgcactcttagttggtgagctgacagcaacatggcgaaggattaagtgagtcaagagcagtgattttacttcttttaaagagcccaccctgcattttagaagttttctccttttactttttcaaaactgttggcccccagtccatatttgttcttgacgaatcaccttggcacatccttggttcggattcccttcctctggagttcttccacctcaagttttgaatgtgtcaccatatctttcctaagtctggtggtaaaggagaaggtttgaaacaaagtaacaggtttgggggcatagctggttaactcccttcttcataggccaaatctttccaattctttgagagttaaaaatcattcttgagagatgttggattaagtgtgtagatgggtgtcatgatttgcaaagccttgttggtaaacatcaagcccatgttgggttcttcattgtcgaactcaagtgttgattgtaaaaatttcgtttccctccaaatttggacttgtaattgccattcattatctcagcagccaaccacctttacaaaaatgttgataccagtcttctgtgagcacccaccttcttagggtgtgttgatttccatagattttactcctcttgttatttccataggtgtgagatgcacaatgcgaaacctaggccccagcttttacaccatgatgcgcagggttgtactttttgtactgaactgataggtggcctagtggttatgccctgtactaccattttgaggatctggactccgtttcctgccttgctctttggaccacattgtcaattcacaccggtgggtatattcattttggagggtgggaactgcagcaacagggaagccagagacttccttctccttggtcaccaccaaaaccaacacttccaaaatttcagcctagccacattcctcaaggaaccggttagagctggttgcagtagtgggttctgaacacttattaacataagaaattacttacagcttttttaagagaaatttttacagatgctaatattgtaatcatttgcattctacacccctttgtataaagtataagtattcagttactattactttgataacccaatctctagagttgctaagcttctaaaagccttaaatgtctgatgaaaacatggttttccatgaacttgttcttgctaccaaagattgacagtggttgatgtttgtgggtacctttaagactttgtatgttacataaatacaccaagataagtttatggagaactgaatgggtgtattctttgatacctagttaaccagttggtgcttaacaggagaatttttcattggagaattgctaccaggtaacattttggtgagtgaaaaggaggccctttggtacaggtatttgactagagacattgcttctacaatttcttagtcattgtgaaaaatcacatatttaaatgggattatttaaatttttaaatactgtatagtatttgtaggcaggtatagtttttatctttatttggtgttttatatgcagttatttaagttctgaaaatgaccatataatttgaagacaacttatttgacggaatgtttgaaatgaagtttgttgaggggcttttgtttgatttagcgaatgggatacagtgttgaatgatgtcctaagtggtaacagccattttcccttaaaggaaaacttgctgtgagctcttagaaagcatgtattctactgtttcaaaggtttcttggttttaacactcaaaaaataaggtgaggccaggtgaggtggcttacgcctgtaatcccaaaactttgggaggctgaggcaggagaatcacttgaggccaggagttcaagaccagcttgggcaacataatgagaccctgtctctaccaaaaaaaaaaaaaaagtgaaacaattgggcttgaagactggaatttatagtaggtaaactatatacttcattaaagtatagtaaaaggttcaattaactagagtgtggggaatgggtattctgtttaactgaactttaagtagaaattccttttttatcttggcctttgttgaaaaatttcctgagactagcttattaggagctatatattgaaactaacctctttgattttggtttttatagttcctgtatagaaaatataggagattgggctgaaaatctcttaatgacccttggcccttccaaccttggaagtcattgattttatacatgcccactgtgaatttgctttgctttgcttaagtttatctttttctccttataccagagtgcaggaagagttttaatactatttatattaaaataagaacttcacaaccttgaacagatggttttggtaccacttgcaagtaaccaaccagtaggcttttatcaggcaaaaatggcttattatttatatttgattattaaaagtataggtatataaggcatactatgtgaagttgttgctttccttgtaactacttacacgttttgaaagtattaaaaagttagtattttgaaaactaaaatactcaagtttattgattaaataagatgatgctggctacaaattttattttgaaaattgcaacttaataaggaagataaagctgttttgtaaaggagaaagtagagattgatacttcatagggtaaaaaaaagaaaaacttcagcatttatgtttcttcttttgagaatcatatataagtaacaaaactgcataaattgcaatagacctaggtcacttgatttcacaattgggtgtgtgtatgtatgtacacatacatataaaatatatgtaggttttctagagctggaaatgattgtcatattattaaatacagatgaaaagttcaagtatcacgtgtagtttggggaaagtacatttagttttgagatgtagtttggggacaatacatctaagtgtagtaaaaaaataccagaattaaactttatgtatgtattttttccaagtaacctatttaaatcttagtgaaataaagatttttaaagtaatatgaaagaaaaaaataggaagtttttattttacaacattagaagcattattgtggtttacaccaaagtacccatgactgttgtgtaaataagctacttgttcaacctggagttccaaaggagtttttaaaagagcatcataaagtcagttatgtcttacataaggtaaaataactttcagtgggagtttaaccttcattctcttgactgagaggcatgtacattaagagaaacattgctcccctatgtgtaaataatttaattatagttggattcacagagcttgacttgttattagcatcgtataaacttaaagtttttcctcccctagtttttgtgtgttgtttgtttgtttgtttgagacagtcttgctctgtctcccaggctggggtgcggtggcccaatgtcggctcactgcaacctctgcttcccgggttcgagtgattttcctgcctcagcctctgagtggttgggattacaggtgcctgccacaacgcttggttaatttttgtatttttagtagagatgggatttcgccatgttggccaagctggtcttgaactgctgacctcaggtgatccgcctgccttggcctccccaggtgctgggattataggcgtgagccaccgctcccagcccctctcctagttttgtaagagcttgtgatagtaactggagtaaatgccgtattttgctgatgtacctcactgccagttaacaccttctatgttgttagtttggaaactcggtgtttgaaactagtataaaccaaagccccatgctaattaactgaattgatactttgaatgtaaaagctgtttcttgtttttactttggcactttccaccttgattgttgagatactttatttgataaaccgtccatgctttgcccattgtgggtggccattgtgatttcatggttttttgttgtttgtctgatcctgtttattagaaagtgaggagaggatgattatgttccttcatcctctcagtgtcttagtactccctacacctgcgttatgttatgacctacctttgcgatctgccagttttggggtcagcttaagtgagaattcatattctgcttcactggaatgagaaggctctcctcacatattatcatgcttctcaagttggtatatatgagccaacttgattatgtagtgtgtgtgtgtgtgtgtgtgtgtgtgtataggaagtcacagataaaaattgagccaactgtggaaagtgacagttttgattgcagggcacacgtttttttattctaatcaatgaaaaatgcaaaattcatattactgtttttagtcctgggtcctgtcatctctgtgtattaattcagtcctctgccttaaggagttccttgagatttcactcacaagctttggtattattgatccctaccttggttccaagacagcagctagagaaagcctggaacctctcaagaatttcagcagtgttctggaaataaagatttagaaaataagaggaaagcatagacaacgttggatggagtttacaaagggaagcctgctctgaatatatgccacagttttagatttaagttaaagatttaatttaaaagcatacacgtaatctaaaagagtcatgcattatttgaccagctgttagaattaaaaatgaatctgcatatcctaataccctcttcagtaagggtatagatttgtaattgagtcacttagctgtgggttgtgtttatatgtcacttctcatgtgactgtgatgactttaataaggatgtgctgcttaagtgtaaaggcccccttgctggcctttatggtattatagtattggtggcttgtctgttttattttccaagcactttataaactattcccaattttctcaggactatccttgtttcacaagtagggaaatcaaggcactaccacatacaatgatgaaatgagccacagagtatgtctgggctggttcccaggcctgtgcttgcaacacaggcctttatggtgctcttgtaagctgtttggctaatgggggctcacatgaatgcttcccatttcacagtgaggttttatgcttccatgtgagcttaaacccaaggattccaatggcgtctacatgtaaagaagctagccacacccccagcagggagagtatgggtgtaaattgtgcaggtggcagttaattggagtagcatatttctgctgggaagttaactgtataagaatctaaaaagaaacgttgtttatgttcccttttcttttcccagttttttagtttaagacagtcagtctgtcctgagcagttacttttttcttagataattgctggcttttaccctttctttttctgaatccttcatgctccatttaagagcttgtggaaacctgtgcttcagttgacaatctgtaaagctctgctcttctggtggaagctcatgacctgagaaccttttgagtggtctcttttgagaaactcctgtctagtggaaatatggtggaatttattaaaattttcaattcgaattataaatttaggttgacagaatccttgctcttgtgaaagaagtgagctgagactgggagtatccaaatgcaagaagtgctcagaatcctgcttcaagatcagttacacttaaaaacagcaacaagaggatgggtgcggtggcttacatctgtaatcccagcactttgggaagccaaggctggcgggtcacctgaggtcaggagttcaagaccagcctggccaacatggtgaaaccccatctctactaaaaatacaaaagttatcctggtgtggtggcactcacatgtagtctcagctacttgggaggctgaggcaggagaatcacttgaacctgggaggcggaggttgcagtgagccaagatggcaccactgcactctagcctgggtgacagagtgagactcagtctcaaaaaaaaataaaaataaaaaacagcaaccaaaaaaaatgcaaataaaacttctctgaggaaagtgtgaaaacttgagccatcaagtggcaaaacctggtacaagaacgcttttgaaaagctaccttcggtgaagccttgatcctgggaaatggcttcgaaaaacttgagaacatagtttaaatattctgttactcaagaatagtgaaagaaatatatttcctattgtgggaaattatttctgagtagtttcggtagagcataaaaatgtattattaggggatcaaaataacgttttatgtcatttagatacaaagacttggcatgcttctgaaataatttataaatggacatatctgcgtgtcctcttgtggtgttgtgatacatactggttttcatccaccacggttcctggctcataacacccataaccccattaccgtgttttgttataatatagggtacgttaggtctcagaaaataatctctgatcttctcctgctctccttacacgtgtcccaaggcaagattctgatctttacccagctttctgattgtaggtcttgagatcctctctagagagagggtgttggccctataccccggggaagggaagtaaggtttcctatatgaagcttttataaaaacccaggagggccaggcgcggtggctcacgcctgtaatcccagcattttgggaggctgggggcgagcaaatcacaagtttaggagtttgagaccagcctggccatcgtggtgaaaccccatctctactaaaaatacaaaaaaaattagctgggtttagtggtgggggcctataatcccagctactcaggaggctgaggctggagaattgctcaaacccgggaggcagaggttacagtgaggcgagattgcaccactgcactccagcctgggggacagagtgagattctgtctttaaaaaaaaaaaaaaaaaacgcaggaggactgggttcagagagcttccagatagttgaacacacctggagggtggcgcccccagagagggtatggaagcccagtgcccttacgcatttctttatctgtactttttataataaaccggtaaacataagtgtttccccaagttttgtgagatgctccagcaaattaatagaactcaaggagggggtcttgggaaccccagcttgaagtgtcagtcagaagttctggaggcccagacttacagttggagtctgaagaaggagagagcagttttggggactgagcccccatcttgtggaatatgacactgtatccaggtagacagtgtcagaaccaaattagaggatactcagctggtgtccgctgcttgggaaaaaaccctacacgtttggtcacagaagacaacttcacgacttctgtgtggtgtgagggcagaggaaaaacaaagtttgagagttttcccctaaagcaccccttaagggctacttgtgaattatttccctttttcacattgatcttaagccagattgtccacttacagcgacagcaagtggctgtatgcctgtggagttcttatgtaggcagtggagtgctagaatcactctttatgctgtgtccctgccttgctgcaatacctgtttagagtgaagtaaactgggaagtgctcctcacctcacactctccctaaatctaaattggtatattataaagtatcctcagtctgtttttcttgtttaagtaccgaggcatcttcccccgctttcaaatacaattttaggtgaactcttaaattgatgaagggtcggggggccagacctctggctgcccagctttcaccttgtccctcaggcatcatcttccctctgtttgtatacatatcttaaactcttagaggagttcagcctgaaaacaactggttctactggtgtactggaaattctggtggtcactgctagaattcttgcctgaaatctgaatacggaaagtatcaggataagcagcaacacagtagcagttttccagttgtgggcaccagtcttgtagtctgaaaatcttcctaaaagaccagtgactccacatattttttaaaacttaagatacgcaaaatctagatgacacctttatgtttctacataactgtaagtcacctgggtttatttaagatagttgcagatgttcagttgcctaaatattttaagtgtcactgagcttgttaagaatatgcaaacctgagtatgaatggctcacacagatgtaaaatattgtataaaaacactactgtgcatgatgcattgtaatgtgtacaggaacagatgttgttatggcaaccacatctgattctcagtcataatagtttgagctttttggagaggttatgccctggtgtgaactcagaattttgaaagtgattattttagtatctcatctggtttaaggtgataatggtaactgacttaagcattaacttgcatcatctcatttaatccttctgccattaaaacaatgagatagtgtccttctgcttatgccataagaaaacagacctctagaggttaaataacatgtgtaggatcacaaagcttgtaagtggcagagcaaggatttaaatacagatctgtctaactgtagggtggaccactgcatctttattttctagcaaagaaaagctttactgtgctatgtcaccctacctcttgttaaggaggtttgaagttataaggtacaaattttttacatatggctgataggtaagtttttgtccaggaaaatagtattattagcacaaattttgacttaggctataagcttcacctgtgaaccttttcttttcccctcgttttactcttaccccagtatcctattatctcatacctaaggcagtgatggtttctcagacctcttagattgagaagatgtggcatgggtgtaaggtccctcaggtaattctgagggttgggtaggtctggtatctactcttttacttaattgacttcctccaggctttttttttttttttaatggagtccaggctggagtgcagtggcgcgatctcaacctctgcctcctgggcgcaagaaattctcctgcctcagcctcccgagtagctgggattacaggcgctggccaccacaccgagctcatgtttgtatttttagtagagatgggtttcaccatgttggtcaggcttgtctcaaactcctgacctcaagtgatctgtctgccttggcctcccaaagtgctgggattgcaggcatgagccactgctttctttttctttctttctttcttttttttttttttttttttttggaggtggaatctcgctctgttgcccaggctggagtgcagtgactgcaacctccgcctcccggattcaagcaatttttctgcctcagcgtcctgagtagctgggattacaggcgcacaccaccacgcccggctaatttttgtatttttagtagagatggggtttcaccatattcgccaggctggtctcgagctcctgacttcgtgatctgcccatcttggcctcccaaagtgctgggatttcaggcatgagccaccacacccggcctggattaatcctcttaaagtgccattagaatcatgtcccttctgtacttcgttacctgcagcatctcctcggtgcctaccagacatggcagcagactccagcttcacattcaagatccccatcctatcctcaccctgcctttccaatcatgtcgttccttgttactcagaagcttgacatagcaaccattctgactcagtggagttgagcaagaagttcctagaacaccttgctttccggcctctggaactgcgccagaagtcttttgcagtaaatgcagattcttcacctaagttaatggccccaactcagcagctgttgccaccctccctgctgagaatgaactaaacatgaagcctcctaggatttagtttgtgacacatctgatacatcgcctcttttactgcaaatatttattggatgtcatatctgtaagccttttctaggcagagattcattcattctgtctgaatttattgagtgcctgctttgttctagtcattgacatagatgatagagatacagcagggaaaaaaaccaaagttccagggtctccctttgtaacgcaggctggagtatagtggcaccatcatagctcactgcaactcaagccattctcccacctcagcctcccaagtagctgggactataggcatgcaccatcacacctggctttttacatatatatatatatatatatatatacacttaaatatatgtattttttcaggctggtcttgaactcttgggctcaagcaatcctcccacctcagccttccaaagtgctgggagctgtgagctacacctgtgagatggcacccttgtcctgctgcatattttaagagttctgtttagtccatcaattgaggtcaggaaaatgaacgtgctgaaagataatatgtaatgataataatttgtagacataaatgccagccgtgtctgttaactatttcaggtgatattgtactaaatctctgaaatcacctgtgatgaacttttaaaataaataaaacttttaagtcacagtgtgattataatttttgtataattggtaggtaatgtgatgaaccaggctgtttatttaccattagattgttggtttgctataaatgaactacaccagcatgagagaaaacaaaacttccttaaagtgctaaaattaaatttttcatcattctgttacctttcaaaagctttccatttcatttttcccaggacctctcctcttgttcttctacttttgtagcggaaactgaaggtaatttgaaattttaacacatgggaattctctgaagatcttttctctactgccacatgctcaagtttgcaaaacaaggtagttgaacgtctcactgaagtaacccagctgtactaaatctattagttaaggcagagtgaatcagggccttcattgccaaaagtaatataatatcctgttcctggcctcttggagtggagcagatttgccaataacgtgaacactctaccatttttttttctttaagtacttaaaggttttggggccacctaggttccattaatgtattaccactcatattaaatgattatagtgtcaaaaatggtctggaaatttgtatagaccttcaaaatgctgtgttacatccacggtttgttctagaggttctctccttttctgggtaatattaacaaatgcttaagattcacattttggtaaagagatccatcagtgataaatgcccctgattttgaacccagaccaccctgctgttgaaattataagcagactttgtctccttccctaatcaatactgctgccttaaatttcccagtagccactttaaaaaaaaagaatgtgtttatttttaattgttgtaaagtatacataaactttaccattttagccttttttaatcttgcagaactgaaactctatacctgttaaacaataactcctcttttcttcctttacccagcccctggcaaccaccattttacttttctgttgctatgaatttgtttattctaagtacctcatgagtggaatcatacaatatttggccttttgtgattgattttattcatttagtataatgttttcaaggttcatgttggaacatgtgtcggtactttattctttttcatggttcaatcatatcccattatgtggatatgaccacatttcatttatcatcagttgatttcagttgttcctattttgggggtattatgaataatactgctgagaatattgatacacgagtttatgtgtggtcctgtgttcccgcttcccaattgcttatgtaactttttggacttttactgttctcccagtttgactggagcctggaggtagttgagaacagaccaggctcctaccaactccctcctttgaaaaaaaggaagcgtctagtttcccaagggactttcagaagaacatgcttagagtattcacaatgggaagataataaaggggagacataggatacatctgttttttgaaaagctggcctgttatttaagaataccaaggttgtggttttcattttacaagatattaccattatgatttgcatagaaagagattcttcaaatgtgactatctagtgactcttggcctccatggtgatggtaagagtgatttaagacaagtgtccttagagctgaattcttctctggatgtgatggaatcatctgactgacttgagatacgtacagattcttaatttctgtgttgctgcttcagctggtttggctgagccttttaatttttgaagaccatttcaaccttgggtattgaagttctggcactttcagatgtacgtagggaacatgctgctgtttgtttttagtgaatgccaaagatagagtttggtctgcatgggtagtgacaggagtgctgcatctcaggtctggagggtggcttcaagacccagctcgctcatgggcaagcagttgcttcacctcagctgctaatttgtaggatgagaagagtttagattaggcagctcctaggttctttcagtgattgagagtgctgctttttcataacagatttctgttgatggtgtgatttggaagatgaatctcaatcttttgactttcctaaggcctgcactggacacttgttttttagtttttggttttgttttgtttttccccctcatttcagaaacagaatgcttgtgttcctgcagttgaggagaccctgaagactggtgattgttacttagattccatccaaactatctttttcctcatcagctgaacaagctaattctgaaaaggcactgcatatttttaaaaatattttttatgtcatatgtatgaagtggatgccactgacacaaatgtatttttcaggagcattaattgaaaaataatgtccagaattagagtattgttgtctcactcgaccatctcctgaatatgtcacatccgaataacagtttatccagggaactagggagactgacaagctggagcttatcctttggagagtggcctatgagatcatggaaggaatggtgagaagaactgatcctggttaactgggagaagaggggcgtgtcttaaagttttgaaaggctgtcatgtgactagggaatttatagcctgagagctatgggcaggttacacagcgttgtaaagcataaacttgtgaacagaagctgtccagtgtggaatgagctgcctgatgggattttgtgcgccctcttacttgaggtgatcaggcaacaatctttcagagcatctttttttttgtagaaaggattcacacatgttgatggaaggtgacaaaaaatattactttgactaaacgtttttgtaaagaatgctatatttagataaataccatctttcgccttgcataaatttacactcctaactaaagaaatagttataaaaaatataaataattgataacagttaaaaacttgaagaaaatcagtgtttatttttggaggcagttttgtatttggttatcttttattatcaaactgggagaatagtaaaagtccaatgaagttagtaagaatagaagaatacagaaactggttacatttcctgcctgcttatctttattaagagtgttataatatgattatcctaggcaatataattgatgttcattattcagatttagctttcagtacatacgtgtgtcatcatttgcaaagtagttttctttcttatcttcctggttctctaattccctcacccccctttttagcctcagtactactgtacattttctagtaaacttaaggaaagaggatactaaactttattttcttacctctgtcttgctgcacagttttatctgctaatccagaagaacattctgcccctggatagtcagaattacgtgttttgtggattggggagggaggggaggaaaaggaggaggcatcagagctgcctttctatgaagagtttccggcatctggaagctcttttgcccaagcttataggagaatggaaatcagctacctctgttcagggcggtgtattttagaaaaagattgagtggggtgattgtttccagtctggctgtaggctctcaatcttaaagctgtgtaagattaattttttaaaatgcaaatatataaacctttttgcaactggtttgatttaaatgtagggcttaatggcacatgtaaagcaaataaagtatgttcactacttcagatgcaaatcctaaaataggaagaataagggcttattggctataagaagaaatagggttttaccgtgaccacagtttttgactcaatgagtgatatagacaggtattaaatatgttgctgaggtaaaggcaggaaggaaagaaaatgcacaaatacaagaatgatgtttttttctttcaacattttattttttagtttctgaaatacaaatcagaatacattttgttacataatcattttaacaagcttgacattttttcaatgtaagctgactcgatataggtactttaaaacttcctttttaaaaaaccatacgttttatcttggcaaatagctcatcaaaaaaaaaatacacgtgtacatgggaagttgtttttcattattttctagcacaacccccaacttaaaatttggtccactgaaatacgtaaatattcctcctatcacaaaaataaaatctcatggttggggaaaaaaacaactgtctggcataggcctgagtgagcttgagaaacaagttaggatgtttaactgtatggaggaacatcacggagtccacctagaaccatctagcagaacgactagcctgttgctattggagctattctatttcagagactgatacaaggtgcatgctcggaggttgctgaagattaacaacagccacggaatcacttactcagaattagccgaaattcagtatacaagaatatgtgacaacagtagaacagtcagcagttactcagtgcccagaaagcaagccgtaagtttagaataagaacctcagcaggaacaatagtcaacatgtttataagactttgaaggtgagaaaacatttgtagatgatgtcctgtgcccaagtatgttagtttccaggacactggggacagcatcacaacatagaaagtaagaagaaatccaagctgtttaaccttctaccattctcttgagtactaaacccagggcacctttggccacttgtggggtttcttttcttctttattctctatgtaaatattgctccttgggacaccagcagttttgcttcttccactcttatcacagactaagtgtggaggagtgttaccctcagtgtcttggatgattgtggatgctttgtagtacagaaggatatgaatcatcttgaagttacccttggctgtggcctggtgctttgctgtagcctcataatgatccttaccatctggattagccccaccttctagtaacatgagagcaatctcatgcctgtttttggaagctgcatgatgtaggggagtagagccattttgattgacagcattcacttgagcaccttttcccagaagggcttttacagtctcattctggccagcacaaacagcagtctgaagaggagaccaatctcgcatagtctttatcattcactggcactccaagttgaaacaaaaattcaataatttatgtatgtatggctgagcatgcccaatgcaatgcacttctgtcctggtcagttctcatagccaggggtttattggccagaatcctctccttcacctcctccagcttccctctgtaggccaagttgcagaccataagtttagacacacacccgtctgttttgctttcccaggattgatgttttctttctgattagtttttatcttaacaggtactaaatgtttccacagagacataacaaaatctgttctttaaataaataaaattatcgtcacaggtagcagttaactgatgctttgattctgttcatgagagtcaaatgcttgtccctcttagaaaattgccagcataacttaacattttttagttagatcattggtttaaggaaacttcaaaaatcttactcttaaaccccagtgggggttataagagatatataaaaattcttgcatcagcatcaattggaataatttaaatatcaaggatctgaaattcttacatagtaacttgggttgatgttatcaaaaaatgaaattgtttatattgtagtagcctgattgtcttcctaatttttattaacttagaaaatacagataccttttttttttttttttttttttttttttttttttttttgagacagagtctcactcttgcccaggttggagtgcagtggcgtgatctctgctcactgcaatccccacctcctaggttcaaacgattctcaggcctcagcctcccaaatagctgggattacaggtatgtgccaccatgcccagctaattttattgtatttttagtagagatggggtttcgccatgttggccaggctggtcgtgaattcctggcctcaagtgatcaccctccttggcctcccaaactgctgggattacagacatgagccatggcgcccatcctgacagctgccgttttcttcactagtaatagcgtcattcctagcccttgattccacactcttctcttctcccaaccccaggtaaaagataatcccagagagactgtgtttttctttacaactttagggtagaaatgtttttttaaaaatcacagtgtgaactttattttctgatcctttaggtttactgtggattccctatcacttcatactttgatcagactaataataattggtgaagattttcagtaaactatcagaattctgctatagccatcaaacttcatgctttggtttgattgcccactaggcccagattctacatttcagtaacctgccacttttgcataaatttgcgtcatgggcttagtttagatgagtaactatttcgtggaggtacttgggggcagggaacctttttttctttcaacctgagcacctctagtttttatcttttttatatttcacctaagattcctttggaaacgggtttcacagcttttaaaaaataaaaagtttgaagctaggcgcagtggctcacacctgtaatcccagcactttgggaggccaagacaggcagatcacttgaggtcaggagttcgagaccagcctggccaacatgctgaaaccccatctctgctaaaaatataaaaaaaattagcccagcctggtggcgcgtgcctgtaatcccagctactcgagaggctgaggtgggagaatcgctggaacctgggaggcagaggttgcagtgagctgagattatgccactgggtaacagagggagactccgtctcaaaaaaaataaggtttgaaaatcactagtttaggctaagtgcagcttatgtttaggtgttaaccaggaagaagtaaggatccttgtgtagctctcagtgcaatattagatatgcttttcttagtggaaatgaaagttttgcattcactagtgtaactgatacattagtcatcactttgggttatgttcaggttttggttcccgaacattataaagtagcaaagtttacacctgcagttgaaggaaagtaggacacactatgacacactagatcctcacttggagtagtttaaaatgtaatctggacaagttggacttagaggctagctttttcttctggcttatctgtgcctgttcagaggtagctgggttgtcttttgcttatctaaaacaggcttatctttttgtttgttttgtctttctttcagatgatactagtaaatgcttttctgctttttttctgcccgtaaaaatacagactatatggtgccatccttgatgtggtagctctgcagaactaccatagacaagctccactaattcttggtgtgccagatcctgcagactttaccttgagcctgctaaactgggactgtcatctgttgggtgatgccattgcactccagcctgggcaacaagagtgaaactgtctcaaaaaaaaaaaaaagaaaagaaaagaaatctgggttttagtgtatccatcacccaaataatgtacaaggacatctttttcagttagtgttggtaggaaaattggattgccatagtgcagaagaatgaaactagacccctatctctcaccgtatgcggaaatcaactcaagatagaaaaaagactcaaagtgagacctgaaactagggaaacctgggggaaactctcatggacattggtctaggcaaagaattcatgactaagacctcaaaagcacaagcaacaaaaccaaaaatagatgggacttaaactgaaaaagtttctgcacagatacaaatatcatgcatatggttttaatttatctgtagcctagggcctagatgaatcttagattttcattccagctgtctgactcttgctttgtaagaaagcacatgaataggatatgggcctggattagtaaaacgttaatgtttgggccctaatcagtagatgtgggtataatttgcaaagactaataggaatgagtatggctagttcactcaacagtgttagtctccagaattgaacgttggctgggcacggtggcccatacctgtaatcccaacactttgcggggccgaggtgggaagatcacttgagctcaagagttggagaccagcctgggcagcatagggaggacccctattaaatttttttaaaaaattagctgaatgtggtggcgcatacctctagtctcatctacttgcgaggctgaggcagaaggattgcttgagcctggagaattgaggctgcagtgagctgtgatcataccactgcactccagcctgggtaacacagagtgagaccctttctcaaaaataataataattgaatgtttacatgtagttcatcagatggcatgtgcttaccaaaaagctagttactctctatttatttagaggcagggccttactctgtcacccaggctggagtgcagtggcacgatcattgcccactgcagtcttgaactcctgggctcaagtgatcctcccacctcagccgcctgtatatctaggaccacaggtccacacccatgctttcttatagaaacataggtcttgctgtgttgctcagtctggtcttgaactcggccctctaacatgctgggattatgggtgtgagacattgcacccacacctagttactttcagtcgtaaataaaatacttgcaaatgttaattctgttattaataggtcattgagctttctctgaattctagaatttagggtgtttaactcttctcatatagtgttttttgtttttttacttcatgaaatcagagtcaaagcattttttagagtaactttcatctttcaaactcctgttctttctactagactcagttcacaagtgtaattattttgcataaataccctatcttccctcttatttattcactttctcttctgtgtccgcctgcccagtgggtctgtcaagacttttggttgtgggtgacaagaacttagcttaggcagaaacgataatgtgtgtgtttatatattggaaaaggctggcatagggaagtgctgttcttcgggcacagctggattgaggaccttaaacaatatcaataggaattgttccctttgcttccttcatgtgatggcaggtctcaactctccttttcagcgtcacgtcatccctgttcgggggacatgtccaactctactggtcattatcttacatagatgaaatattcttaactagtcaaactgagtcatgtgtactctgctctgctggaaaagtgactttctgtcttccatcaatcgtggcagaggcgtttccaagaggaggctgggcaggcaaaaacaggtgtctaaaccctactgattgagggctggctatgtgtattctaagctggaagaaatggactgttgaaggggaagaagaaccatgtcttactcatctctctattcctagcacagttgagtggctaagtgcaagtgctctgaaaatgattgtctaacagatgaacaatatataggtttgttaaattggatatttttctttttttatgtcatgagctgaaaggttcggctgaagggagctagttctccttggtgttggaataatgatgctcatctgatttcttttttttttttttttttttttttttttttgagacagttttactcttgtcgcccacaggctggagtgcagtggtgcaatttcggctcaccacaacctccgcctctggagttcaagcgattctcctgcctcagccttcctagtagtaggattacagacatgtgccaccatgcccagctaattttgtatttttagcagagacggggtttctccatgttggtcaggctactctcctgacctcaggtgttccgcccgcctcggcctcccaaagtgctgggattataggcgtgagccaccatggctggcaaattttttttttttttttaatggccatcctaatgaggcaaaagagaagggattagctatccttctgcatgtcaaaacccatctctgggacaatttttggcattagtgttaaggtttctttctccctaagagtaataattacctgtattttagtttttagctctctttgcattcgaaagtgaggaaagggccttgaatttcaggcagagacaatttcttatctattctgttcccacccctcagttacttaagtatggatcccttgtccacatttataaaggagaatcaaatagataactttttttttctttttttgcagacagagtctcactctgtcgcccaggctggagtgcagtggctcgatctcagctcactgcaagctctgcctcctgggttcacaccattctcctatctcagcctcccaagtagctgggactacaggtgcccaccaccacgcctagctaattttttgtatttttagtagagacggggtttcaccatgttagccaggatggtctcgatctcctgacctcgtgactcgcccgccttggcctcccaaagtgctgggattacaggcatgagccaccgcgcccagcctagataacattaatgaaccctggagccagctattgatttgaacttatgtttcttaacagcaagcagtagctgcaaagaaacatagggtccttctcttctttttcttatcacccataatgattgactgatagagtttggttgaaacttttttccaaagaattgtttggcttgttatagttcaaaacactcacaagaaagggtaacagtggccccttctgggatggggagctgcgtggctggagggataagagtgagaaggaagccttctttgcttatatttctgaattgtgtgcttgttttatctactgagaaaagtatttaaagcaaaaaaaaaaaaaaaaaaaacagaaaaatctttgcaaatgcttttgaaggtgccagtgtatatgactgttacttcagctgcaaatggagaaaatcttagagaaatgatctccatgaacaaatgcatggagggcacactttgttctggagaaagggagattatggaatttccaaggttattaggaatgtcagaaatacgcatatgaagagcattataatctttacactgaaagttgtagaatgttctgagttaatgtgaacatacattcctggccaggcatggtggtgcacacctgtaatcccagcactttgggaggccaaagccagcagatcacttgagctcaggagttcaggaccagcttgggcaacatggcaacaccccatctctacaaaaaaaaacacacacacacacacaaaatatagccaggcgtctaggtagtgtgcacctgtagtcccagctggtggggctgaggtgggaagatcacttgtgcccaggaagtcaaggctgcagtgagctatgattacaccactacactccagcctggatgaaaagtggaaccctggccaggcgttaacgtgagttaacatgaacatacattcctggccaggcatggtggtgcacgcctgtaatcccagcactttgggaggctgaggcaggtggatcacctgaggtcaggagtttgagaccagcctggccaacatggtgaagccctgtctctattaaaaatacaaaaattagcacgatgtggtggtacgcgcctgtagtcccagctactcaggaggttgaggaaggagaattgcttgagcctgggaggcagaggttgcagtgagccaagatttgtgccattgcactccagcctgggcaacaagagcaaaactccgtctcaaaaaaaaaaaatgccgggcgcggtggctgtaatcccagcactttgggaggctgagatgggcggatcacaagatgggcggatcacgaggtcagatcaagaccatcctggctaaacggtgaaaccccatctctactaaaaatacaaaaaattagctgggcatggtggtggcgcctgtagtcccagctactcaggaggctgaggcaggagtatggtgtgaacctgggaggcggagcttgcagtgagccaagatcgtgacactgcactccagcctgggtgacagagcgagactgtctcaaaaaaaaaaacaaaaaaaaaaaactggaaccctgtctcaaaaaaaaaatacagatttctcctagttgccaagcctacagcaagataacattttttggtacagcatttcccagtaagcagtgtcactgctttatttataagccttttaaattcaaaatagataagtaaacccaacaccaactctgtggctgaaataccgctttttataaattacaagtttcttacaactaagttcccttatgggcatactcactttttcagaaaaaaatacctaccaggcagtgagatgcttcatcttaatgtcttaaaccgactttttaagctgtgggtaggcacttagaagaatgggtttttctttcccccaagctgccgcttgattcttttttatgttttctatagactaatgaccccagtggtggctgcatttccaaatctttatgtctttgtttttctgagattgttgagccactcatccaggaggcagggaaaccattaatggctggcttctggacacatctgttatgaagtgtgaagcagagttaactcaggaagttcccaaagaactgaattttggcccatagagagtttatgaaatgaacagagaaacaagatgtctcttcccagtcttaggtatctgtgggcatccattttaatacctggtttcttcagaattagcctgtgacacttttctgtatttctgaaatatttttctaacatgtgcttctctctaaaagacctggtttgtagtaactgtatgtgttttttgtttgtctgtttttgagatggaatctcgctctcgccatgctggagtgcagtggtgcgatcttggctcactgcaacctctgcctcccgggttcaagcgattctcctgcctcagcctcccgagtagctgggattacaggcacgtgccactacgtccagctaattttttgtatttttagtagagtcgggttttcaccatgttggccaggttggtctcgatctcttgacctcgtgatctgccctcctcggcctcctaaagtgttgggattacaggcgtgaggcaccatgcccagtgtgtactaactgttttaaattaagcaagtgataaagaatttgctggttttaagccaccacaaaagatggtttaaaacaatttagcaataaaatttggacaaaaaataattgatttggtcttaatttatatcagaagtgacttctaagtctgtagttggcttcacaatatgcagattattagcatagcagagagagcaggggacaccatagtcattgcttcatagtgagcagcaattctatcttgagtatgataaggcctagaaggtttttttgaaatacttttcattttcggccccaattagactttggtacttcatatagaatattttgagacttctaagttagagtaacgtacccagtttcaaaatttctaggggttactctttgattttggtagatttcactctttctccttttattttccatttttttatagttaacgttgattttggattagaataataaatgaggcagcattttattacatttggattagttgacttgccatttacagatgatattggtattacagagtaacagcctttgttaattagaaaactggatttgcatatattaaattttaattcctggtgctttgtcttttgtttttgctgttttgggttttagaactactttatatcctgcgaaattgtgttagatttggattattaaattgataaatttttaccatattatgggaagcatttctgatctcattagaaaccatacatattctcagctgcccaggttttactgattttattttctcattaaagacaaacttctgttttaaggaacttgggaaagttgatatgaatttctaatttaatgtattaggtcattaaaataatttttgagttcccttagacacatacaggcttttcatttttttcaaaagtaccctccttaaagtctgtaacagttaacatttttgagtacctttgcccaggtacgttgcaggcaggggtggagtgggggcatgcattggtcgagtcacatatcattactgtatttagtttggggagtatacagaaacttaaggtttttttgtttttgtttttgtttttgtttttgttttaaagaataccgtagcagtaggcaggacagttccaattcaacaaaaacctctttaccctggcactcaaaactgtaatgatgatgaactggtaagcatttttctgttttcagatgttcaacatcaaaatgagaaaagcactaacacttgatttaaaaataattgattgctagtatttctctaattttcatcttgaagttcattactgaactgttgttaagtcttatcagaattatgccagattagactcatagtcaaaatgtcctgttaaaaactgggaaaatcagagagtacttattttgcctgcctgctttaagtattcaaaatatagtagatatgtgctcggctcagtggctcacgcctataatcccagcactttggggtgccaaggcaggaggatggcttgagtccaggagtttgtgagcagccttggcaacatagtgagacctagtctctacaaaaaaattttaaaaattagttgggcatagtggcgcactcctggagtcccttcctcttgagaagctgaggtgagaggatcacttgagcccagaaggttgaggctatggtgaatcgtgagtgcactgcagtcaatgaaccatgagtgcactgcactccagcctgcgcgacagagtaagactctgtcttaagaaaaggaaggaaggatggatggatggatatatcaagccatatgcacatgaaagcaggtgtgtgtctgtgtgtgtacacactagatgaggatatctatgcaccttttttgtcagatgggtaggttttatgatcctatcatcagtggaattagtaaatattacaagttgtacgtgttttgactttgacttaaatttttttttccaatagaaactatgttccaacttcctgtcaacaatcttggcagtttaagaaaagcccggaaaactgtgaaaaaaatacttagtgacattgggttggaatactgtaaagaacatatagaagtaagtagcatgtcatttttaaattttaacatgactcagcttctgatccattactttgtgtcagtggccaagatggctaaatcttagatgtgattctgaatttcagccacagcagtagcttcacgaaaacattctcaatagcattaacttgtgcctttctccctaaaatgggctttttcatttttgcatcctgaagcagaaggctaccattgaggacttaagcatgtcaggcgttgaactaggtgccgtaaagttgtctatacatttaatccttagaacaaccatggaggcgggaggcagtgtagcagttcttatctccacttcacagatgaagaacaaataaataggcccagccttgcagctgagaaagtggcagtgtctgtgggactcaaagcctgttctcattctgatacgcctgaatgttctggttgaccttcttctaattgttgaggcgtgcttgtgtgggtgcttgttgtctctttccttaggatttgagcatttgttgccccttttgacccatcatagactattactttcccccttgtataacagtttgggctttatgaactgtttttcaagctgttttattctatgagctttataacagctctgtgggatagccatgcagtggtctccttttcaacatctcactgttccaggtcttatggtttgttggtcagagcccctgattgaaaagaaatgtttgaagctgtttcccccactaacctttaagttctaggtggctagggaacatagctaccttgtttatccatttagccccagcacctagcacagtgttttgcacgtaataggtgatcagtaagtgtttgaatggaattggaagtaaaaaagcaaattcattcatacaacaggttttcttaatttgagttccactaataatacttgaagagtatggcatggaaacagaagctgctcaaaagttgacttctctagtcacgttgttccaagtgtggaagtagcccttctccaaccccagagttcaggtagatctgcccaaatgaaacagtccattcactttgcactctgtggggtcatcttcatagaaataattaataccaacatcacagtacatttctgtcatgcatttgatttgttcctcctatgattatttatgtgtagacttcattttccaccttgaactgtgaactttttaggaacaagtgggattttaccctaagacttttaatcttcctagtctggagggaagtggaccattaaatttttacatgagagtataaatttaacatcatactgcttaactttctttgaatagctttctttctgcctttttgggtttgaaatttgagttttcttcctgatctgatctcctgccccctcccctcgaaaaaaatcttttttttgcacagaaccagaaatcatatttgcagtgctgtaagcaaacattgctattttagacaccattccagtactgtaactgacgagttagagtacagtactctaatgaaaagtgctttgatattagtgtgtggctgaattttttacttaattagaacttccagcaatttccttggaaacctgactgaccatcaggaaagtggttggttgatataaaatgtagactgcaacttccatatgcctttttatatttaagagccttatcactcctagtttaagtccttgttgacgttggttttcctgtgcctctccccatcttagttaagaggtgagatttacatgtaagattgggttagcgtttataccactatgtttttgtaaacttatttcactgttttctaggattttaaacaatttgaacctaatgacttttatttgaaaaacactacatgggaggatgtaggactgtgggacccatcacttacgaaaaaccaggtaagtggcacaggagacttcctcagatggcagcatgcttggtatactcccttttcagctctaggccttttatagcggtgcagtgattgcgggcaagtgccaaacatcgaaagtgtcaaaattgcatttcatattttcctgaccagtgggaagactaagaaaaactttttgtccttttttgtcattggactaaaacttgaggtgtaagaagaaacaaaattttgttacttaaaagttacgaagcctgctgtatcccaccatttcccctaaaagtgctctggctctatttttctgcatctgtgttgccattcttgttttttctgcacagaaaaagacaagacccttccttacatttaagcttttcttatttccctatgttgatggcacccaacttctatgggaggcctggggaagtgactctgtaggatgtcagtgacagagagataaaacttcttacaaattggcattaaaaacaatattagcactgccagcaagtatcaatagatgatgatgatgtcatataggtgatatttccttctgcatagagagaggtaattgtcaatttaatttttaccattacctattttaggagtgattctcattctgcattaatgatctgttcatctatcggaacatacttttcaggaaattagtactcagatatttgacttttttttttttttttttttttttttaaataccccaggcaaagttactaaccagcagtcttagaatgagaatgctttccagtgggacacatcatttatttaattcagttttatcaatctgaaagcctcatagctgaatactaaagaagagttgagctttgaggagaagcagagtatttcatcatggttcaaaccagtatctgaaacaagtaggtttctagggagaaaagataatctcttaccaagcatgtcagttcacctgccttcatcaaaggactgactgcataggtgttaacaatcataattctgaaagttgctctttgatatcagtatattctataatgtattattggcttttaaatacctcaccctcctcacagtctgtaggacatttttatttaacttcttgatttgaatcaaagcagctattacttcattagctcttttgaagtgttcttggttgagaaggaacagcaaggcttatagaagaaagccaacttttcaaatcagtctttcttttgatcagcgctgaatctgatactacactgtactttaatcagaggaaaaaatggagatttgccttttttctatgaaaatttatccataatgaggaaaggaataaaagatatagctttatctcttgtaattgtctaattgcactaaaacatcgtgggccctgaattttaccgcagtcattcaccacataacgacattttggtcagtgatgaactacatctacgacagtggtcccataagaatataattgagctgaaaaacttgctaccttatgacatcatagcgcaacatatgattcatgtttgtagtgatactaatgtaaacacacctgtgctgccagtcatagaagtatagcacatacagttatttacagcgtataataccgtcgtgcattgcttaatgatgggatgcattctgagaaatgccctgttaggtgatgtcattgttgtacaaacatcataaagggtacttacacagacctaggtggtatagcctcctattacccctacgctatatggtatggcctgttgctcctaggctacaaacttgtatggcatgttactataagagaatactatatactgaatactataagagtgattaacacaatggtaagtatttgtgtttctaaacatagtgaagcatagaaaaggtacagtaaaaatgcaatataaaagaaaaattggtacacctatattgggcacttgcgggactggaagttgctctgagtggtgactgaatatgaagggacattattgtacatcactgtagactttataaacacacttaggctacataaaaagtaaaactttaaaattcttaacttctgaatcttttgtaataacacttagcttaaaacacaaacacggcaacctgcccgggtccccttccacactgcggaagctttgtcctttcactcttcataatgaatcttgctaccgctccaaaaaaaaaaaaaaaaaaaattgtacagctgtataaaaatattttgtcttcatatgcttacaggctttttcctagtcttaaactttttttttttttttaactttttaaactgttgttaaaaactaagacacagacataattagcctaggcctacacagggtcaagatcaatggtattaccattgccaccttcacagcttgtctcactggaaggttttcaggagcagtaacacgcatggagccatcatttcctgtgatggcagtgtcgtcttctagatacctcctgaaggatctggctgaggctgttttagagttaacttttttttaaaaaatatagaagtaagtggtacactcaaataatgattaaaaactcattaccggccgggcgctgggctcatgcctataatcccagcactttgggaggccgaggcaggtggatcgcctgaggtcaggagttcgagaccagcctggccaacatggtgaaaccccctctctactaaaaatacgaaaattcgccaggtgtggtggcagatgcctgtaatcccagctactggaggttggaagtgggagcggggaaggcaggagaatcgcttgaacctgggaggtggaggttgcagtgagctgagatcgtgccatcgcactccagcctgggggacaaaagcaagacttcatctcaaaaaaaaaaaaaaaacctcattaccaaaatccttgcatacttaagtcccacagttggccctggagaacctgcatataccaaaagctagccctctgtataagagggtttgagcatcccaagaatactgtatctttgatctacatttgtttggaaaaaatccacatataagcagttcaaacctatgttgttgaagagtcaactgtatagtaaatactaggtgacagaaatttttcagccccgttataatcttgggggaacatagtcccatatgcagtctgtactagacagaaaacatcagcacatgacttcctgataatgacagttaaaaaccgtattgccagtttatgtatttactatatatactttttattttagagtgtactcctactttttaaaacagcttttcatggtaactggtagcagcctcatacagcttgtgttcactgtgtctcttgattgcatcattcttgtgcatggtttaatctcatggtattttgttcatcatggcccctaagcatacaaaatccataatgttgccagtaaggggccatgttgagtgattgacctggaaacagaagtgattaaggactacgaaggtggagaatcagtgatggttatttcttgccagtcaggcttgtcccattttaccatagctatgatcttgaagaacaagaacaaagtgacagaagctgttaaagcatctgcttcattgaaggcaatgagactaacaaaaattcaagaagggcctttatcagacacacacaagcttctgatgacctggattgaagagcagacacaggtgcacacggtgctgtgtacctctcagcaccatgatgatcccaaagcaaaaagtgtgtttgaggtgttgaaagaaaaggctggacctggctgtgatgttgaattgactgctagttctgggtggtgtaaacaattcaagaatcgttattcattacataatgggaaagtggtgagtttgtgagtgctgatgtaaaggcagcggaagaattttgggaaactctagataagctgagtctggaggaaaatcacttgccagaacaaattttcaatatggatgaaacctttctattctggaaacagatgcctgaaaggactttgatccatgaggtagaccaaagcaatgccaggcttcaagtcttttaaggactggatgacagtcttgcttgggggcaatgttgcaggccacaaattgaaaccctttgtgatttggcatgttgagaaccctaggggcttcaagcatatcaatacacacacacttggccagtgcactgcaggagatataagaagtcgtgggtgaccctgctcctctttcaagatgccctcctgaatagatatgcctgcgaagtggagaagtagtattgagagaataacatacccttcaagcttttgcttattgtcgctgataagcaaatgcctcctttaagtggtgtttttcatcccagtatcaaacaccacctctttgatccaactgatggagttacagcagcttttaaggcgtactatctgagaaaggcctttgtcctgtcgtcgcagcttagggagacactgagaagattctgatacaattctggaaggattgcaatatctgtgactgcattaagaatcttgcttgggcttgggttgatgtcatcaaggagtgtatgaatggcatctggaagaatacactcaagaggtttgtccatgacttaaaaggatttgcataaatcacaaagtctgtgattgagatggcaaacaactttaaccggggtgtggatgaggacaacaggagctcctagaggtgattcctgaggaattgactggtgaggagctgtgggaactagaacaagttcccgcataggtgaagaggaaagagaaaaggaaactgcaggaaaagcaaaagaagaaccctcaagaaaattcagtgaaggatttagcagtgcagacctcagcaagctccttaagtctgaaaacacgtggccgggcttggtggctcacgcctgtaatcccagcattttgggaggccgaggctggtggatcatctgaggtcaggagttcaagaccagcctggccgacatggtgaaaccccgtctctactaaaaatacaaaaaaattagccgggcgtggtggtggggcgcctgtaatcccagccacgaggctgaggcaggagaatcgcttgaacccgggaagtgcaggttgcagtgagccgagattgtgccattgcactccagcttgggtgacaagagcaaaaaaactgcatctcaaacaacaacaaaaaagtttgaaaacatggatctcaataccaaaaggtttttattaatagagaagaatattcatggttcattatctgcttacaatcaaatctatgatgaaaaaaggaaacaaagcaccgtgggcttattcttggtaagtgtgagacctcctcaagaaaagcctaaggcaggtccttctgcagttatccagaagaaggcattgttaccatgggagatggcagttccatgtgtgttactgttcctgaagaccctccagtgggacaagatgtaaaggtggaagatagtgatactgttgattctgactctctgtaggcctagactaacgtatgcgtttgtgtcttagcttttaagaaaaaaaatgtttttaaagtttttggtttttttttgagacggggtcttgctcttgtcgcccaggctggagtgcaatggcacgatctcagctcactgcaacctcagtctcctgagtagctggaattagaggcgcctgccaccacgtccggttaattttttgtatttttagtagagatgaggtttcaccatgttggccaggctggtgtcgaactcctgtccttgtgatccacctgccttggcctcccaaagtgctgggaaagtttttttttaaaacaaatttttttaagcttatagaataggcatatgaagatagaaaatatttttgtacggctgtacaatgtgtttgttttgggggtttttgtttgtttctgagacggagtctcgctgtgttgcccaggctagagtgctgtgctgtgatcttggctcactgcaacctctgcctcctggattcaagtgattctcctgcctcagcctcccgagtagctgggattacaggtgcctgccaccatgtgcagctattttttttattttcagtaaaggtagggtttcaccatgttggtcaggctggtctcaagctcttgacctcaggtgatccacccgcctgggcctcccaaagtgctgagattacaggtgtgagccactgtgcctggccaatctgtttgtgttttaagctaagtattactacaaaagagtcaaaaagttaaaaatttaaaagtgtataaaccacagcaagctgaggttattattgaagaaaaaatattttttagggctcggcacagcggcttgcaatcccagcactttgggaagccaaagcgggaggattgctcgagcccaggagttcaaggccagcctgggcaacagagggagaccctgtctctacaaaatttaccctagtgtggtggcacacacctgtagtccccaggactgaggcggaggtgggaggatcgcatgagcccaagaggttgaggctgcagtgagccgattgtgccactgcactccagcctgagcaacaaagtgagactttgtctcaaaattttttttttagtaaaacttgtgtagcctaagtgttcataaagtctacagtagtgtacagtaatgtcccaggctttcatattgactcacccagagtaacttctagtcctgtaagctttgttcatggtatcatttatcttttacattgtatttttactgtaccttttctgtgctcagctatgtttaaacatacaaatatttaccattgtgttaatcattgcctatggtaatcagtacagaaacatgctgtacaggtttgtagcctaagagcaataagctatgccatgtagcctaggcgtgtagtaggttctaccatctaggtctgtgtgaatacacacttgaggatttcacaccatgatacatttttcagaatgcatccctgtggtttagcaacacatgactgtatagtaaacctgaagtctttagtaacttccttcatttaggttattcttgttatttctagctgcaaaatgtttatcttcaagtcatttgtctttggtttagctaaaatgtgactttttttccctaaacattgagaaagaacttagcatttttttaatttacactgacaaaaatatttggtttaagatagctttttttttgagtttctattttataaagttactatacaaaaggggaaaacatactaaaatcagtgcttttttttgagacagtttcgctcttgtcgcccaggctggagtgcaatggccgatctcggctcgttgcaacctccacctcccagcttcaggcgattctcctgcctcaccctcctgaagtagctgggattacaggcgcccaccaccacgctcagcttatttttttgtatttttagttgagatggggtttcaccatgttggccaggctgctcttgaactcctgaccttgggtgatccacccacctcagcctcccaaagtgctgggattacaggcgtgagccaccacgcgcggcctaaaatcaatgcattattaagaatatccgggggggatctggaatctgttaactgcctatctgaagtggcattctaattctagtttttgtgtttactttaggactatcggacaaaacctttctgctgcagcgcttgtccattttcctcaaaattcttctctgcctacaaaagtcatttccgcaatgtccatagtgaagactttgaaaataggattctccttaattgcccctactgtaccttcaatgcagacaaaaagactttggaaacacacattaaaatatttcatgctccgaacgccagcgcaccaagtagcagcctcagcactttcaaagataaaaacaaaaatgatggccttaaacctaagcaggctgacagtgtagagcaagctgtttattactgtaagaagtgcacttaccgagatcctctttatgaaatagttaggaagcacatttacagggaacattttcagcatgtggcagcaccttacatagcaaaggcaggagaaaaatcactcaatggggcagtccccttaggctcgaatgcccgagaagagagtagtattcactgcaagcgatgccttttcatgccaaagtcctatgaagctttggtacagcatgtcatcgaagaccatgaacgtataggctatcaggtcactgccatgattgggcacacaaatgtagtggttccccgatccaaacccttgatgctaattgctcccaaacctcaagacaagaagagcatgggactcccaccaaggatcggttcccttgcttctggaaatgtccggtctttaccatcacagcagatggtgaatcgactctcaataccaaagcctaacttaaattctacaggagtcaacatgatgtccagtgttcatctgcagcagaacaactatggagtcaaatctgtaggccagggttacagtgttggtcagtcaatgagactgggtctaggtggcaacgcaccagtttccattcctcaacaatctcagtctgtaaagcagttacttccaagtggaaacggaaggtcttatgggcttgggtcagagcagaggtcccaggcaccagcaagatactccctgcagtctgctaatgcctcttctctctcatcgggccagttaaagtctccttccctctctcagtcacaggcatccagagtgttaggtcagtccagttccaaacctgctgcagctgccacaggccctcccccaggtaacacttcctcaactcaaaagtggaaaatatgtacaatctgtaatgagctttttcctgaaaatgtctatagtgtgcacttcgaaaaagaacataaagctgagaaagtcccagcagtagccaactacattatgaaaatacacaattttactagcaaatgcctctactgtaatcgctatttacccacagatactctgctcaaccatatgttaattcatggtctgtcttgtccatattgccgttcaactttcaatgatgtggaaaagatggccgcacacatgcggatggttcacattgatgaagagatgggacctaaaacagattctactttgagttttgatttgacattgcagcagggtagtcacactaacatccatctcctggtaactacatacaatctgagggatgccccagctgaatctgttgcttaccatgcccaaaataatcctccagttcctccaaagccacagccaaaggttcaggaaaaggcagatatccctgtaaaaagttcacctcaagctgcagtgccctataaaaaagatgttgggaaaaccctttgtcctctttgcttttcaatcctaaaaggacccatatctgatgcacttgcacatcacttacgagagaggcaccaagttattcagacggttcatccagttgagaaaaagctcacctacaaatgtatccattgccttggtgtgtataccagcaacatgaccgcctcaactatcactctgcatctagttcactgcaggggcgttggaaagacccaaaatggccaggataagacaaatgcaccctctcggcttaatcagtctccaagtctggcacctgtgaagcgcacttacgagcaaatggaatttcccttactgaaaaaacgaaagttagatgatgatagtgattcacccagcttctttgaagagaagcctgaagagcctgttgttttagctttagaccccaagggtcatgaagatgattcctatgaagccaggaaaagctttctaacaaagtatttcaacaaacagccctatcccaccaggagagaaattgagaagctagcagccagtttatggttatggaagagtgacatcgcttcccattttagtaacaaaaggaagaagtgtgtccgtgattgtgaaaagtacaagcctggcgtgttgctggggtttaacatgaaagaattaaataaagtcaagcatgagatggattttgatgctgagtggctatttgaaaatcatgatgagaaggattccagagtcaatgctagtaagactgctgacaaaaagctcaaccttgggaaggaagatgacagttcctcagacagttttgaaaatttggaagaagaatccaatgaaagtggtagcccttttgaccctgtttttgaagttgaacctaaaatctctaacgataacccagaggaacatgtactgaaggtaattcctgaggatgcttcagaatctgaggagaagctagaccaaaaagaggatggttcaaaatacgaaactattcatttgactgaggaaccaaccaaactaatgcacaatgcatctgatagtgaggttgaccaagacgatgttgttgagtggaaagacggtgcttctccatctgagagtgggcctggatcccaacaagtgtcagactttgaggacaatacctgcgaaatgaaaccaggaacctggtctgacgagtcttcccaaagcgaagatgcaaggagcagtaagccagctgccaaaaaaaaggctaccatgcaaggtgacagagagcagttgaaatggaagaatagttcctatggaaaagttgaagggttttggtctaaggaccagtcacagtggaagaatgcatctgagaatgatgagcgcttatctaacccccagattgagtggcagaatagcacaattgacagtgaggatggggaacagtttgacaacatgactgatggagtagctgagcccatgcatggcagcttagccggagttaaactgagcagccaacaggcctaagtgccaggttccctggcgttggtgacatgctgcagcctggaactctgatatccagtgtgactgcaaagctgtcttctcactggtactgccttgtgagtactggttggactgtggggcatgtggccgctgcagttccagtggttatttctaagtctatgacaggacaggctgttcttgcttcagaaccttctctgacagacacggtaactaaatgtgaaaaaccaataagctggtgactcatgaatacacacgaggaaaagcagaggtttattttatctgccttttcaacatttctttccctctgtgaaatgattggtcagatgtctttgagaagtgttaaactaattcacatggtagtgtagggccaacatacaagctaccagtctaatgtgtatagtagactttgggaaaagcgattttttttcatgtattcattctgaatagttgaaatgtatatttgtacagtcttttagacctattcaagtgatgctcatgatcctgttactgtgtgcccatcatagatttctttttttagtgttgcccttgctgtgtaataaacgctctatctagtttacctagcaaaagctcaaaactgcgctagtatggactttttggacagacttagtttttgcacataaccttgtacaatcttgcaacagaggccagccacgtaagatatatatctggactctcttgtattataggatttttcttgttctgaatatccttgacattacagctgtcaaaaacaaaaactggtatttcagatctgttttctgaaatcttttaagctaaaatcacatgcaagaattgactttgcagctactaattttgacaccttttagatctgtataaaagtgtgttgtgttgaagcagcaaaccaatgagtgctgcattttggatatttagttttatctttagttcaacaccatcatggtggattcatttataccatctaatatatgacacactgttgtagtatgtataattttgtgatctttattttccctttgtattcattttaagcatctaaataaattgctgtattgtgcttaatgt

SEQ ID NO: 35978 - DNA, 149420 bp, Homo sapiens
aggtcgggtgagtgtagtgtgcagggaagagacgcgtcagcgccagggccaggcccgcccgggggcagcccggcagccgaatcttgggctactctgtcccaacagccggagcagatcagaccgaccggccctgcccgctcggtcccgcgccctccagaccctacggtctccgtttctaggggcacatggttagcggcaggcgcccacagccaatccactttgccagcctgccccttcctctgccaagagcagcttcttcagccgcgctccagttccgcagacgcctgccccaccctgctcttcccttccagggaagacggatcacgcggccaagaacgagactcgcaaactgggcatttctccgagccgggctagagcaagtagcgagactccgcgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaaggtaagaccctgtccggcttcgcggcagccgggcagctcgttatcgagcggcccagagaacataccccgcttgttggccctcgagctcggagtcggccctgctgctgaggtctttgctgctcctctagagctgggtgagaagtcaattaggctttttgcaaaaggaataaaatagccttgccctcgggggaccgagtctcccctgcactctcattccgcgagtttgtgtgtgtccaaagttgagttaccggttttgcttctctcattcccttcttgaggctgcaagagcctgcctggaaaacatgtttggaaggcttttcttggtcaagtacctgccgcaacgtcctcgggcacatcgcttgactttagttgagggggctgttttgtctctgaatagaaggagggcagtcacttcctctcttttacccccaccccctttttctttccctggaagctcagattgcaggtttgggacttaacccctgctagggccagatactacggtcagtcagcagctctgcctgtatgcttgacttgacttgacttgcacttattaaataactttgtcccagagagaaagagagagtgggcagacatcgaagccaaacagcagtatcccggaagcactcatgcaactttggtggcggccactcagttttctctgccagtgtctggtaaattcctctattttgtcctaatctgacaatagtaaatagtaaatttccaaaactgtcgtttcatcatcagtttcagcaccgtgggcagctgctcgggtcctctcttgttgccccaaacctgcccggctattactgttcgtcagtgatgcagcagaaacagtgaaaactgatgcattcctttcaacaatgatgtgtttgttctccaaggagaacatctgcagtttttgatacaatataaataagtaaggtggctgtgcctccaaagagttcttctggagaaacagatcaattcaagatttaaggtagggctttcaagagtttatgctatttaagcacagttttttaatgggtggacattagctccatctcgaagtaacaaaactggacagtgatagcaattaaaaagaactttaaacaggaggtaagaagtgtagtgcagtgctgtagtgcaggaagtgtagtgcagtgctgtagtgcagggcccataaggattcattaatagattttagaatcaatttagtacattgacataagctttataaagaaagaaaaaataccagaggacattgtatggaataaaagtaaatattatggcaagaagcttttgtttcagtttttaacagtatgtgtgtgtcaagaggaagatggaaatgtaaagtgtattatggattatggcaaaaacaaatgtttcaaaatactaaattccaaatttgggagtcaagctgggttcagctctgccatttactaattctgtgacattttccgtaaataagaaatgagttgttatgaggattaaatgaaacaaaatttgtctattacataatttttttttgttttgttggaaactgttggagagaggcacagttatttttctctatgtagggaatgagaactgttttattagtttttttttttttaacctctgcctttgtttgaagctaggcagcttgacatcttgtctctatgtgtaatgcaaatcatagacagaatcttggtttgagaggtataatactgaagggtttgggataagttctcatctatgcttgtataaagctaattttctcaataattttggaggggcataaattgttgctagcattcagctttcttcccttgatatttttctgcattccagaataacgtagatttatcagaacttttacaggcactaactttagctaagtgagggtaggcctgagggtatgactaaagggatagatttatgtctttgagttaagttggctaggaaggcattttatgccttatagttcttgccataagagatgtatgaaatgaaatagtttggtcaactatcatggtatgttttgcttacttcatgtaggtgtgacctagaaatggttggcatttaaataacaatatttttaaatctgggaattgatgtttagcaggaggcaaatgagtttcagtcaaaacagtgttttgcaccatttgtcatgtttaccatatggcattgcatatgatagtttcacatgacataaaaaggggaagaaagttggtaagcattgttacttttcccaaaagaggaaacaaaattagaagcgaattccttttaataaagcatactggtgagtcattgttcaaaaatgtatgtattctatagatatttattgagcatatataaaagtaaaatattaaacttttatgaatcttttacattacacaaaagttgatttgggaacaacacagcatatgattggtattgtcaaagtttatatagcatagtatatcaacaacaacaaaacagtaatgtagctaatattgattggttaatatgagccaaatacaattctaagtgctttataatatctcaggtggttcttacagtcattgatgtggtagatagtaagttgtttcctttttatttttttttgggacagggtcttgctctgttgcccaggctggagcaattatggctcactgcaccctcgacctcccgtgctcaagggatcctcctatcttagcccgacaagtagctgggactacagtcataaacccccatgcctggctaattaaattttttttttttttttgtagagacaaggtctcattatgttgctcagtctggtatgaaactttagggttcaagtcatccacctgcttcagccttccaaaatgctgggattacaggtgtgatacatcatgcctgtcttatccccattttctaagtgggaagtgggggaattaaggcatcacagatacataacttctgagttcacacaagtagctggtggagtagctggaatttgatcacaggtattctgactacagaacgtctgtctcttttgtgtcttatttcattaaaaaatatggaatgctgtggggctattgtggattcgtacttgctggtgaccttggggaagctcctcctcaatttccttaactccttccttacttgtttttgtggggattcagataatttgtgaagcaatcagatggcgtatatgtttagtaaattatatgccttagcctttttttttttttcattgaggatgaggtcatttgaaagattgttagcagttgaaggagggtggaaaaaaaaaagttccacataaggacactgcccaagcaaaggtatagagataggaaaagcagaatacatttggtaaggatatatgtttaaggaccagactggtaaagatagatggatacagattatggagattcttaaatgtcagactaaagattttatatatgatttttagttaagaagaaactctctttatggataataatttgtgaacaggtccaatggaagagtggaagcctagaagtaggaataccatgcaatttaattatagtagttgaggcaagaagtgatgatcgtagtgaaggtatagatttgaaagatgttgacattataatgacattgacactgggaactgaccagagtataggcctaggacaaatttttgggaggatagtgatgttattaacagaaataaggatattatcatgaagaacaggttttggtggaaggagatttaggaggagagaggatgatagggagtttacttttggagctgaggagttgttcagacgtttggaaatgtagaatgaaaactggaagttctgtgtattctatgaaaagggaagagaacaaatgcttacattgtaaggaaatgacctaaaagtaaccactcctctgtgggtcagagtttcacaagagggatgtgactccttaaattactcacaagtacagatttctcaatgaagatgcacccattatttttccctttagtgtattttgattcgtgtcctgggagatcaggaggtaaggtagtggggaggaaaaacttttagacctagcaaggctcccatttattcaaaaaatagctagtaaattggaggctagggattctcaccgtaagaattttgagagtctgatttttgtgtggtaccaggcatttataaacatatgttgaatgctgaattgttgaacatttgaacatctccagatttgttatttttattatcctgtctttgttaccttgaattggttaatagcaaaacctttagaatcagagactctgtgtgcttgttatggggggcaacaatgaaagtcagggtgcagctaatgagattgtattttacttatagccaggattgtggaagaagacactcaaaggataagaggcttaccatttttcccattctgtaaaaccatgttgatgacaataccaattctgagagttgttttgaaatactgagttaatatatgaaaagggtctggtacatgatagatagtaattgagatgtttttgttaccagtattattatcttcacaagtggggggcaaacacagagatcccagaacctattataagaaaaaaaggaaaacatctggagaccctttgtacttgaaaaagggctcaggactaagtcatagaaggactgtaggtttcctttcttggaaggttttctagggtttggtacaattgggtagagcatgatgttgaattaagtagtaaaatatatccatctcaactattttcagtttcctgtcaagttctcagtaaaccaacagaaaaatgttgttgagcatgagaagaaggtttacttttcttgtcataccatttttggaaacattacttggatcctactacttaggggtttttctgtagcatttattcactcaaatatttgttgagtaccttctttgtcaggcactgttctaaagagaaaaatccttgcctgcatggagcttatctgctaatgggagaaataaggtgcattttcataatagacggtaattagatttttctcgtactatgtatttgtacctatttaagcagatggtaataatgaatactataccagattgtaactaattttgcagagcatttgaaggaagggaccatgtctttcttattcgcatttgtctctcccttttccccttcctcccagtggaatggcttagatgtgtttaatgctcaacaaacgtaggtactcatcaaatgtttattacagggagaaggtgttaaggcagaggctacatcttaaagattaaaggagtcagttaaatgtggcatgtattaaggacccatataccccctagattgagggtgagaagaagagaatccggctgggcactgtggctcatgtctgtaatcccagcactttgggaggctgaggtgggcagatcacttgagaccagagttcgaggccagcctgggcaacatggtaaaaccccatttgtactaaaatacagaaattagccagatgtggtggcgtgctcatgtaatcccagttacttgagaggctgaggcaggagaattgcttgtacctgggaggcggaggttgcagtgagccaagaccgcggcactgtactccagcctgggtgacagagcgtgactctgtctcaaaaaaataaaataagataaaaataaaaagagaatcccctggcttatctatgaggttggaataggaataaagttatattgtagctgaaagcatcaacattatgggagtctgggtgtcacccaacattcccactaattagctgggtgattttgcataaatatcttaacctctcagttcatttcctcacctgtaaatgaagtagttggaattgtccagttaaaatctgtttttacgacttcttgtaaaatatctcttgcactaatgtttcacttcactaacgtagataatatagagccaagcatgagcttccattgaataagcatcaagctaaatatatactcttagttaataaactaatgtttaagaaaagatgtctacaaaatttgttgatgctatttaccggtaagattacattgtaattttttaaaatagagcaaaatattacctaatatatagtttcccccattgccattatgtaaaggaaaaataagccatagtattttagaccttaataatggatcataatactcactttcatactttaatttatacaacagtcacttgcctctgatattgtgctagatgctaggtattgtatacagaattagaaaatgtatagctcctaactttaaggagcttaaggaataatgggagtgacagaccatttagttgtgttgcattttggtggcatagagaagcatataatgagagtctgggagaagagaaagtgctcatggttacagagaaaaagactggaggaatggcaagggactaagctaaatatacagagacgagccagtttatgaagaactttgtgctaaaccacagtttagttctgagctgtattctgaaaactgcttaatctgttaaggaattttatgcaggcagtaacataatcaggcatttttatatctacctttatattccttttaagagaaggtgttccctgaggaaggtatttgttatttctagttgtttcaacgatgtagatcttcctgaggaaatcagtctttttaactttgaaataaagtctgaggaacattgtcaattttgtggttatagagttaataattattaaatattaataattatgaaatattcagacattaaaacatttaaatgtttattgccacattaatgtaaactgaaaagaaaactgaaattttgggatgttttgcgctttgatgtaagagagctcttggtcagctacaagaatttggcttagaatcatttttaaggagttagaaatacgttgaccttgaattgattgaaagtgaatgtagttcaggctcagtttctttctttcttttttttttgtttttttaaagagaccgtctttttctgtcacctggtatggtctcaaactcctggccccaagcaatcctccctcctcagcttcccaaagtgctgggattacaggcgtgagtcaccactccctgcccgggctctgtttctaatgatagaaatatccaggtaaactttatagagggaatgaatttccaccgggaaataatcctagtgaggagctggtgataaatgaatatttctgaatgaagtcatgagggagaaacatctactttatttagatgtgaaacacctcattaaatgttgaagaatactttatttgcatacttactatgtttgtcatttactcttttgaccctcaaagaggaagagctgcttataatttccacatttatccaacatggattataaatgttaattgctttttttggaaaaaaaattgaggtaaaaattcacgtaattaaccattttaaagcaatagttcagtggcatttagtacctttgcagtgttgtgcaaccatcacttctgtctagtttcaaaacatttttatcactttgaagtaaaatctcatacctattaagcagtcattccctgatgcccctagctcatggcaaccacatctgttttctgtttttatggatttacttattctggatattttatataaattgaattttcaatatttgagtttttatccctggcttctttcacttagcaaaatgttttcaaggtttacccacatgtagcatatatcagtacttctttccttttcatagcagaagaatattcctttccatgtcagaagaatattcctttccatgtctatatatcagtttgtttatccatttatccatcgatggatatttgggttgtttccaccttttagttattatgaatatgttgctgtgaatatttgtgtccaaggatttatttgagaacctgttttcactttttcgggtatataccaagaatggaatgctgggtcttatggtaattttgtttagctttttgaggacctgccaaactgctttccacagtagctaaaccattttacattcccactggcaatgtgtgagggttccaatttccctacatccttgcctacacttattttctgtttttaagaaattataattgccatccttatgggtatgaagtggtatctcactgtggttttgatttgcgtttcccagattactaatgattttaagcatcttttcatgtgcttgttggccatgtgtgtatctgctttagagaaatgtctattcaagttctttgcccttttaaaaaactacattgttggtgtttttgtattgagttgtgtttttatatactccagatactagactgttcattatcaaatatataatgtgcaaatgttttcttccattatgtggattttttttttcaattttttgataatgtcctttgatagataaatgttttgaattttgatgaagtccattttatttatttgacccatgcttttggtgtcatatcaagaatccatttccaaatcccaggccatgaagattaaccctatgttttcttccaagagttttataattttactccttatatttaggtcactgattcattttgtgttaattgttgtatatggtataaattccaacttcattgtcttgcatgtgaatagttgtcccggcaccacttgttgaagacactgttcttttgccattgaatggtctttggcatctttaaaatcaattggctatagatgtatcagtttatttttggatgctcaattctactcctttggtctatatatctatcactatgccagtgccatgttgttttgattactgtagctttgtggtaaggttttgaaattgggaaatgtgagttctccagctttgttcttctttttaaaaattgtttggcctgtttagggccccttgcaattccatatgaatttgagaatcagcttttccatttctgcataaaaggccatagaaattttgataggtaatatattgaatctgtagattgctttgggtagtattgccatcttaataatgttaagtctttgagtacctggatgtgtgtttgatatccttcagcattgtttttgtgttttatagttttcggtgtacaagtctctcacctcctttgttatatttattcctgggtattgtattcatttggatactattatacatggaagtttttcttaatttaatttttggatagttcattgctggtatgtagaaacacaatggattttgtgtgtaacatttattgcctttaacagtcatttactttcttttttccatgtgcaagctgaatcacgtgggtaaataagaaagtggaaagtggaacactaaagaacttgatctgtaagatgtctgatttccctgaatgtgaaaactatgaaatatgtttttagcatagtgttgaactattatcttactatacttgggctattccatttctggtatcacgttacatatatttggtcattattaaagaaggtagatcatttcattttctttaggtttggagagaagtgtcaatacgtaattcattttcaaagttacaattattttgcaacttaattttgatgttacacagaaagcctcagggataaaccatatttatcgcagagtctggtacagagatccatgaataataaagataaaattagaacagaagctaatttgaatatgtaaattaccattaatatacattagtttttctgttttttcttgaagtttccaaatagccttaaaatttcattatgaatagaaatgtgaacaatttcaacctcataagtaattaaagaaatgcaaatttatgcaatacttggatgatttgggaagggcagtatttcatgacacagacttttaattgaatcctagcttcactatttaagaggtaagtattactgggcaagtaactgaacacttaaaacacttaaaaataagaggaaatatttataaagtgcttgctgtgtgttaggcactgttttaagcactttatgctgttgatctaagtttttattcctatatttatggaaagacagtggaacctactatagagttgtgaggattaaaataaataatgtatattaaggacttagccagatatgtagtaagcatttgataaatattagctatttttgtcatttataatttcacctaacaccaacaaaagaccaaaaaaggagaatcgatacaatgaaatgcacatttatttggaaatataaataggaatgttcttttctggaaagcaattgggcaatatgtatgaagtcttaaaatgtttctttggtgtagtgattccatgtcaaggaatctatcccaagaagataatcagaagtatggaaagatttatattcattggaaaattatttgtaatagtaagagttcaattcaatgttgtacagcaagaaaatagacaaagtcatgtgtcagccatataaagcagtacaaagtagctgttaacatagtggttatgaagagtttgaacaacaagggaaaatctttgttataatttcaagtaaaaaagcatacaaatcataatacaatatgatacaagtgattactttgaactttggaagacattatattattaaaataaaataacatgttaaaattttgaagtagctacggagttaaagttgtaaaaacaatacaaagacctttatgttttttgttatttgagagaaagttgtttctctgatgctgtatattcctataaacaacaatattctctttaaagaaatggctgatttcagggctggggcaggaaaagtacaaggcaggactggaaaatcttgtgccagaaaacaaggaggtgctcaagaatgttgggaacatatcaaaaagacacaaaagctagcttgaataagcctccattggccaaacaattggacatcaaaatgataatacaatagcagattataacccattgaataaaacagtaatctgtgattccacactgatataaataagtaaatgaataaattagaatgttgccaagaaatgtgataattaccgtggtaggcagaataatgactgcccaaagatgtccatatcataatacttggaatctgtgaatatgttaccttgtatgagaaaaggaactttgcagatgtgattaaggacctcgggttgggaagattatctgtgtgggcccagtgtaatcacaagtgtccttaaaaatggaagagggaggcagaagaggagtttggaataatgtgctataagaaggaattaatctgccattgctggctttgaagatggaagaagaggctacaagccaaggatgttggcagcctctagaagctgataagtataacaatcaaattgttgtataatgtaaaacattttcatttaaaaacatacatgaataatatcctagactagaaaaaatatatggtttttttttgtgaaaggaaatgacctctgtcctagttttcctttggggctttttttttttaaagatatacacacaaatatagttaggtagattgataaacacatacaggattatatgattatgtctagttaatgtccatttgtaagtatgtctgtatcaaaaagctccaaaagaactaggtcagaggtcatcctcttttttttttttttaatttaacttattttaagttcaggagtacatgtgcaggtttgttatataggtaaacttgtgtcatgggagtttgctgactagattatttcatcacccacgtattaagcctagtacctgttagttatttttcctgattttttttttttttttaagatacaaagtctttccgtgttgctcaggctggagtgcactggcgatcatagctcactgcagcctcaaatcctgggctcaagcaatccttctgccttagccttctcagtagctgggactataggtgcatgccaccacacctggctaatttttgtattttttgtagagacagagtctagctatgttgcccaggctccagcaacccttttttttttttaaggcttagtcttgctctgttgcccaggctggagtgcagtggcacattctctgctcactgtaacctctgcctcctgggctcaagtgattcagcctcctaagtagccgggattacaggcaccaccacgcctggctaatttttgtatttttagtagagacagggtttcaccatgttgtccaggctggtctcaaactcctgacctcaggtgatccgcctgcctcggcctcccggagtgttgggattacaggtatgagccaccatgccccgcctccagcaaccctcttgatgcagatgttgtacattccaggcctggtgcctgcagctgtgccctgactgcctctgcacacctacccatcagcaccccagtgggctgtttattgtttaccgggcaaccttggaccagctctggtctggtcaacccagtgagattctctgttacctggtgtgctgcaaccacacctgctccagtgaaaactgaatttcagcctcaggctctcttccaagtttgtccctttgtaatgtctccctcagtgttactctcttatagtttaataattccttttctctaaaaaattgaaaacagctttactgacttataattcacatacaataaactacataaaagtgtatactttgataagttctgatatatttatataatcatgaaaccacctatataatgaagttaatgaacatattcatcactcttagaagtttcctgatgcccttttggaatccctctctcctgcccctccctacccctctttgtatctttatatttactgtcctatcatagcttaataatcatttatattgaataccttttgtttaacttactgaatagtttctcctgtttgaatctctactggtacacaattggtgtctggagtggctccagcagatagatctgaaattctgagattttggcatttgggtggttatgcctttgggcctgagcgcagtgctgagctccttgtcagagggaaatggaatgctggtaatccatggcatcacaattaattaagctatcacctgtggttgattataatgtgttgctaatgaatgcagatgcctcagagcccaagtggctgctacatttgacctttatggcaataataactgtaaggactatagtgtaggatagagtcttttgagtataattaaaggcttacagacagaaaatgactgctcagatttgttaactctgctcaagatctgccctttctcttttttgatcatatattttacttcaaatcatttcatctcctccaaattatgaataaacttgtgaattaaaagacttgttgcttgctcatttaagaaatattttgctgtgtaaaagtaatgcacacttagaaaacttgagcaagtagaacagatttctcttaatattttcgtgtattttcttctagtctcctgtatatattatgcaaaatgaaatagtctagggagttttagttttttattatgaaacatgcagataaatataaagaagaataaaaaccgcagagtcccaccatccagagcttacatgattcagcaaattaatttattatttcatagtatttatgtttcgttttgagatagggtcttgctctgtcacccaggctggagtgcagaggtgcaatcttgtctcactgcaacttctgcttcctgggctcaaacgatcctcatgcctcagcctcctgagtagctgggactacttgtgcatgccactatgcctagctaatttttgtatttttatgtagagacagagttttgccatcttggccagggtggtcttgaactcctgggctcaagcagtccacctaccttagcttcccagagtgctgggattacaggcattagccaccatgcctagccatatttatatatttttaaatattaacgtacagttggccctctgtatccatggctctgtatctgtggattcaaccagtattcaaaatattcaggaaaaaaaatggatggttgcatctgtactaaacatgttaaacaatatggtataacaactatttacatagcatttacactgtattcagtattataactaatctagagatgatttaaagtatatagaaggaggtgcgtaggttatatgcaaatagtataccatctgtggtaaggaacttgaccatccatagattttagtatgagcgggcagtcctggcaccagtctctcacagacaccgaggatgactgtatatataaactatatataaacttttaacatttttaatgttacggtcttaaattttttttttgagcatagaggctctgcagaagatatcaagagaggctatgtaggcattcagtctataaatattaatattaaacacctaatacattataggcactctttaggtacttgtgatacatccataaaataaagattcctgtctttgaggagcatatgtttttgtggcaaagctgaacactaaacaataaacataacaagtattatagtgtgatagaaagtcatattataataaaaaaaggaaagatgattataagaagagtgaggcatgataggtgcataggcaggctgcaaacacttgtcaagggagagtgtggtgtccagaaaagaccaagaacagggctgtgggtgatgttttaaataaacagttgttataggctgagtgtggtggctcatgcctgttatcctagcattttgggaggccaaggtgggaggatcgcttgaggccaagagttcaagaccagcctgggcagcaaggcaagaccctatctctctattttttttttttttttaaagaaacagttgttataatcaatgggaatgctgtaacttgatctggtgctccaccattaacatggtaagccatgttaagtttcatgtttaacacctgaactaagtgcgagtcattggacttctcagctttttgttcagaaattgcaaaaattaaaggagtaattaggatgagggaactggttcatttagtcagtcagttagactctagcacttaaacatagaaattgaatcccctaaaatagggaaaatggaatgacagtgcaagttactattttcctgtgttgtttttgttttattttacaatgttgttttgatgattagaaggaaaaacattcatgtcagatgcttaacacagtgcctagcacaaaattaagttttctatcaatgttggctacagtgatggtgacatttatgtgaggaatcatgaaaataaaacattctggtttgggagatagatgacattaataccttcaagtacactgtgcatgatatttgatattttgataatcaagaaaaccagaattttctaccatctttccctagtgtttaatattctgctattcatgaaagcaatttcattgtcaattgtctttttcttgtttgctgtgtggcttattgctagggttggcagcctatggtactggtgacaacagtggtatttgaaagaattatgaagtctgtttttcttagcactcctatcactctctctctctctttttttttcttctctagtttgaccctctacccactgcctattgacttgcaagaagtttatgaataatgacttggtacgccacttaccaatctttggttcaaaacagtgctttccaaatttgacttaattatatggattcaatagggaacttttttaaaagtcaaattataggttttctgtctgcatctcaaggggaggggcctgggaacatttatttttgtcacaggcgctgagagatttgtgatatactgaactaaaaatgtattttccatttataagaatcacctggagtacatgttaatactgtgaatagtatagatgaccggatcacatctcatatatactgagtgagaaactataactttgggattgagaacaattggtatgaaggccctgagattggaaagaatttgatattttggaaaaacctatttctttttgagatggagtcttgctttgccacccaggctggtgtgcagtggctatcttggctcactgcaacctcttcctcccaggttcaagcgattctcctgcctcagcctcccaagtagctgggattacagacgtgagccaccaggctcagctaatttttgtatttttagtagagacagagttttatcatgttggccaggctggtctcgaactcctgacctcgggcgatcctcctgcctcggcctcccaaagtgttgggattacaggtgtgagccactgcgcccggccagaaaaacctgttttttcttaatctattaaaagtaaaaaattgatcattttgtttcatttgttgaaaaataaaattgtaaaacatttattgcataggtgaaaaaattttgctttggttgattgtggtagttaaaaatcttagattatgcttgcttttactttggaaggctttatgttagaggaatttgctgggcaaacttctgctttcttgcaaaaaatattggacatcttatttttgcttaaaaagagaagccctattattgttgtttttgttttgttttggtttctgatgtaacacttttgcttatgacaacttctgatccagtgtttttaaaagcgttaaaaaactatggagatttaaatatagtatgtgatatggtttggctgtgttcccacccaaatcacatttcgaattatagctcctataaaccccatgtgttgtgggagggacgtggtgggaggtaattgaatcatgggggtggttttttctgtgctgttctcgtgatagtgagtaagtctcatgtgaactgatggttttataaaagggaagttctcctgcacatgctctcttgcttgctgccatgtaagacatgcctttgcttctcctttgccttctgccatgattctgaggcctctccagccatgtagagctgtcagtccattaaacctctttttctttataaattacccagtcttgagtatttcatcatagcagtatgaaaatggactaacatagtaaattggtaccagtggagtgggtactgctattaagataccagaaaacttagtttaaaagggaagtgactttggaactggataacaggcagaggttggaacagtttggagggctcagaagaagacaggaaaatgtgggaaaatgtggagcttcctaaagacttgttgaatggttttgaccaaaatgctgatagtcatatggacaatgaagttcaggctgaagtggtctcagaaggagatgaggaacttattgggaactggtgaaaaggtgattcttgatatgctttagcaaacagactggtggcattttgtccctgccctagagatttgtggaacttttaacttgagagagatgatttagggtatctggcggaagaaatttctaagcagtaaactgttcaagaggtgatttgagtactcttaaaagcattcagttttattcattcacaaaaatacggtttggaattggaacttatgtttaagggaagcagagcataaaagttcagaaaacttgcagcctgatgatgcaatagaaaagaaaaacccattttctgaggagacattcaagccagctgtagaaatttgcttaagtaacgaggagccaaatgttaattgccaagaaaatagggaaaatgtctccagggcatgtcagaggtcttcatggcagcccctcctatcacacgcccagaggcctaggaggaaaaaatggcttgctgggctgggcccagggccttgctgctttgtgaagtcttgggacttggtgtcctgggtcctagctgtggctaaaagggaccaaggtacagtttgggtcctggcttcagagggtgcaaaccccaagcattgacagcttccacgtggtgttgagctgcaaggtgcacagaagtccagaactgaggtttgggaatcttcatttagaattcagagaatgtatggaaatgcctggatgtccagacagaagtttgctgcgggggtgaagccctcagggagaacctttgctagggcagtgtggaagggaaatacagtgttggagcccccacacagagtccctactggggactgcctagtggagctgtgagaagcaggccactgttctccagactccagaatggtagatccaccaatggcttgcaccacatgcctggaaaagctttacactctcaatgccagcccatgaaagcaaccaggaagggagctgtaccctgcaaagctacaggagcagaactgcccaagtctgcgggagcccacctcttcctcagcatgagctggatatgagacatggagtcaaaggagatcattttggagcattaagatttgattgctctgctgtaaaatttcagtctgcatggactctgtaccccccttgtttctgccagtttctcccgtttggaatgggtgtatttgaccaatgcctgtcccctcattgtatctaggaaataattaacttgcttttgattttacaggctcataggcggaacggacttaccttgtttcagatgagactttggatgtggacttttgagttaatgctgaaatgaattaagactttgggggactgttgggaaggcatgattggttttgaaatatgaggacatgagatttgggagggtccaggggcaggtatttcttcatagcagtatgaaaatggactaatacagtatgtgttagaaattctagttgccagaattcctggaaatcttgatgctttttaaggaacactaggaagttattgatatatttaggtggtgtgtgagctgagaacactattttggaggaaattttatagtgccatatatatgttataaacatatgtgaccataatcacatttgtaggaaaaataacctattaaatgatgtgtgactggctattataaattttccactaaaatagttaattaattgttcgctgatttttttctgttagtgcttggtacagtatatattcttctgatgcttattgtagtataaggtacatttcttgaaaaaaacaaattgaaattactctgcctattctgttcgcaaattaggaaaagataacaattcttttagtagtggaatattttggtccagttcttgagatgccagtgaaggtcaagaatgtagcttcagaaccagtggaatctgagcttacttggtggatttcttatggagatggctggctgtttcatgagtgttatttggcagtgaagcagttggtatcacactgttgactcatcttcagaattaaaatttatttggaagtgaatttcctgaaagtaatactggtcttaaaaattcattgtcacagatttaaatgtgaagttaggatttactgtgatgcttgggaaattttcaaatttttcagtgaccagcattagacaagtaactgtcatttatcctccaaaaccatacagataatcatgtgtaccagccagtttgctcattttctcaaaaatgaggccaagagaaaactcagccaaaccaacaattggtttttaaaaaaaatctatgaaattaacaaatctttcattatagtgactaaagaaaacaagagaggagactcaactaaaatcagaaatgaaagaggggacacaactaccaattttatagaaataaaaaggattgtaaaagtactataaacaattttatgccaagaaattggataacctagatgaaatggatgaatacctggaaagacacaacctcccaacactgaatcatgaaaaaatagaaagcttgcacagacctatgggagattgaagcaataatcaaaaacattccaagaaagaaaagcctgggatcagatggcttcattggtgaattctaccaaatatttaaggaagaatcaacatcaatttttctcaaactcttcccaaaaaactgataaagagggaacacctcctaacttattctaaggggccaaaattaccctggtaccaaagtcagacaaggatactaaaaaaagaaagaaaagaaaactacataacttatcgttctctctctctctctttttttttttttttttttgagatggagcctcactctgttgcctaggctggagtgcaatggtgtgatcttggctcactgcaacctctgcctcccaggtttaagagattctcctgcctcagcctcccgagtagctgggattacaggtgcctgtcaccacacccagctaatttttgtatttttagtagaggcagggtttcaccattttggccaggcaggccattatctcttatgactgctgatgtaaaaatcctcaacaaaatgctagcaaactgaattcagcagcacgttaaaagcattatacacatgaccaagttggacttattcttggaatgcaaggatggttctacatgtgaaaagtgttatagtcaatgtaatgtaccacattaagagaataaaaacacataatcacttcaatagatgcagaaaaagcatttcacagaatttaacactctttcatgataaaacacccaacaaactgaaaatagaaggagactacctcagaataaaggccatgtgtaaaaaaccgacaactaatataattggtcataaaagactgaaagcttttcctctaagatcaggaacaagacaaggattcctgcctttgccatttctatttatcttggcaccagaagtcctagccagagcaattaggcaagaaagagaaatgaaaggcatcaaaattagaaaggaataagtaagattaccattgtaagcagatgatatgaccttacatgtaggcaatctaagattccacaaaagaaaaaatatctgatagaactattaataataaatgaattcagcaaagttgcaggatacaaaatcacacacaaaaatcagttgcattcctataaagtaacagcgaactatccaaaaaggaaattaagaaaacaattccatttacaatatcaacaaaaataaaatagtaataaattaaaccaaggaggtggaagaattgtacactgaaaattgtaagactttgctgaaataaagaggacataaataaatgaatagacattccatgtttatggattgatagacttaatactgttaagatgtcagtactacccaaagaaatctatggattcaatgtaatattatcaaaatcgcaataaccttcttgcagaaataggaaaatctatcctaaaccatatatggaatctcaagggaccccaaatagccaaaacaaagttgtaggtcgtatacttcctgatttcaaaacttaactacaaaattccagtaattaaaatagtgtggtactggtgtaaagatagacatatagagcaatggaatagaataaagagctcaggaataaagcctcacatacatgctcaaataacttttgacagaagtcctcctatggtttggaaatggtttgtctggccccaccaagtctcatattgatatttgatccccagtattggaggtagggtctgatgggagctatttggattatgggggtagatccctcatgaatggcttgatgccgttctcatgggaatgactgaaatttcactcttagttcttttgagaactggtgattgaaaagaacttggcactttcttccctctctctcacttgctgctcttgctgtgtgatgggctcccttttgccttctgccatgaatggaagcagcttgaggtcctcaccagatatagatgttggtaccatccttcttgtacagcttacagaactgtgggccaaataaacctcttttctttataaattacccagcttcagatattcctttatagcgacacaaatggactaaggtgtcaagatcatttgatagagaaaggcattgtacacagtctcttctacaaatggtgtgttgggaaaactgaatatctgtatgtaaaagaatgaatttgacctttaccttataccatatgcaacagttaactcaaaattgatcagagatctaaacataagagctactatgtaaaactcttagaggaaaacataaagaaagcttcacaacattggaattgtcaataatttcttgggcaggacaccaaaagcacaggcaagaaaagaaaaaaatagatgtttgacttcatgaaaattaaaacttcttgtgcattgaaggacagtaccaacagggtgaaaaaaatgagagaaaatacttttcaatcatatattttataaggaattgctgtctagaatatatagagaatttaaaaaatttttttatttccataggtttttggggaacaggtggtatttggttacatgagtaagttctttagtggtgatttgtgagattttggtgcatccatcacctgagcagtatacaccttcaccccctcctaccctttcccctgagtccctaaagtccattgtatcattcttataccgttgcattctcgtagcttagctcccactaacgagtgagaacatacgatgtttggttttccattcctgagttacttcactaggaataatagtttccagttctatctaggttgctgcaaatgccattaattaattcatttttatggctgcgtagtattccattgtgtgtgtgtgtgtgtgtgtgtgtgtgtgtgtttgtgtgtgtgtgtgtgtatgtgtgtaccacaatttctttatccagtagttgattgatgggcatttgggctggttccatatttttgcaattgtgaattgtgttgttataaacgtgtgtgcaaatatcttttttttatgacttttctcctgggttgggattgctggatccccagtagtgggattgctggatccccagtactgggattgctggattcccagtactgggattgctggattcccagtactgggattgctggatcaaatggtagttctacttttggttctttaaggaatctccacattgttttccatagtggttgtactagtttacattcctgccagcagtgtagaagtgttccctttcaccacatccatgccaacctccattttttaaaatttttttgataatggccattcttgcaggagtaaggtggtattgcatagtggttttgatttgcatttctctgatcactagtgatgttgagcatttcttattttgtttgttggctatttgtgtatcttcttttgagaattgcctattcatgtccttagcccactttttgatgggattgttaactcagtggcaaaaaaccaagcaacccaattaaaaaatgaacataggagctgaatagacatttttccaaagaagacatacaaatggccaaaaagtacatgaaaagatgctcaacatcactaatcattggggaagtgcaagtcaagaccacaatgagataccactttacatgtattttagtatggctatatgtatatatatatattgtatatatatgtctatcataaaatagatttaaagtggtatctcattctggtcttgaaggaaaacaacataaaatagcaaatgttggcaaggatgtgaagaaatagtaactgtttgtgcattatttgtgggaaagtaaaatggtgcagccactttggaaaatggtatggcagttctttaaaaaaaaaaaatcaaacgtagaattaccatatgatccagcaatacttctgggtatatgccacaaataatttaaagcaggaactcagttatttttttcacaatagctaaaagatctaagcaacccaagtgtcaattgagagatgaatggatcagtaacatggggtatgtacatataatggaatattactcagcctgctaaggaaggaaattttcacatgtggtacaacacttcaagatatcatgctaagtgaaataagctagtcacaaaaggacaaatattgtatgattccacttatattaggtagttagagtagttgaatttatagaaacagaaaataaaattgtgcttgccaatggccaggggatggggcatgggtaattaatgtgtaccaggtttcagtttgggaagatgagaaaattctagggatggattgtggtaatatttgcacaacaatgtgaatatagttaatgttactgaactgtatactttaaaattttttatatggtaaattttatgtctgtatgccacattaagaaaagaggctgaaggccttctgaaaagatcactgaagagttaaaataatttttcatgcatttagtaaactttttattatataaattctcaaacatatagaaaagcagagaaatagtgtaatgaatctcaatgtaatcttcacctagatttatagtgtgtttttttctgaagtgctttaaatgacagatatcatgacatttctttcctaagtactttactataatagatagctccccaaataaggactttttcatacagctattgtattagtcctttttcacactgctgataaagacacctgagactgggcaattttcaaaagaaagaggtttaatggacttacagttccacatcactggagaggcctcacaatcatggcagagggtgaaaggcacgtctcacatggtggcagacaagagaagagagcttgtgcagggcaactctcctttataaatccatcagatctcatgagacttattcattatcacgagaataacatggggaagacctgcctccatgattgaattacctcctgccgggtccctcccacaacacatgggaattcaagatgagatttgggtgaggacacagccaaaccatgtcattctgccctggcccctcccaaatctcatgtcctcatatttcaaaaccaatcatgccttccaaaagtcccccaaagtcttaattcatttcagcattaactcaaaagtccacattccaatgtctcatctgagacaaggcaagttccttctgcctatgtgcctgtaaaatcaaaagccaatcagtcacttcctagatacaatgggggtacaggcattgtgtaaatacagctgttccaagtgggagaaattggccaaatcaaaagggctacaggccccatgcaagtccaaaatccagcggggcagtcaaatcttaaagctccaaaatgatctcctttgactccttgtctcacatccaggtcacgctgatgcaagaggtaggttcctatggtcttgggcagctcctccctggtggctttacagtgtacagccttcctcttggctgctttcatgggctggcgttgagtgtctacggcttttccaggtgcacggtgcaagttgttggtggatctactattctggcgtctggtggacagtggtcctcttctcacagctccaccaggtggtgcctcagtagggactctgtgtgggggctccaaccccatatttctcttccacactgccctagcaaaggttctccatgagggctctgcccctgcagcaaacttttgactggggatccaggcatttccatacagattctgtaatccaggcagaggttcccaagcctcaattcttgacttctgtgcacctgcaggctcaataccacgtggaaactgccaaggcttggggcttgcatcctctgaagccagggcccaaactgtaccttggctctgtttagccacggctgggatgcagggcaccaagtcccaagacttcacaaagcagcaaggccctgggcccagcccagcaagccattttttcctcctaggcctctgggcctgtgatgggagaggctgccatgacaacctctgacatgccctggagacattttccctattttcttggcaattaacatttggctcctcgttacttaagcaaatttctacagctggcttgaatgtctcctcagaaaatgggtttttcttttctattgcatcatcaggctgcaagttttctgaacttttatgctctgcttcccttaaacataagttccaattccaaaccgtatttttgtgaatgaataaaactgaatgcttttaagagtactcaaatcacctcttgaacagtttactgcttagaaatttcttccgccagataccctaaatcatctctctcaagttaaaagttccacaaatctctagggcagggacaaaatgccaccagtctgtttgctaaagcatatcaagaatcaccttttcaccagttcccaataagttcctcatctccttctgagaccacttcagcctgaacttcattgtccatatgactatcagcattttggtcaaaaccattcaacaagtctttaggaagctccacattttcccacattttcctgtcttcttctgagccctccaaactgttccaacctctgcctgttatccagttccaaagtcacttcccttttaaactaagttttctggtatcttaatagcagtacccactccactggtaccaatttactatgttagtccattttcatactgctatgatgaaatactcaagactgggtaatttataaagaaaaagaggtttaatggactgacagctctacatggctggagaggcctcagaatcatggcagaaggcaaaggagaagcaaaggcatgtcttacatggcagcaagcaagagagcatgtgcaggagaacttcccttttataaaaccatcagttcacatgagacttactcactctcatgagaatagcatgggaaagacctgcccccatgattcaattaacctcccacgaggtttctcccacaacacctgggaattcaagatgtggtttggttggggatgcagccaaacccataccagccataatactatcatcatagctaaggatttttttaaaggatatctaatatctgggccatatttccgttgtctccattattccgaaaatgtatttttattgttggtttaatggaactgtatgttgcatttgtctttactgtttctcatctcttttgatgtgtaacaatttcatgccatttcctcattctgtcctcttgtactgtctctgtttattgtgttgaattttgtagaaattggggcattaccctcaagcaagacacccatcttgtggtatcttatttattttttttcattccagaaaattcttgtaaacttgaagtgagagctaaaggcttgttagaactggtttaaaacagtttcgcaagaatacatcttaagtgttataatacagactgaacagaaagtaaaattagaatttgacagttggaaaaatctttagagtgacgaagctgatttcagttaaaatgtctgttaataactagtagaattatgtcaaatggtaggccaaattagatgtgatcaaagatcgtggtagtgtacacatctctagaagcctttttggtagttctcaagagtttcttgtatattctctactttgaactttcttcctttgaagaagtgtgactttttttattataggcatactcaaaatgaatacagagttatattctgtctttggtaatatgagtgggaggacgaggggcacaaggaggaggaaaaggataaagggtagatgtttgttatcagcaagattttactagatttttttctatgttttctctgtttcccagaatggttctaaaatatcctcaggatggatgtattctatttgctgggggataagagtctcgacaaacagtactttactgtggtccatgcagagactccaacagttgaataagttcaagcatgagaggccagtaagaattgtaatggggaagaaagataccacactcactgtccacctgcgtggtcaggggttctgattggtatccacactctcaataactgatgggctattatctggtaccaggttcactagcttggtaggaggtaggaggatagagactgggagcacaacatatcaacataaaatgcatcttcactgagaagccttacattcattcagataaacctttcatacctaccaaagagtatactggattgtaaccagtgagataaatatatggatgtgtatcacctcagcatacaaaagtgtcacatatgaaaggaaccacttcttttaatagtccgtgagtagctccagcttcgctcaagcatcatgctttctttcaagaaacagacactgtagggaatcagagactttttttgtttatgtttttgtaataagcttttttagttaacttacagtcttttcagtttaaatacttttcaccaatcaggagtcatttttaccataaataatattgcctagtaatacagctgacagcctgcatttattttaatccagttgattaagtgctagaagatgatatcagagaatttaagcttgctaacctttttcctcaggaggcttcctggaaaagggcagatttaagtgaaaacaacaaaacaaaacctagcagcaacaacaaaaaacctatgtgcttatttgagaacatgttaataagtgtggatctttttcacagaaactttgtgtagttgaacatacacaaaattttgcatacaatttaataagatttgtagttttcccccaaattctcttttgaagatagaagagagtgtattttagttcctgggtaacatgtgaatgaagatataatgccagcaaggtgattgctggaaacagtgagctgattgatcagagcaagggtgagtggtagagtatgagaaagtaaaattgtttaggttgagcagattcttttttttatttttattttttgagacagagtcctgctctgttgctcaggctggagtgcagtggcatgacctcggctcactgcaacctctgcctcccgggttcaagtgattctcgtgcctcagcctcctgagtagctgggattgcagctactcagctacagaaattaccgtgcctggctaatttttgtatttttagtagagacggggtttccccatgttggccaggctagtctggaactcctgacctcaggtgatccacctgcctcggcctcccaaagtgttaggattacaggtgtgagctgctacactcggcctgggcagattcttaaatgtgaaaattttagaccctcttgcgccttctccaacatttacttctgttgaccaatgccttacttccccccacattcattttaaagttcttttctctcttgacttttgtgaaatcagtctctctctcttttttctttttccacctgtctttgaaacttagatatccctcagagttttttagtcctcttttctttttgattttcacttttacattaagagcacttcaattattcctatctgctgatgattcctaagtctctttttgccttgtgtggagctcgagatctttatttattgttgcctgtgtacatgtccaccagactgttccacaaatactaagttcagaaattctcaaattgtacttactttctcactgtggtcttccttctatgtttcctgtttcatctgttggcatccctatccaaagtcctttctttctatattccattgctatgttaagcccttctgtgcataattgtatttattctacagagttgtcttataggtcctatggtccttcttttagagataaagcaatttttgtagtttaaatatttacctccaaattacactattagtatgggacagtgctgggatataaacccatatgtataaattccatattttttactgcaattattataatgccagccacttttatcactttaaaaaatattaagggtttacctataggtgtaattaaaggaatatttattgcagtgtttttctaaaaagaaaaattccaacagtaagaatttctgttcagcccattaaagaatattcataaggaatgccatatggccatttatacatcatatttttgaccagtagtttttattttgtataaacaaattacgtatggaaacccaatgtgtgaaatagattaagaaaaaataatgcttgaaagggagggacgctccacagtatttcatggacagctatctgcaatggtttttgaggagagttaggaaaatattcataataccttaagtgaaaaaaatacaattagtaaaacagtatgcacagtgtgcccccaattttgctaaaaacgtatttgaatgtgcagttcgccctccgtatccatgggttctacatccatggattcaatcaactgcagagtgaaaatatttggggaaaaaagtgactatactgaacatgtacagactatttttcttgtcattattcttgaaacaatacagcataaccactatttacatagcatttacattgtattagatataagcaatctagagatgttttaaagtatttgggtggacatgtgtagattatatacaaatactacatgattttacataaggaacttaagcatcttcagattctggtatccgcagggagtcctggaactgatcccccatggataccaagggacaactctatacattgctaaaagactaggaagttatacatcaaagtatgagcactagttgttccttaatttgaggattatttataattttcattttccccacattttccacaatgagcaagaattagtttcgtaaatagagactataaagcaaaactcctgaacattatttaaaaaaggcaataaatgcaaaaaaccctcaaaacatgctacatgtcattgaatacacacaatatacacacatacactgtcatatacgaagtaaaaggaaactggtgactgttgatccatgagcattggcttttgaagcccttgaatacatgtgtaggcaagaagctgtactttactcttcgaacatcaaccttggatggatattgatgctgttttcagtaggggtttagaatgtggactttggaaactgactgttaggtttgaatcctggctctgctattatttgttgttttatcttgggcaagttgcttaacagttcttaagtcttccccatttgtgaaatgatacctaccttacagggaggttaggattaagtgagttaactcaataacatgcttacagcaatgcctggcacttagtaagagatcagtattagttgttttggttattattccaatcttttattttccctccaaactctgtctccctttcccttccccaaagttagctggaaatttagatggaaagtcatagtttttattcagattcagtttcccaaagaggtcactggtcaattaggtacatacttcttcttcctactaaaatttaataacaactataccttattttgtaaatatttgtgtgcttttatggtatgatttctaaccagaaattgtccacattcagtgattcactaggagcatttacaagactcagcacatggttgtacttatggctgtgatttattacagcaaaaggatacaaaacaaaatcagtgagaagaaaaggcacatggggtaaagtccagagtaaatcagtgtaagcgtctaagggtcctttcccagtggagttacatgggatgcgtctaattcctcaagcaagttgtgacaacacatgtaaaatgtttaccagggaagctcattagagactcagtgcccagggtttatattaggggttgttaatatagacactctctgtctagcatgcaccaaaattctagatcctagaaggaaaacaggtattcagcacaaaccacattttttgtaaagtgtaggcacactgagctgttcttactaggaaatagtgggaactgtcctgaaatctaaatttccagatgccagcgaggggccaaccttgcaagcagacctttctagggatagcaatctcaggcctgctgtgttaactcttttctgtaccatggtatgttatgaaatgtattttacttaagaaacgaatgtcaacaaatctagacatttaaaaaaagctttattgagatacaattctcacattataaaattcaaccaattaaagtgtacaatgcagtgatttttagtatatttatagagttgtgcaaccatcaccagagtctaattttagaacattttcaccatctcccctccaaaacccttactcattagcagtcatttctcattcccacctttcccctccctcaagctttccccccacgccctgccaatccctaggcaaccactaatttactttttgtcgttaaggaacaaatctatactttagcatgttttcatttttatttcatctctgatattagtggctttgtaaatggtaccttaaaaattattcacaggtattttacttccagtgtgtgagtcagagattcagagtttgagtctatatggcagcttctatatctagagcacttatccacactaatcatcatcaaaacggatattacatgagtttgggatatttaatgaaataattcattataaaagcccttgtttttgtaatgttcgttctcacttgtttaagagtatataatacaattgattgaggcttaccaatgataatttttatatttatgggttgacatttagtcttttcacggtatctttttgctaaaagagagaaagggactcatagtgaacaggatgaagttgggagaggtagttatgctgttgccattcagacgtagagaggggaaaaaagcatagattgttaggaggtaatggacaaaaagtattcctttattataagtggctgttaattttttggcattctctgatgttggtacaatatacaatagcaaatgaaaagtaaatttacatgtgaatttatattgaaccagaagtaaaaattttttaagttgtagaaaattttcaattttaaagcaaagatgcttgtgtgtatgtttttaaccattattttggttgaaatctagtttctctgaaatttgggttagtaagacaagctgtactataaactgagcactgtgggaggatgtttgttttgtgattaaaacagaactttgtcatcatgagttacataggtattgactaaacatgggtgtttacctaaatgtccaaatctgtgtaagttcttatgcttttgaaataaaagctttacttttaatgttaatacatgtttataattaaaagggatatttttggacattgggaattaatatatcaaatgatctattccctgggacaaagcaccagctctcagttactcacatccttgtcttccaggtgattttacaacgagatgctgctctccatagggatgctcatgctgtcagccacacaagtctacaccatcttgactgtccagctctttgcattcttaaacctactgcctgtagaagcagacattttagcagtaagtacagtaaaatttattcatgtctagaaacatcccttaaagaaaagcttaaaaaaagcctggaatgatatttataagacattgttataagacatttttatctaaaaacataccccaacacatatacacagttacttgacattgaggtaccttattcatttgtttatttattttttgagacggaatttcattctcgttgcccaggctggagtacattgttgcggtcctggctcactgaaacctccacctcccgggttcaagcagttctcctgactcaccctcctgagtagctggaattacaggcgtgtgccaccatgcccgactaatttttttgtatttttaatagagacagggtttcaccatgttggccaggctggtcttgaactcctgaacctaaggtgatcttcccgccttggcctcccaaagtgttgggattacaggtgtgagccaccacgcccagccccttattcattttctattgcttcatatctaatgtaagatctcatgaacaatcagtacctgataaataatgttgctcatgagggtatgtgtgcacatgtgggtgctttgcacacatacctacctgctgtgtgcttacatagaattttactgtttttcttggtacctagtacatctcttaatgactgtaagatctcagtagtatctctattgataataatatttaagaaattctataagatgttcatagaaaatttcaacccaagattagcattaatgaatcagaagagaagcacagtggtcctatctttgatggtggatagaaaagtttttagagaagaagagtgctgctcaaaaccttagcatagcctctcttagctactgtcttactttcctccacactggggagtatacagatggtctccagcttaagataaggcttgactagtgagctttcgactttatgatggtatgaaagtgatatgcattcagtacgcacctcaacttatgatgagattatgttccaacaaccccatcataagttgaaaatatcataagtagaatttgacttatgaaacatttttgacttagatattttcagtttatgatgaatttatccagatgtagccccattgtaagttgaggatatatattttctatttctctttttctgtgaaggtagaaaaagaacatacatgcctatactctaggtctgtgctaaggatttggttttactttctgggtgcaactgatttgcttaatgatatcaggtgagaaataaaagggcaagaattgttgctgaccaaagcttgatgtggtccccagctgtgcttctgcacattgcagtaattctggaagattctgagatcattgtagcacttgagagagccaggctggtttccataccacagcttttgaaggcagaggatgctagtaatccatacgagatttctaaccccctgttgtcctctgtagtagggaactggttgattaggtttgttttggggaatagtcttggtctttttgaggtggaatggaaatagagcctttaaagactgagtccattgctatccaaatctcccttctaaattggtccctaaaatccttagaatattcttggcatgacttttgaaatgagttagaggatttatggactgatcagggaataaacttctccttgtctcctttctctcctttgatttcttccattttgtgtctctctttttccctctctgttgtttttaatactttttgccttctttctttcatttatacccaaggtggattgctattctgtggtggagctccctgatgggttaaatgattttcagtgttgtgctctgggaacttaagcagatatataaccttgatcaaattactcagctgctataagtgccacagtttctttatttcttcatgtaaactggagtgttgtggtggtgattaaataagataaactgcttagaatagtatctgacacatagtaaatattttatatatggttttaatcttcattataattatcattctgattatacttcattcagccccttgagaagatacaaaactacctgagctgtattttttaatttagagacaaaaaaaaaatgttaggtatggaagaatggtcaatcctttttgccagcagtgttccttgtgctttacacaggtacttgtggaatgtatgttgatgtcctgtagtgaaggaactgtaagatgggagctgcttaaatctggtctctatgctgtccataaggatagaaggctgacacgaatgcaaagatggctggaggggagtggcttgtgaaagcatataactggtaaaacagggaactaaaaattgagacagaggaactggatgtgtgacaatcattcaaaggaagtgagttaagaggtagaaaataagagcacctccttttaatgcaataagagcatccctgaaatctgagtttgcagtaatacagatataaataaattagacatctagttccagtcaactaggttgattctagttccatttgcacagggcttggggtgctgcttttgaaaaattaagttttagttatgctatttgtaatgccagatgcctttgattttttggttggttggttggttgttttgttttgtgttttttttgttttttgttttttgtttttggcagttgaattcaattcacagacaacagtgtttgtccaagtagttgttgagttctaagaggctatggagatgctactgtagcatctagtctatagctgactagactagctgactagtcagacagacctctaggccatgagtacttggaaggcaggactgtgtcttactaaactttattcctggtgcctggtgtcagttacacaggaattcaataaacgtttgaagtaattaaaagccttctcttagagattttgtaccatcacattttcttttaatagcatctgttccttagtacttttagattactgtttttatctcttatcatttttcttttacccaaaaagaaacgtaatactattaattatgtaggtttatactagaaacatggaattttagaattgcacttaagagagaactacatcagtgctgtatattctgagactcagagtccacaagtgacatgttagttttgagtagtgcccatgattttactgagaagtaacatccatcttatatgagagtcaaacaacccatgtagcttgatgcccagtctgccttttgattcttttgtctggatttgtcagagagaattggttgctgggtagtgattattgagggccagtgtgctgtgtagcaaagaaacacccaatgggtggtggtgtgaatggattggattatatagcatgggtagtccaggctccagaaatggatttataatcagagttgaaatccagctctaccactctatttgcatgaccttgggcagattacttaacatttcttaagtcgcagttaactttgtaaaagtgagagtttgtgaaggacagtgcagggtagtgggttaagggctggagctctgtggccagactgcctcggttagaatcctggttcttctaatttaccagagcttgttattttcaacattctgttgtcaatctgtaaaatgaggatgatagtaatagtggcctactttgtagagttgttgttaggattaaataaattattacctgtaaagtgcttagcatgatgtctgtacataatgagtgctcagtaattgttagatatttattactttctaaattcaattaaaccttttgttaaggaagctgtcaagaaaaataattggttaaggaaaagaccttttcaaaataagtggagtcaaacttatgtggtaatcactaagaatgggattctagtgaggagtaactattttctacttcagatttttttttttttttgagatggagtcttgctgtgttgcccaagctgttgtgcagtggcgcaatcttggctccctgcaacatctgtctcctggattcaagcgactctcctgcctcagccttgcaagtagctgggattacaggcatttgacatcaggcctggctaatttttgtatttttagtagagatggggtttcaacatgttggcctggctggtcttgaactcctgacctcaggtgatctgcccacctcggcctcccaaagtgctaggattacaggtgtgagccaccacatccggcctactacttcagatttttaaacagtgaacatgctttaattttatgagcatcgctcccctccctccttataccaaaaacgtaaagtacctttgttagtcttgttcactgtaggaacattttttgttttaaacaatatgattttaagagacaatatgaaacaatccttattttgctgttaaggaaagacaaagcagtttcaaaaagggtttcattcagtaacaaaacttattccacatctcagtgttacaagtactgtagttcaagctagacattttatttctataattttagctataatagtgaaactcttaagtaataggaagagataaaagaatactttagtatagtttgtagattccccatttcctaatttcaaaagtacattaaaaaatactgcttacacacatttgtattttgtcctcattctatttccattgatctagataagttactttattttacagtgacatctttggctgggatgaattaaatgtttttctcaagttcaacattaacctgatcataggtgaattaaatcaattaaatgtgttttaattaagagattaaacgatagattgtgataatgggtttaaaagcattttgtaactctgaagtactttgtaaactatggagtactctgcaaatatgaattattgttgcaatgggaaatcacgctgaagcaattaccacatatacttgatggcctccaagtacactgctaggatgattatcccagcaatgacagaatgaataggtttagtgactgcatttagatgcttgaatcacacagtttcctgagctaattacaagcatacagtgagaggcaaaggtataagatggacatgctaagacactcaagatagggttccagtgggatgcaagaaccacactacctgaatcctgggtcacttgttgtagtttgtccagtcttcctgtatgctgcatcaacttttcctgctgacagtgtggtatggttaccaggacctgagttgacggtgagccaaggagacttgacagatgaaaggtgtctagatccaacatttgcttgctgtactggagagatgcaaggcaactggtcacagctgtaattggctgttaaactgtggagttgcttatctgcatgcctctggcagatgacataagaggctaggatagcgttaaccaatgggtgtttgattcagggatgacgtagctatcagtctggatgcgtgacttaatccatgctttgtgaatacttaaggtttacttgatccttccatcttttcttatctatatataacactcttgctttcttcctttttgtctatcttcaaaccatcctttgtatctatatgcaaaacaaatgtgttctttttttttgtatttatgtcctacatgttgtgaacacttcccttaatttctagtacatcattttcacttgtgtttcaaaagttacttgtttactatctatacttgtttactatctatgaaactcaggtttcatccatttcccttgtttctcttgctctctgtatagcaaattgaacattattaaatgatacagcaaactcatctcacaattattatcattactgttatcttctaaaagcacaaagaacttttgttttgttttggtaaaggactaataaatattgtagctttggaatctatatctgtgtggaagggggaaaattgttaaagagtttgaatacctccagctttttccgtgtatgtatttcattgaatttggtcttttcagtgttcaaccctggataaaaatgttcagcttatacaaaattgacatgccttaaaaatatgatatgatgctgcttctttccaaaaagaaagtcatttttcatagctagagccagaaatgctgtaaatttcttccagtaaatcagacctttataatacagagaaattaaaatggaacactcctcctggaagatgatctgtctggaaaattccttgctaggaaattgtctatgggaaaaactcagaaaacagtaggctgaattagtgttgctgctcgataatatttgaaataataatccaatttaagcagttgtatatgttgtaaattatatatattccttctattttagtggatgtacatttacaaattcagttttattttgataagctgtgatagtaatcagaattgtcaaaataataattatacataattaaataagtctttgtttttaatgttatatataaattggtcttaacttgaatatttaaaattttatttttagtataactttgaaaatgcatctcagacatttgatgacctccctgcaagatttggttatagacttccagctgaaggtttaaaggtaagacagttggtaatacattgtaaagacacaaggtatttaataaggtgatttttattgtttattatttaaagaatgaaatcatttcttactatttattattataaagcctatatatagtcatttgtaaagggtcagattattcaaaagatatcagaaagaaagtgaaaatcacctaggattgtattattctgaactagctgtgtttaacattttggtatatcacatttcagacctgtttttttaggatatgtgctatgcgtgtgtttgtagatgtatgtatgtgtgtgtacatatatatatgtacacacacatttacatatatatgtaaatgctttcatatacagtaaatctgtatttaacactaatagaaacatgctatttggttacctgcctttttcttttaattgtatgttttgatcatgttttttcatgctgataggtaaggatttacattattaattgtaacagctgcatggttttgcaatatcatgaaatagtatggattttgaacattgctttagtttttcatagtggatatttaggttgtctagtttttactattacagtgctacaatgaatgtttttgtctttgtgtattcatccatttatctccataggatacatttccaaatgtagaattgctttgtggcatgaatgtttaaagttttgttctgtattttcagttcttcctccaaaaagtttggaacgatttagaattctatcaataacatctgagactgtccttttccctataccctcttaaatactagatattatcaaacttttgctaatttgattttaaaaaatctaatgaacttaaacatattttttgctgtgtgtgtgagagagagagagggagagagagagagagagagagagagagagagagagagagagagagaatggactattaatgctctttgcccaatttgaaatgaaagtgtccttgtgctttgtaagagttctttatatattggaagtatcaatttattgtttgccatatatgcttcagattatcccttcttcagtttttcgtttatcttttaattttttttaagatttcaaaagttttgtttaagtagttaaaaattcttctttttcctctacctctgggggttagaaagtcctttctcattccaagataatattagttttttgttatatgaattcatgaagttgtgtggatatgtaccatagaatgttttcagtttattctaattttcttaaaatttctcttttttttttttttttttttaaggtagggtttcactctgttgcccagactggagcacagtggcacaatcttggctcactgcaacgtccgccttctgggctcaagtgatcctcccacctcaacctcccgagtggctgagactaagtgggcaccaccatgcccggctagtttttgtatttttatgtagagatggggtttcgccatgttgcccaggctggtcttgaactcctgggctcaagtgatccgcccaccttagcctcccaaagtactggtatttcaggcatgagccaccgtgcctagccagaatttcttagtaagataccacaaacctattattcttaattaggatggcagacacctctgggaggggcattgaatttttaattattaaaaaaaaattcatagcattgtatgactatttctcataaaaatatttcaaccgaaaagtaatatacataagaaaaaggaaacaccttcttttattcttttcttacctatatgtagcagtcacacttccctcttcagagttaaatattatcagtgattttacaggccttcagatccttttctgaacatgtaatgctttttcattcttttttgttcataaacttatgaacatgtataattcataaatggttatcatttgtatatatgaaaagtttcttaattcttacaatggaatccgctctagctagttttacccagaaagggatttataaagggataaagatgttcagagtatcatagcctggacaggcagtttctaaactgttacaggaataaaacccagaaccaccttgcaggactggctttatagatgagtggtgcagccaatggaccctcacaccacattattttttctctcatcaggaagcctttgtggttttacctcacaacatttggcctcttctgccatccaagctaatcgaagagataccctttttcagactgtttccttacatgtctacttccaaatccaacacttggatttttctgagtgatagacttttggccacatagttacttgctacatattttggtgaaatacctagctatgaggaaggctgggaaatacaatgtagggtttttgttgttgttatttttgttgttttagcctactttgggaaggtggaatgcgtagtgggttcagaaaatttggagcaccgtgagtgacagatgtctactgcaataattaccctgcaaggctgggctgggtgcagtggctcacatctgcagtcccagcactttgggaggccaaggtgggtagatcacttcaggtcaagagaccagcctgagcaacatggtgaaaccctgtctctaccaaaaaatataaaaagtagctgggcatggtggcgcaagcctgtggtctcagctacttgggaagctgaggtgggagaatcgcttgaacccaggaaggtgaggttgcagtgagccgcgatcaagccattgcactccagcctgggcgacagagtgagaccttgtctcaaaaataaaaataaataaataactactctgcagtttgattcccctacttcttctgttttagaactctttccacagcagcatctataaatctagtatgttcctgttaagcactgcatggtattctgtaatatgaatgatcatagtttattagtaatttcctctttaaaaatacatatatatgtatttttacatttatgcattaaaaaatatatatgtatctttacatttatatattaaaaatacatatatacgtatatatgtgtatatatatacgtgtatatatgtgtgcatatatatgtgtgtgtatatatatatgtattttttttcccccaaagttgttatttctctaggatagaggtctggaagtagaattgatgaaaccaatgggtatgtacatctaaaagtttcatagatactgccaaattacctttgcaaaggctgtgctaatttattcccattaacactgtaggagaatacttatctccctatactcttgccaacactggatattatcggtctttctaactcttgccaatctgatgggcaaaagtattatcttgttttaatttgcatttctctgattactaatgatgatctggcaacctttctttcattctatcataaggagtcagactattccttctcactgaagagcttttctactgaataagcttattttaaagagctccattaattctcgataagcataatcttattggtgctcctcaattactgtgctactataaatttggtttacatttaaaagatatgttgatgagtttgtttattcactgcctgaccaaaaaaaaaaaaacggtgttagatatctgtctgctttttgcacttgacaatatagggcaagaagagaagtgaaatattctaacaaaattattggattattatgggtagcttttatagttgcgtgactggttttgccattgcccagaatcagaatttaaaatgccagccatgcaaagatttacatttgtttacaaggacttgataataatgaagtgaggtagctcactatagtattatgtctgtaaaaccaattaaataaatacgttaaaaatataactaatttaaagatataatatggttattatgagacttagctgaaaaatactttttttttttttttttgagacagagtctcgccctattgcccagcctggagtgcagtggcatgatcatagctcactgaaaccaccaactgctgggttcaagccatcctcccacctcaggctcctgtgtagctagtactatgggagtgtgctactgtgcccggctaatttttaaatttttttaggaatggaatcttgctatgtttcccaggctggttgcgaacccctggcttcaagcaatcctcctgcttcggcctcctaaagtgatgggattgtaggcatgagctactgcacctggccaaaatatcttactttttttattgagacggagtctcactctgtcgcccaggctggagtgcagtggtgtgatcccggctcactgcaagctccggccttctgggttcacgccattctcctgcctcagcctcctgagtagctgggactacaggcgcccgccactacgcacggctaatttttttgtatttttagtagagatggggtttcaccgtgttagctagaatggtctcaatcttctgacttcatgatccacccaccttggcctcccaaagtgctgggatacaggcgtgagccaccatgcccggcccaaaatatcttacttttaaactctgcccagaaagtttaggtgagatagtttttgtaggtctaatttatgttctatattttgtagcttttataacatccctggattccatcagaatcatttataagacttcagatatttatagtataatatatcagttgaaattctgtttacattctatttatatatgccccaatattaggttaattgtatttaaagcctttttctgtcctctcctgtatcttaaaaaatactattattcaagtataagaaaatgagaaagccaaggaattttgacctatttgaactttaatgcaaaaatgtaaatcttttcatggattaaaatatggcacatcagtgttacagaagttttaaaagaaagattttatttttgtatctaggtaagtcctgtgtttgtagttttatattttaattggctgtttaggaagttaccttttccagacaacctttttagaccttgtaacctttgagtaccattagtaattagtttacagttcttttgaacagtatatttatatgttttggcaaaattcagaactatacaactgttctttttggaaaacatgttttgtctttgaaaagataaataatgttacttagcagtataaatatactttcctacgtcctcaaaaaattggtaaagattacctttccccatccccttcccccactctatgcttaggaggccaagaattattattgtataatgtaacgtatgactctatttttacctttttcaaatggataaccaagtattaaagaatcattattgagtagttactatggtttggatatggtttttttgtccccaccaaatcacatgttgaaatttgatccccattgtgggggtgttggaaggtggggcccagtgggaggtgtttgggtcatgggggcagatccctcatgaattgcttgatgccattctctctctggctagatggaattagttccaacggaataggttagttccctcaagagtgggttgttataaagccaggacaccgcttaggtttggtccctcttcacatatgcccacttctcctttggccttctccatcatgttttgatgcagccctcaccagaagctgagcaggtgccagtgccatgcttcttaaacagcctgcacaaccatgagctaaataaaactccttcctttataaataacctgcctcaggtgtgctgttatagaaacacaaaatagaccaagacagtagtcaagactttacatgtggatttgtaatggtagcaagcaaggtctcttgctatactttttattatcagtataattggaataatttagttacacattgagggccagtctcaggagaacaagcttctccagatttcttgtttctatatttttaggaagtgccttgataggtggaggagataatgattgttaaaaaattgaaaacaagatttatctctgataaggaagctttgatcagtaagccaagtgtcagattacctgagtataattatcaatggcaaatctcattttcagcaacacagcttttgggctagatttgccatgatccatatatactgtgttttgtaacctggtagtcagggtatattctttatgttgaagaggaagaagatagaagagatgaagatcatgggatgcggatttgtcctagactatgctgttcctactatccagaacaaagttgcaaataagcagtttttcttatatgatgtataatttatttcccctcatcattattcattaaattagtgccttatatcatcaccagttaattttccacaaactaggcttgttctttgaaagttaatttaccagttaatttcaaaattcttattacaggaaatgattttgtttaatataaagtcttgagattagaagagagtttttttccctggtgaaggaaaatgcaaacattgcaaagaaatgtggttgtttggatgttttatttgtgttacgtcctttgcctgctttctttgcaggaaagaagctcagtgccacttagtgtatttttcctctcagaacacttacacagttttgtgatgtgaagaaagccctggttaaggctcaatgtgctggacttcctcacccttatgttacagtatcaccctcagtttataaacgaaaacaaaggtcagagttcctttttcaaaggataaataaagaaatagcattgtcaaaataaagagtcaaaccatctggttatacatgaaataagaattctaagatctaaggacattttcacatgcacatagttagatggtataaaaagaatacttttgaagtgaattttgagcttctaaaataaaccctttcctcttaatttcaaaaagtaatggttgcttattcatttattaaatgaagcaggaatatagcatttcatttgatttagaaaataattgtttcatcatggcaaattatcacttagagaagaggggagataaagacacacacacacagaggaagtcaaaggaggctcaggtttttgatttcataaatcaacacactcccttcattttctcattgcattactgggcatcttttttgttcacttagtagtttttactagattttcttagtggctttctcagttcaatatagctaattttttattcttctgctcatgaaaaaatatttttctcattagaagagtgatacatgctcaccattaaaattaagatgatatagatatgaaaaagaatatggctcatggagtagaactggtataattaaaatgaccatactgcctaaagcagtctacagattcaatgaaatttctttcaaaatgtcaatgtcatttttcacagaaatagaaaaaactatcttaaaatttatatggaaccagaaaagacctcaaataaccaaagaaatcctgaacaaaaagaacaaagctggagacatcacactacctgacatcaaaatatattacaaggcaaccaggtgtggtggctcacacctgtaatcccagcacttggggagcccgaggcaggtggagcatttgaggtcaggagttcaagaccagcctgaccaacatggtgaaaccccatctctactaaaaatacaaaattagccgggcatggtggtgggcacctgtagtcccagctactcaggaggctgaggagaatcattgaacggagatgcaggttgcagtgagctgagatcatgccactgcaccccagcctgggcaacagagagagactccatctaaaaaaaaaaaaaaatatatatatatatatatatatatatatataacgtgtatatataatgtatttatacataatgtatacacacatatatacatattatgcacacacatacatataacaaggctgtaagaaccaaaacagtatggtactgatataaaaacaggcacatagaccaatgctacagagtagaggatccagaagtaaattcacatatttatggccaaatgattattgacaaaggtgccaagaacatacactggggaaagggcagtctcttcaataaagaatgctgggaaaattggatatccatatgcagaagaatgaaactgaaccctcatctctgaccatatacaaaaatcaactcaagatggattaaagaattaaagcccccaaactataaaactattggaagaaaacatatggaaaacacttcagggcattgaactaggcaaagattttacagctaaaatcacaaaagcacagacaacaaaaagaaaaatagacaaatgatgctatattgaactaaaaagcttttgcacagcaaaggagtcaacagagtgaagagacaacctgttgaatgggagaagatatttgcaaactctccatgtgacaggggactaatatccagaatatataaggaatttgaacatctcagcagcaaaaagacagtctgatttaaaaaagggcaaatgatctaaacagatatttttcaaaagaagacatacaaatggccaacgggcatatgaaaaaaatgtttaacatcactaatcatcagggaaatgtaaatcaaaaccacagcgagatagcatcttaatccagttaggctgactatcattaaaatgacaaaaaaaaagacagattttggcaaggattcagagaagagggaactcatacactgttggtgggaatgtaaattagtacaactactgtggaaaacggtatggagatttaaaaaaaaaaacttaaaagggggtgggggagaactaaatatagcactaccataggacccagcagtcccaccactgggtatttatccaaaggaaaagaagtgtatcaaagggatacctgcacttgcatgtttattatgtcactattcacaatagccaagatgtggaatcaacctactgtccatgaatagatgaatggattaaaaaaagtatatatatggaatgtaatactatttggctgtaaaaaagaatgaaaccatgtcatttgtcacaacatgaatggaattagagattattatgtcaagtggaattatacaggcagagaaagaacaaatatcccatgttctcactcatttgtaggagctaaaaaagttgatcttatggaggttgagagtagattgatagataccagagggtgagaaaaagatgtggttgagagggggagatgaagaaaggttggtcagtgggtacaaacatgcagttagatagaaggtataagttctaatgtttgataacagagtagggtgactatagttagcaataatgtattaagtatattttgaagttgctggaagacagaacttgaaatgttctcaacacatagaaatgataaatactcaaggtaataggttcctcaagtatcctgacttgatcattacacattttatgcatgtaacaaattatcacacgcaccccataaatatacaaaatattaaatgccaataaagttttaaaagaatatgaaaatcatacataattctacaattaaagattataatggtagatgtttgggtacaactgtgtgaacttatgtagacacattcatgccttcattttatgcacttatatgtgttattttgcaacttaaaaaaattggcaatatgttggatggcatatccaatatcatggatatcttcccatataaaaatctatacattcatatcatcattcaaaattatacaatttattatagtacttaaattacaccataatgtaaccaatcccttgtgtcattggacatttagattgctttcactttttaaaaatggaaatatttcaagcatagactagagtatgagaataacagagcatcctgtatatctgctacctagaggttaatattttactatttttttgaaagaagaaataaaatattacagatactactgaaacatcctttttatcctaccatattctgttcccttacctcgctccttatagatgatcattatcctgaaacttatgtgtatctttcctatttatgttataaaacatacatatatatattttttctaccatatatgcatctataaacattgtgcttccatttaaattttctttgctgtggttttaaaacttgcttttccatctaacactatatttgaaatttttgttattacatattcctaattcattttaactgttgcatactgcattttatgaatatgccacaatttattttttcattcatttgctggtagatgccagttttttactttcttttttagtgaacatcttttaaatatgtctccttgtatatattataactagatgccaattcacactcatcaaattagtaaaagtaggagtctaacaatatccacaactggcaaggatgtgaaaccaggtacttttatatactgctggtataaaagaatgtccagccactttgatgagtttagtaatatctcccttcttctgtaagtgataagtaataaaataattcattatattttacatttgatatattccctgtttcatgaaataaatgaatgagtaatcgtcacctttgaaattaacagaataactaatggcaatgacagtacccttattaaggtattgtaattgttctccctacttttgtttgcctgcactatcccttcttgccagttgccattctctttgaattctgaatactgaaataattcctctagttaggatctgaccatttccatcattatgatccctttaatcagattgataagcaaattgtatcaactttaattaaccaggttgtgttcaactataaactgagttataatgacaaattgcaaatggcaagtgctgtggtaagtaatgaatgagtgagggtcttttttgttgtggttgtgtttgttatgttttggaaaacagtatgttttatgtttcattaccaaagaattcctcttagtcttgattcttttttttattttttaagatggagactcgctctgtcatgcaggctggagtgcaatggtgcaatctcagctcactgcaagctatgcctcctgggttcaagcaattgtcatgcctcagcttcctgtgtagctgggattacaggcgtgtaccaccacgcctggctaatttttgtatttttagtagagacagggtttcaccatattggctaggctggtcttgaactcctgacctcaggtgatctgcctgccttggcctcccaaagtactgggattacaggtgtgagccaccacacccgggctacatttgttcataatactaaaggagaatttttctgatgcctgttaagttttcatggatttactttttgtatttgtttctgaactcttgctgtcaaagattttgttaagaattctgtagttattacatttaacctctttatgtttttacaggatttgtcaaatactatagaatatgaattatgcataaatattctttactgggttgtactgattatatggcaattgtagaggacatggattgctagtgtaagcacaatccacttagaattcttgtttttagagaaattattttgttgcatgtagctggaatggcaatgtttgattggaattttttttttttttttttttttttttttttttagaatgatgatgtggttgtagtattagtatgaatgtaactaccatagtttggatatttgatccttatgttgaaatctgatccctagtgttggaggtaaggcacaatgggaggatgtttgggtcagggaagtggatccctcatgaatggcttggtgacttctgctgtaatgaatgaattctcactcttagttcctgtacgagctagttgttcaagagtctggcccctctcttctcctctttcatcatgtgatctcttctcacacaggctccccttcaccttccactatgcatgagtggaagcaggccatcagaaacagatgctggtgccatgccttttgtgtgtgtgtgtatgtgtgctttcttgtatagcctgcagaactatgagccaaataaacctctttacaaattacccagcctcaggtattcctttatagcagtataaacgcaccaagacagtaacgtatcaattaaaaggcattgtcctccagagcgcacattcattttgttttctaaaatgtcaaggtatcatatccattgagtgaacacacattatctgtgtgtaccaaatgagaggcacacaccagatgaccttttcttcacagagctggaatatcataaaatcaaaatcctgacaaatcagtactgtgttaagtaaaacaaaactgaaggttatagtcattaaatgtttgccaattatgctattgttattgagaactaaatttgataaagacaaaaagaatgtcaactggatcttttatgatttccctttgcttaaatctctccatatcagctcaaataaaaaagaaattattgatcatatttcctagctttattctggacactatgatttgttgccatccctccctccttttttcttttaatgtcgaggtcactagcaaactatttatgtctgcagattaatttgaagtagtaaactttgggagaagatatttattaatttatatgtaaatgaaattttatttgcaatcaggttattctgatgatataaagaaaggtatagtggatgtttaataagatatattgtatttagatgggacaaccaaaattccaaaaccaagagaagaaaaattaggcatttggagtatatttctccttaaccagtgtgatctaagaaataaaaaaaaataaaaacaagcatctccataaaagtgtcttttctggctgtctgcagaagtggtacttatcaatggttacagtagactggagcctgtgcaaaggggctaaccctttcaacacattcatgaaacttctttctagatgttttggtgatatatatatatatatatatatgtataaaacagacattatatttgttgtaataatcatcaccattaatagtaaaagcaggaatatttaagatataacctcaaaagctgtcttgttcattgaccagccctataccctcctgtttcgtttttttgagagagagagtctcactctgtttcccaagatgaagtgcagtggtgtgatcatggctcactgcagccttccactcctggcctcaagcaatcctcctactttagcctcccaagtagttgggactacaggcatgcaccaccacagccagctaatttttgtattttttgtatttttgtaattttgtatttttctgtaaacaaaaaaattggaatagatgagctttctctctgtctactaattttgggttgcatttggtgttgtttttctagttccttgaggttcattgttaggtggtttatttgaaatctttatgcttttttgatataagcgtttgttacaggaaaggggtcccgatctagaccccaagagagagttcttggatctcgtgcaagaaagaattcagggtgagtctatagagtaaagtgaaagcaagtttattaggaaaataagggaataaaaaaatggctaccccgtagacagagcagcccagagggctcctggttggccatttttatgattatttcttgatgatatgctaaacaaggggtgggattatttctgccttccctttttagaccatatagggtaatttcctgatgtcatgacatctataaactgtcatggcactggtagtgttataggaaagggatcctgatccagaccccaagagagggtcgttggatctcacacaagaaagaattcaggacaagtctgcagtgcaaagtgaaagcaagtttattaagaaagtaaaggaataaaagaatgactactccatagacagaacagcctggagggctgctggttgcccatttttatgattatttcttgatgatatgctaaacaaggggtagattatttatgcctcccctttttagaccatatgggtaacttcctgaagttgccgtggcatttgtaaagtgtcatggcgctggtgggagtgtagcagtgaggaagaccagaggtcactcacgtcaccatcttggttttggtggattttagctgacttctttattgtaacctattttatcagcaaggtctttatgacctgtgtctagtgctgacctcttatctcattctgtgacttagaatgctttaaccatctgggagtgcagcctagtaggtctcagtctcattttacccagctcctattcaagatggagttgatctggttcagacacctctgacatgtttattactataaacttccctcttaatactgcttttgctgtatcccatatattttagtatgtagtagtttcattttcatttgtttcaggaaattttaaatttcttttcttaatttctttattcacccattggttattcaggaacattttgtttacttgccatgtatttgtgaagtttccaaggttcttcttgttattgtagtctattgtggccagaaaagatagtggtatgattgctactttttgaatttttcagacttgttttgtggcctaagatatggtatattctgaaaatgttccatgtgctgataaaaataatgtcttttctataactgttgggtgagatgttctgtaaatgtcaggacttttcggttattgattctttgttgattttctgtctggatgatctgtacatttctgaaagtggtatgctaaagttccctactattattgtattgtagtctctctctccctttggatctgtttatgtttgctgcatatgcttggctgccccatattgggtgcataaatagttataattgttatatcgtcttgcagaattgacccctttatcatatatagtgaccttccttgtctcttttttttttctttttttgagacagagtcttgctctgtcacccaggctggagtgcagtggccctatctcggctcactgcaagctccgcctcccgggttcacaccattctcctgcctcagcctccctagtagctgggactacaggcgcccaccaccacgcccggctaatttttttgtatttttagtagagatggggtttcacgtgttagccaggatggtgttgatctcttgaccttgtgatccacctgcctcggcctcccaaagtgctgggattataggcatgagcgaccgcacccggcctcttgtctctttttacactgtttgatgatttgtagtctgttttatctgatgtaagtatagctactactggaatttcatttttcactcttcacttttggactatgtgtatctttataggtgaagtggtttttttgtaagcagcattgtattgggtcttgtttctttatccatccagccattctgtgccttttaattggagaatggattccatttacatttagtgttattgatgagttaggacttttactgccattttgttgattgttttttgtattgtaatttttctcttcctttcttactgtcttcctttgtggttattttctctgatagtactttttaattcgttgctttttatttttagtgaatctgttacaggtttttgcattgtcattactatgaggcttacaaagccatcttataacaagtaatttaaagggtgacattttaagtgacatagaaaagaatagaaacaaaggaaaatgaaaaaaaatcttctacactttaactgtgtccctcatattttggcttttagttgtctcagttcacatatttttatattacctatctcttactatgttgctgtagctataattttttttgtttttctttttttaaacaattgttttaaatagatttgtcttctggacatagctagagttatgggtggattgcacaccacaattatggtgtgagtattctgggtttgtctatgtacttaattgtaccagtgcgttttagaccttcaactatttttttttaattttagcacattagtctttattctttcagattaaataatttttcttagcatttcttgtaagacaggcctggtggtggtaaactctctcaacttttgtttatctgggaaaaactttgtttcttattatttgaaggataactttactggatttggtattcttggatgataggtttcctttcttcctccctgcctccctcccttccctttttcctttctgctcctctttattccgatcctctccactcctctcctcccctcccctttcctcccaacccttctccttccctctcctttccctttctgttctttcctttctttctctctctctctttctcttgttattccactccctcctggcttgtattgtttttcaatgaaaagtctgttgccagatgaattggaactcctttgtatatcattttcttcttttttcttgctgcatttaggatcctctctttgtccttgacctttgagagtttgattagtgtatgtcttggggtagtcttatttgggtcaaatctgtttgttctctgaccttcctgtagctggttatttacatctttctcaagttttggaaagttttttattatttttttgaataagctttctataccttacttttgctcagctccctcttgaacacaataattcttagagttagtcttttgaggtaattttctttatcttgtaggagatctttattgcttttcactcttttcttttttctcttctgtgtacttaaaaaataggctgtctttgacttggctgattctttcttctccttgatccattctgatgttgagagcctttaatgaatttttcaggtcagcagatgtatttctcagttccaaaatttgtttgatttaaacaaaattatttcaattttctggttaaaattttctgataaatttctgaatttcttttctgtgttatcttggagatcactgagtttccttaaaactactattttgaattcttggttaaaaagttcacatattaggccgggcgcggtggctcacgcctgtaatcccagcactttgggaggctgaggcgggcggatcacaaggtcaggagatcgagaccatcccggctaaaacggtgaaaccccgtctctactaaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgcctcagaaaaaaaaaaaagttcacatattgccatcttgttagggttgcttgttggtttcttgcttcgtccatttggggatcatggttccctgcttgctcttgtttcttgtggatgtatgtcagtgtctttgcattgaaagattagttatttattctgttcttctctgtctggcttgttttggtttctattggatgtatttggttagaggttatttactgctaggttactgcctcctttttggctataggtgatgccttaagcttaggttcaccttggctctagtaaattatcaaaatgctgcccttcccaaaggggcagttcccaacagggatatcttggcactgtgggaaggctgactgtggaggttcatgcccagtggacctgtgggacaaacctactgtatggtgctactgaatagctactgtgatttggcatctcctttggtagaattacaaaggagggctctcctttccagggctagggattgtagtcctgcttcccctcttagtctctatctacctcatggatatttctcccttcaggtacttgtgatgctttctgtgggttaaggaagggacaaatctcctcctagggaacccaagatagtgggcaatctggttccactttggtcttacttttccagtgtagaaacagtgagttggagggaaattttccttgcagttggtgctcggcaaaatggggggaggggcatagtagatgtggaagtctgattctctgtctgctgggagttttttttacttctctgtggccctgggaatgatctctccttatatttgagttctagcttatttctggccgtaatctcattgctgtacatttgtttttctttttctatggggggagtcaaaccagcttgcttctgcatcatcattttggagctggaagccaacctatatggcttgagtttaattgctgtaataatcatgttgaaaaatatttcctacactatatgatttagcattggagcaaaaacttagtgtttgcagaaaggcactcagagcaggatgcaaatttaacaagaataaagcaaatattcatcattggaaggatgaccacagttgtacttcgttgcaaaacaaaaaccgagtgctttatgggattaagaagaggagctattatatgagcaaatgaaagagtgatacattttatacccaagatatgtacaaacactttccatatcacaagctgagcaatataatttcagggaggagaaattgccaaatcctgtggaatagatgattggtgtgaccagttcaggaccatacagaactgttgttaaggcattgtctcatagctttaattgcctccttcctttataaatgaaatcagtgaatttgatcatctttttatgtgtttattcactttttacaaaagatagacatttgatttttctgttttagtctgttaccagattttttttttttttttttttttccgagacggagtttcgctctatcgcccaggctggagtgcagtggcagaatcttgactcactgcaacttccacctcctgggttcaagccattctcctgcctcagcctcccaagtagctgggactacaggtgtgtgccaccatgctcggctaatttttgtatttttagtagagatggggttttgccatgttggccaggctggtcttgaactcctgacttcaggtgatccatctgcctcggcctcccaaagtgctgggattgcaaatgtgagtcactgtgaccagcctgttactacattttcttatgtcaaaccatcctgcattcctgggaaagcaacttgctgtttactttttaaattcatggttatctcgtggacgtcttttcagtttagtgtatacaggtcttccttatttttttaaatggctgcattattttcctattgtataaatatactataattgtttaaatagttaccttgtggatatgcatgatttccagtttttgctattaaaaataatgtaccaatgactgtctttccacatacaccttacatactcaggctagcatttctgcagaataaatttctagaaatttatttattatgtgcatttcattgtctgctaacatgaaagaaagttaatttttaagacatatttgcttggtttgaaaatgtcaaatattgttcgaaaatataccagtggttgtctttggggtgattggcttatgcctgagtttgcttattattattatttttttaacttcaatacaaaagatagaacttattttagaaaactaaatgcttgtgaaagcaaatgctgctttagaagttccgtgattgtgagcaattttacatgcccaatgatacatctagcataatgcaaaacacatgacaaatcgaaaagatatttgtagaagtaagttgattgatttactgagtgaaacagagagataatttttaccaattctttttcagggttttttgattaactcaaaaccagagaatgcctgtgaacccatagtgcctccaccagtaaaagacaattcatctggcactttcatcgtgttaattagaagacttgattgtaattttgatataaaggtatgattatcttttttcattttttgtttcctatttgttcagttagctaatttaaatcatttacatcctcccttgtttcagaaaacatttaaaatttaaaatccagtaagattgaaaataaactggattcatagaatagaaataatgtttactggttctaagaattttcaggcatttgttggacatcttgaactgtggtttaacagtggaatgttacttgatctcatctaggaatgaaaacttaacttcagcctttagttttatgcttttacccttccagtatcaatctcaaacctacatctatacctgtgtctacattgtcattgaggtttctcttttgtaataagttaaatctgcccctgtgtaaagttttttctctctgacatgggttaagctagcatttcagatagtaaaacaaggtttacccacctccgtcaccatatatcaccagtgctgctctaggtgtatggttttttaaagtctgttttgggattggcattggcaaaggagccacattgaggcctatgtaaaataaaccttgatgtaactgttactggactacctcagagctgagtgtcatatagtgtcttgcatgtatctcccagaataggacatgggctattatttcatgtcacttggtcttagataatttgtccgttcagcaagaaaaaccgccctgtcatgctgtgcatgaattttctctgcaattttgattgcatggaagaaatgatacctccatagtaaacttatgagaggaataaaataatataaagggatttgaaaatgtatagtactgtataaatgatagttattgttactactttatgttagttccaaatatagactctcaattgcctttaaatgggaataaattagagcttgaagtcaaagtagtagacttcctgctcctcagagttgtttatgatagtttaaatttaactgttttatccagaactaaactataataattacaggttgcttcagttaaaattaaatgttattgtaatgtttcattaatttcttgctgctaagaaattaaaagtaaactaattctattgatcccaaggtttactacactattatgctatgtaatttctggactcggtacagtctgataattagaaactagaatacttttttgctgttgttataactttcctttataggcagggatggcagatggtacactttgaaaattagggaaatactgttattgaatatctgtttttgaagatgaaaccacagctcaggaatgaatacagtaggcttgttagccttcttgtccctttagtggatcctcatcatgagtctgagtacttctaaaggagtttaatgatttagtcattactccagctcatctcttttcactgcttgccttgaattttatgttgcagccatactgcctacctgaactctctcaactggctgtgccatgctgatcatacatttgtgcctttacatgtactattttctctgtccaagatctctgtctccagtgatctttaccacccatttatctgtctcatcggttacatgctagctgaggatgttacctcctcagggagccttacttttctttctacttcctctgttgcagtgcagaccattccagctcaatgtgccacccttccactttgtaaatacttccttcattgctttttatcacattgttgttactttttattgaatatatatatctcacttatttgtgaattgatggtgtttagaattcatgttttagtcatatttatgtatccaatttgtattatagtgtgtggtaatcaataaagacttattaaatgaagctgtgtaatagtcttttgcttatgtgtctaatatattcttgaaaaacatgtacatatgaaaaacatggaagaagttttcagttgagccattctaatgttagacagggaaatgttaaaaaaattctcattgtactttaccatgtaggcacagtttttatgaataagggtctagtctgttgtacatgttctttaacttggttattttttcctccataaatacacagtggagtgtattctggccatttaaggctaaagattccttacttatgtcattcctaatgatttctgtctttgtcagagttgtataaatttctggaacatcagtttataggggagacacaatgattataatcaaggtctggaaacagactgtatacatttcaatctcatctttattatttactagcagtatgatcttggacaagttattttacctctgtgtgcctcaatttccttatctgtaaaataagaattataatgttccctatatgataggattgttgggaggatcaaatgaactaatcaatgttaaatgcctaccaaacagcaccttgcacacaggaaggaggcaagtgggtcttagctgttgatgttttatgctttttaccattagaattaaatagaataagggtaaagatggcaaaattcctgacttttcagaaattaaattgtctggtaagtcacatgtgatatagcaactcagtgtcagctgatgtaaaatttctgacttggcttataaagacagtttagtcatgccattgtggaaagtatgtttcataaatttgtaatagtaagaattatggatcacctatcaaggtagtgtgactgggtaaggataaagtcattatgggtactgggaaaacaactggaatcgcaccctaaagaagatttcctttctagagtggttactgatggataagctgttagccttattagctgtaattttcatatcagaaatctctgactgcatttaatgagcttccaaaatggttatatacagttttatattaagtgtgttgtggaattcagtcatcagtgttaatatatatctcttatagataatcagtagtggttcattcatgtatatccacaattttgtatgatgcattgacttaagatagttagaaaaatgatatatttccttatttattacatagcttactaggactgagtactgaggaaaacttaattcaactccatacataatactacaattgatggtagtgcagggttatattttggcatgcctcttatccaaagtgacatacaaattatctcagacaaaggagaattggctctatcttttaaaattttccttggagaaaggaactctttgttgtagaccacaaagagaaaagaaacaaggaataaaaatttatcgagttattccagatgattaatgttggtgagtatttcaggatttttacaactcttttagttttgttttaaacagattaaagaaacctacacttttcttacttctttaaaaggaaatgaataagtggaatgtatgttataatttttaaaatggcatattttcttcatacaaaccatcccaagtgatttgtgactcaaagatagccacgaaggcagcagaaatgcaattaacaattcctggaggaaagggaattgctttccaaataaagagagccattgtttaattttttatcttctgttgagagaagcacatatgaaccttttaatctgtcttaccttgaggagatgcagcaaaacccatgctcagaatgaatgtttgaatatgtagaatatccaaaaagccagtaagaagaactattgattacatgtcaggtacttattctaaaagtaatcacttacactgttttacaaaaactgtatcctctgaaaaatacagctctttagaggaaaagcgaaacagtgctattttgtctttgtatgatgctgttctttactgtgacaaaaattgactttgaagcattttgagggagatatttctcaaaaggcttgaattggcatcccagtgagaaatacgactttaaaaaaaatctgtaaaaatacctagtaattgaaaggccattaaaataatcacttaacattgaactttcagagctatacaattttctgtgtatataactgaataaagacaagttataaaaaaatctgtccattgtcatttcagtaccagatgctttcattacttgggtataatggtaagtcaccaatttctttgagtagccaatttactgtattttagctggactttagcaaaggctggtaaacagaaatggtgcaacatatgcactttattcagcagtgtgtgctgaatcttattctatcttatgtgtgaatgagtatttttgaaaaatgcagctgcaaagccatctaggccagttaccaagactgaaaggacttagatattattctcccttcccacacccccttttttgtgggcatgaatggaggtacatttggattgtagatgataaggaatatgttgggtctcttcagagctattttctgctgtaatgtggcttttataaaacttaactgggatacagatacaaaacttaactgggatactttacctgacttctgcctctctctcaagtctcatctctactttgccactcctcccacctcgtaagaatttacaagtccccatatgtgctgagcagtctctcccactctgtcttagtttctgtcatgtcctccatctggcatgtcctccttctacttgtctgtctggccaatctgactttattttaaatctgagataaactgtgtcctgtctgaaaccttccctgattttcttcaaggtagaagtcatcatatcttttttttttttttttttttttttgagatggagttttgctcttgttgcccaggctggagtgcagtagcacggtcttggctcactgcaacctctgcctcccgggttcaagcaattctcttgcctcagcctcctgagtagctgggattacaggtgcgtgccaccacgccccactaattttttgtgtttttagtagagatggtatttcatcatgttggccaggctagtcttgaactcctggcctcaggtgatccacccgcctcggcctctcaaagtgcagggattacaggcgtgagccaccacacccggcccgtatcttttatatactatttaatcccacatcagtctctgtttctctctgtgagagaaaaatatcatgttttagattctgtagtgctagtgcctaatgcattatatggcattggtagatgaataataaatatttgcaaagtgatttactttaaaaaccttaagggcttataataaaatgtgaatagattagagcctaaacagtatcactggaactttccatttgcttcatgttcatttcacttaatgcttttggcattatttctaagcctagatatttatttatcccacagatatttttctctagttctcaatgtttatagaatttttttaaattaccataaacatttttgggattatttgatcatatcataataactctttttctttctgtcttttttttttttttttttttggtgatttttttgttatctcagaaagtagccctctagttttcctttctagacttacctttcattacattatcccctttcaggccttcagtcaaacacattacttgtccccagaacatactctgcactactatttcagtagtagtaagcaagtagatacgaccttaagtagaaattaaactctgcaaattacctgaaagtcatttaatatcatttaatttttcataatgtatatatttctataaagtgatgtataacatttgttattaatctacttcagaatcatgtttaaaagattccactaaaggagcatattcaaggatattcgatggatggaaacagttctatccatatatagttcaatcaaacagctttgtgctgctaattcattcattcatttgttcattcatttcttccaccctttaattggtaaatatacttgcattttcatgattaggtttctttatacacaaatttattcaatattaaaataacaaagcaaaattcccttcttttaccaggaaggtaatctttcatgaaagaaaaaagctgaaaaatattaatttacatgtgctttattctaatctaatgaagcagtgtaatgccagtaactttatttatgtatctattccccaaacattcttttgcttcagaatttttacataggtatcctttaatcacagacatcagaatgctagaccatatacttttcaagagacttactgctttattttggactcaagcaataaaatgtattaaaatcaagatattcagattactcagatatactataaatgaacgatgtctaggtaaggaggaaagatgggatcgaaagaaagagagaaagatagtttttatcactgaactataatattaatgagagttaaaatgtcataagagcctgatactctcttctgaggagtagctcttctcaacatggcctgcagtagtcctaaaataatgtgcaggaaagaacaatgttgaaatggaatgtaatattggcaggattgcttgctataattctggatcttatttcaataattgattattcgatactgcaaagttcccaggaatttttatccaatagataaaattaatgatttacattcacaatctgaatcctcagatctattgctccattctcatctgcattgttttgatcacttgagaaagagattctacttcttaatttcttcttatttctttggactcaaaaagatgatcatagctaggttttgagaattatctctattctctatgtctctcattaatttatttcattttcttcccttatagaataagtactttttctcctctattagacatctgggtggggagaaagggtattttgtgtccaggctgatggttaatttactgttcctttgtggctatgctgaaggaagagaaaatcagttctccagagaacttttccattttgcacttggaaaggtttagaagcagagttagagtgtgttttctttagggaatctttagaaggtagacattaaagtgaaggtctagttgtgtcacatttctagaactgcaaaaacccaatttataactagaagtttgaagaggccaggctccagaaccatccagtatctgtattatgctattttctttttcgttttgacttttcacctttttgtgttttgaaagatggaagacacagtaaaagtatctataatgtgtatatgtgcaatttaaataatagtaaaatgaatttctgtgtactcaatacttagtttaagagagacctgttactttctaatgtatcactttaatcagacttcattaaagaccttgttatcaggtaattttttttttttttttttgagacagggtcttatactgttgcctgggctggagtgcagtggcatgaacatggctcactgcagccttgacctcctggggctcaggcgatccttccacctcagcctcccaagtagctaggactatatgcacactccaccatgcctggctaatttgttttgttttgttgagagggggtcttgttatgttgctcagactggtctcaaactcctgggctcaagtgatccttttaccttggccttccaaagtgctgagattacagatgtgaaccattgcatctggcctggtaattctttatcttcaagattttattccatctacagattatattaaatgagctgatcttcataatgagaaagctctatatttgcactaattttacattgatttcaaatgttttaaataaagtgatgttaagtataccataaagtgactgctcattaaagttactcattttttatcttgtgtttataatagcttgcaaagggaaagtctctttgtaaggccagaacaaattctagcaatactgtgtattttctaattctttctttttgctacattatactgttttcattacctctagcctgatcctaacctaaaaaacccatggatatgtcttttctaatttcagattcttgggagtagagcttatgttttatgcagttctgtgtactgagcttttagtacagtgcctacaataccagaaacaattaacaggcagtaatggaggagtatactcagagatctgtcgctgggtggcgctgaacatcaaaattcttactgtaattgctccatcacagttacttttcaagtgcaatggaagttcctgtgttacttgtgaaattcctagtaagctgattttaagtacagaaagttatcctcttgttgcacagaaagttattctaaagcctttattttcagtggtgggtgggctgaaatggggcctctgctatgttaggatgagaaatcattaagatttgattggaatatgaatcctatcagtgtctaaaaaatatgaacttagatcagatcctttattttaaatatctactttaatatacataggtaactagagaatatttatgaatagcttttttagatttaaattgcaattctgacaaatatttaggcagcttttaactagtatagtttattttaactggtgtggttcattacaaagtaaagatttttttaaagcagttttaacttaagcataacttacaagttttaacttatagcaagcataactacacataaaggttattcagattttcttaatgtcactgggaaaaaaagacgaatgtaatttaacttttaaattaattttaattttatgttattcattttattatctttagtactaatcatgttccagctacagtattaagcttcataatactggaaatagccacattcaaagacctataagctaatgactttgattttttgatgggatgttgcagaacatgattgttgcaacatggaacaatcatgttgaaaggcatcaatcttttttctgattgccaacaacctatggaatattaaaaactatctatatgagtgagtttcaaacttttttgactgcaacccacccacagtaagaagtttatttttacttgttccctagtttgtatacagcacacagtctgacaataaaatttcatggaatagtacttacctacactacctatacgataataacttggtatatgaaatttctttttattaaaaaataaaattcacttgggttcactaaatgactttactgcctggtaatggatcatgacctatagtttgaaaaatgcagatttaggccaatcttttctgtgtagcagtgaaaactggcagggacactaagaagtatgctttttgcctaagcacttctaagttcaaaaattgctttttatttgtaattttagtagtaaattgtgtctcccagtatttaaaattgcttgtccatatgccatagattgactttaaaatgatgccattggaaaaaataacaaaagatctttgtttttttttgagatagagtcttgctctgttgcccaggctggaatacagtggcttgctcgcagctcactgcaacctccaccttccaggttcaaatgattctcctgccctagcctcctgagtagctgatattacaggcacccaccaccaggcctggctaattttcatatttttagtagagatggggtttcaccacgttgtccaggctggcctcgaacccctgacctcaagtgatccacccacctcggccttccaaagtgttgggattacaggtgtgagctactgcacccggccaacataagatctttaataatttaagttccaagcgttttggcttctgttttttggtatactgtacttgaaacaaataagtatggctttttgtataacacaagattttactagccctaccaaaaatgttttctaatgaaataaataaattcagcttacctctaagcttaacatgtacagtggtaatatgccacttagcaaaaggtcaactttcccagaacatagcctcagagaagagaaggaaacatgcctttgtaccaccattatgaatgttgctaagcttcagcgttaaaaccatgtacttttcctggcagtttttctcagaattcttatgcacttaattttttttaaagaatagaattcttatcgggtttagttctttttttttctctgccacagagaaggatatacagatggaggaagtccagaataactattagtagagtaccagtggtaagcacagagagaggaagtaacatatgacacttaacattaaggagaaaaactatagtctgttgaagcatgttcatgatgatctcgagtaactggaaaaggtcaagtcacatttggtgaaaaggtggggaaaatgcaacatatcacaaaaatttttatccaaaatgactaaagtaaaatttcctgtgtgctttcgtggagggtgggtgggggagggggtaggaaggaactaaccaacagatacgaggaaattttatttttttgacttatatattgctggatagggctggataatcagttaccttagttgcagtttactttaaacaactatttatatgagagatatttttctaggcttgagatatacataaacaaaaaagattgttcttaaggaacattaaagcctggtacttaaaatgctctaaatgttattttgtcagatctctgtttttcaaggtgaaaacaggcttagttttctagtaattaatgtttataccaagaagcatgaaaacagatcttttgttaatttttaaagtaatactctgaaacatgaattttcacaaattttgcttactagtattgtgctatgcacttacctttactaagtgcaggatgattttgtttttattttcaatttgagaccatgatgaaattagtccatatttatatcatgtttttaatgagccatggtagttgaaaattaatctatttaaagttaagtatgtgaagctggcctgattaaaatgtatcaggttgtcacagtactcagctggatatttaaaaaataatgccctcaagacaaaagcttgtggttcatgttacaacaaagatgaaaatacaggtatacttctgaagttaatccattgttagtaactaccaagtgttttttcttaaacagttttaaaataagccccatattttatgtcttatacattctctctctgtacaacagcagcattctcctacatgtagttaccacacttaagaaatttaatattgataaatattatctaataatataaactacatgtttaaatttcctaattgtgtccaaaatatctcttatagttgttttctttttaaccatttcaggatccaatcatgaatcccagactaaacatattcagcttagttgtcatgtctcctttaatctacaacagctcttgattctttttttcctactttgtgcatttctgtgtttcagtttaataatttctattcctttgtcttcacatttactgatcctttattctacaatgtctataatcttttaagcccacctagtgaacttttcatattgtatctcttttatctaggagtttcacttggatctttaaaatgtgtgtgtatgtgtgtgtgtatgtatcatccatttctctgagccttatgtttatattctccttcaaatccttgaacgtaatttataattttatgtctttatattacatgtaaatgtattcttataataataaattataatttatagctgttttaaaatccttgtctgctattcataattccgtatccatgtaatttctgggtctgtttctgttgaatggtttttctcatggttatgggtcacattttcttgcttcttggcgtgtctacctttttttttttcaactttcattttttaagttctggggtacatgtacaggatgtgcaggtttggtacataggtaaacgtgtgccatggtggtttgctgcacggatcaacccatcacccaagaattaagcccagcatccattagctattcttctgatgctctctctcccccgaccctccctgagaagtaccagtgtatgttctccaccctgtgtccatgtgttctcattgtttagctcccacttataagtgagaacacgtggtgtttggttttctgtttctgcgttagtttgccaaggataacggcatccagctccattcatgtccctgagaaggacatgatctcgttcctttttatggctgcatagtattccatggtgtatatgtaccacatttgctttatctagtctatgattgatgggcatttgggtcaattccgtatctttgttgtgaatagtgcatgtctagtaacttttgattagatgttggacatagtgttgtattgtcatatgtcttggtctttaaagaccttttaattttgttgtggctggcagtaagttacttgcagatgagcttggttattttcaggcttgtttttaaagtttgttaagttgatgaagagttgcctttactgtagcactactattttagctgtactaataaggtataacccttctagggtgtcctctgaatgatctagtattcaaggaagtctcccctctctggctggtcagagcttgaactcttcctgatcctgtctgaattctggaaattgttaatcttttttccagtaattgtttttttttccctagtgagcttgtttgtccaggcttataaggtctcactgtatgcatgcatatgccattcttatatttagccaaagacctaaagggaacccatctacatttttttttagttttttatttaaaatttttgtgggtacatagtaggtgtatgtatttataggatacatgacattttttgatacaaacatgtaatgtataataatcacatcatagaaaatggagtatctatgacctcgagcatttatcctttgtgttacatacaattcagttttactttttagttcctttagaatgtacaattaaattattaactatagtaaccctgttgtgctatcaagtactaggtcttatttattctgtgtgtgtgtgtgtggttttttttttgtacccattaaccatccccatctccccccactacactactctcttatctccatgagttcaattgttttgatttttagatcccacaaataagtgaaaacatgtgatgtttgtctttctgtgcctggctcatttcacttaacatagtggctttcagtttcattcatgttgcaaatgacaggatctcattttttctaatggctgaatagtactccattgtgtctaagtaccacattttctttattcattcacctgtggatggacacttaggttgtttccaagtcttggctattgtgaacagtgctgcaacaaacatgggagcttgggtatctctttcatatagtgattttctttctttggggaatatacccagcactgaggttgctggatcatatggcagctctatttttagtttttttgaggaatctccaagccgttctccctagtgattgtgctaatttacattcctaccaacagtgtacagggttcccttttctccacatactctccagcatttcttgttgcctgttttttttggataaaagcatttcaactggggtgagatgatatctcattgtagttttgacttgcatttatctgatgatcagtgatgttgagcacatttttatttgcctatttcccatttgtatgtcttcttttgagaaatgtctattcaaatcttttgcccatttattaattggattatcagacttttttcctatagcattgtttgaactccttatatattctggttattgattccttttcagatgggtagtttgcagatattttctcctaatctgtaggttgtctctttactttgttgattgtttcctttgctgcgtggaaggcttttatcttgataggagtccatttgtcccttttgctttggttgcctgtgcttatggggtattactcaagaaatttttgcccagacaaatgtcctggagattttccccaatgttttcttgtagtaatttcataatttgagatgttaaatttaagtatttcatccattttggtttgatatttttatatggcaagaaataggggtctagtttcattcttctggatatgtacctccagttttctcagcgccattcattgaagagactgtcttttccccagtgtatgttcttgacattattgtcaaaaatgagttcactgtaggtgtgtggatttgtttctgtgttttctattctgttccattgttctgtgtatctttttatgccagcatcatgctgttttggttactatagctgtgtagtataatttgaagtcaggtaatgtgattccttcagttttgttctttttgctgaggatacctttgtctcttcttggtcttttgtggtttcatataaattttacaattgtttttctctatttctgtgaagaatgtcattggttttgatagacattgcattgaatctgtagattgctttgggtagtgtgggcattttaacaatattgattcttccaatctatgaacatggatttttttctcttaattttattttggattgttcattgctagtgtatagagaaacagtggatttatgtatattgatcttgtatcctgtcacattgctaaactggtttattagttttagtagtttatttgtggattctttcatatgattgattgattgattgatcgagatatcatttgcacatacatatagttttacttcttcttttccaatctggaagcattttatttcaatttcttgcctaattttcctggctagaactgcctgtacaatactaaatagaagggccaagagtggaattcttgtctttctgatcctagagagaaggcattaagtcttttaacctgaagtatgatgttagctgtgatttctcatagatgctctttatcaggttgagttcacttctatttctgttcgttgagtacttttatcatgaaaggatatgattttttcaaatgtatagtgttagtagtatccaaataagttttgatatgttttgtttttgctttcattcatctcaaagtattgtaaaatttcctttgtgattttttgacccattgattaggagtgtgttatttaattttgaaatatttgtgaatttcccaaatttccttctgatgttaatctttaatttcattccactatgatcggagaatatactttgtgtgatttcagtacttttaaagttatccagggacgttgaagaggacaggagaaacagacttgaatcgctgacaccacccttcttcattccccgcccgcttcccggcagcaaccacgcaatgcagagtctgtgcactaggagtagcgagagcacagtgactagaggactttacatggaactcagtgctgccctgtcacacagttcaacaatgatagttggagactgcaatgccccaatttcaataatgaatagaacagcttgtcagaaaatcagtaaggaaacacaagacttgagcaacagtataaatcatctagaccaaaccgatacctatagaatgttccatccaacaacagatgttgatctccagggctcaggtgatcctcccacctcagcctcctgagtagctgggactacaggcatgtgccatcacacccagcttatttttaaattttttgtagagatggggtctctttacattgccaggctggtcttcagttcctggaatcaaacaatcctactgtctcagcctcccaaagtgctgggattacaggcatgagccaccatgccctgtcttctagaagtctttttgcagattcatttaagtagatgattatgtgaactgcagataaagactgttttagtttttcatttcttcatccatatgcacttttacacactctctcttctctcctctccctttgccctactcccaccaccttattgcattggctaagagcttcagtacaatgttgaatagaagcagtaagagtgaatatcttcattttgttgctgttactaaggagaaagcattcagtcttttaccagcaaatagaatgttaattgtaagagttttgtaagtaacactattaacagaagatattttaaaataatatgaagccaagttcatacttgaacatgaaagttgattgggagcaaaaagaaaagaaagacgctttaaagctactgaagacatcatgagtaaattggaattcaagaaaatgtagtcattctcttcctagtgagtaagcacttaaaatacaccttgagagaggtgtatttttatatttattcctaaaccatggtagatgaattttcccagtatttattacttttttctacttctattcttattagtttacttgttttagtaataaaattatgacttgtcactgaaattttcctctacctcacatatatttttattctgcacgcattactgtttgacatatttcagtatatcctcttttaacttcccaattaaaataaatgatctatttgtacttataaaaatgttgaaatagtgaactaaaatttatgttattaaaattagaagagagtatatttgtaaaagctactatttatcatcagatatcttttgcccattatctgaagacagatgttctcagaaacactgggcatttgcaggaaatgaatgtatgctgttgctggaatatcctctgtctgtctgaagtagtcctgcttttgggcttgccttttctctgttcttcaaacattacaaattactcttcgtgcaaaacagcactataattcagataaaagttttagaacttgaaatgcagatttgtatttcaagtaaataatgttctagttctaagtatgtatcattttacatgaatatccagactcctgtctaatataataactggattcttttcaaggttattgttcaccagggaaagtcacctctcttacatttttaccattcttgcaggtgtgtagcctggacatatacacatgtctgcttatttgcaacatctcttcccagagaaacaatgaagtacacttaacttcgttcatatatagaagttaaagaggattgaagattataggaaatgtaacaatgtgaatagattgcattttattagaagtttgttttaaacaacaaggtagccagatttgtctttttttgagatggagtcttgctctgtcacccaggccgaagtccagtggcgcgatctcagctcactgcaacctccgcctcctgggttcaagcgattctcctgcctcagcctcccgagtagctgggactacaggtgtgtgccaccacgcccagccaatttttgtacttttagtagagacggggtttcaccatgttggccaggatggtctttatctcttgacctcatgatccccccgactcagcctcccaaagtgctgggattacaggcgtgagccactgcacctggccccagatatttattgaatgaatagattaatgtgctgaaaatctgaatttgagtgtgcgtgtgtgtgtgtgtgtgtgtgtgtgtgtgtgtgtcggagtcttgctctgttgcccaggctggagtgcagtggcgtgatctcagctcactgcaacctccacctcctggattcaaacgattctcctgcctcaacctcccaagtaactaggactacaggcgtgtgccaccatgcccagctaatttttgtatttttagtagagacggggtttcaccttgttggccaggatggtctttatctcttgacctcgtgatctgcccgactcagcctcccaaagtgctgggattaaaggcgtgagccactgcacttggccccaaatatttattgaatgaataaatagattaacttgctgaaaatctgacaatttttttttttttttttttgagatggagtctcgctctgtcgcccaggctggagtgtagtggtgcgatctcggctcactgcaacctctgacttccgggttcaagcaattctcctgcctcaacctcctgagtagctaggactacaggcgtgcaccactgtgcccagctgatttttgtatttttagtagagatgggatttcaccatgttggccagactagtcccgaatttcttggccagactggtcgaactcctgacctcgtgatctgcccgcctcagcctcccagagtcctgggattacaggcatgagctatcgcgcccggcctgaacatttttgtcttaagttctaacctgttgtgttctacctacctaggaaaacttgctacctctcaaatttagtatgtttaaagccagtctctgctactttcctatcaaaacaaagtttctcagctttcctattttggccaaaggcattctccaagttccctaagttcaaaaattggctatgaagtataagagatagtattctttcacgtcattgctgtcatcctgcattgtcataaaagcttctaaatcttcagtctctcctttccaagtcaatgtaatcattaccagattgttccaaagcagtgttttagccatgtcaaccccttattcaagtgcctactgtgaactcttgactgaggagaccacaagtctacttttctaaagagccttcagggtactgcacagtctgtccttttttttctctctcttctcacttctgactgtccaacaataaacactagtagcaatggcaataaacataactcttagtatgtgccaggtaatgtttaagcactgttttaagtgtttttcatatattaaattatttaatcctcagattaaacaataataaatgtgtatattgtaatactagtaatgtagacattaaatcacttgcatgtctaataaaagtaggatttgagcccaggtcgtctagttcccagagtctgtacttttaactaatctgccattctgcctttcagtaacactcttctttaagtcaagtcactatgttttttgttttgttttgttttaaatgtgtcttttaagataccatttgccctgttgtagctctcttcttcccatatgaaaaaatatccccaccttttcccactgttaaccagaatttcctgtttttattgaggtgtaattcaagtcttataaaatctgtcataggtatttcatcccacagcctttttccctctaagtttctatcagctcttcacacaatattttaacacatttcttcttggcttgtgttgttttgtttataggttttattttgcccacaagattttaagattaatgttatctgcatcttgatgctttctcagttcaattcctctttctagacatttgtaaaatgttacataaggttaatgatcctgagcctcatcctgatccattgggcaaccccatgcttctctatctaacctgacaaagcagtgtttaaatctcagctctgcctaagtgtgaccttagggtagttacacttacctatctttcctcatttctaaactatagaaaagaatatctacattgtggagttgtattgaatattagagataacatgtataaagcactagcacacagagatttctttttaaaaggtctctattcatgatcatctcaaaagcataatcatctctattataaggcatgttttattagtgtcagtattataaatttgttcaggctagaaataagatgaattattgtgttgttcccagggttccttttagaacctgtcttattgaagacttttctattagcagtctgctatcttctgacagactggctatttataataacaagccaacagttccattatttctttaaacctcttggttaggtgccacctggtctatgtaatttagttgcatgtaatttgtttattggatgtaaaatactcagtgcatttaccacaatttgggctaatagctctgatcagtctccttaaaaaggcagattgccaatacaatttagaaggctttataatgtagttttcagttttggtggctgttttggatttagatttgttcactgtgcatgctttgtttcatgaatctttaagttctttgcttccatctgacaccatgtgtttgaggttgcattttatgaatgggaaactttgcaaatgcttactaaatgatttaacatttatttctgcctcatgtgttcttaaaaataccagctgctgcttagttgaaaatgtaatttaatttgactgacacatgagttttatagttcataaacatggatgtattttccttgtttgtattcataagcctgttagtccatatgttaatgtgttctttgatttaatttcatttctttattttaaaaatcgataaaaacaacaacaaaaaccttgggaaagccttcatacttgctacatttttgaaaacatgcatctattttttggagatcacacttatgcctacagaatttcttcccattttagtggtttcctaaggtttctattttaggagttttattattatgttaacagagaacagcttttgatattgatataattttgtagtgtatttatagaaacaagtgcattttggatgtgtgaaagacatatttctcctaagttgcttggtacagttttaaaagcctaatggttagatttagttaaacatggtggactgttataaatccattcatgtatatagatgattcttaataatttgagagtgagaaagcctcttgaaagattattactttgtctcctctccagaaaagtttatatgtagacaaccgcagatttaaggaccccctggagacctgttggggaattgggatagtacaggggtccccaagcccccagccgtggtcccgtacctgttaggaaatgggccgcatggcaggaggtgagcggtgggccggcaagcattactgcctgagctctgcctcctgtcagatcagtggtgcattagattctcgtaggagcgtgaaccctattgtgaactgtgcatgcaagggacctaggttgcacacttcttacgagaatctaactaatgcctgatgatctgaggtggaacagtttcattctgaaactattcccccggtggaaaagttgtcttccacaaaagtagtgcctggtaccaaaaaggttggggacccctggggtatgacatgtatatgtgtaagtataagacactatataagatcttgaagaaaaatataaatagattaacgtaaatactctaagcagggagcaattaatataggtacatgtggcataggggtacaggacagggcaagcttcatggagataatggaatttgaagtactgacaggcattcagaagacaaagccagttctacacagggtcaagaaagcaactgacctgtttggctacccatgagtactgaaatttccttaaggataatgactttctgattgatcctcaagttccacattgtgcctagtatggatacagttatcttactcattatgtaagctcagcaaactacttgctgaattcagccacagtttttactcgttgtgctttctgagaccacttttctctgtgttctaacatgttgcatgtttgccttcacacatatttttattcagggaaaaaagttaaattatgtaatttcaatgactatgtgctttggttggctttaaaaagaaatttaaaacttaagttttgtattagcaggaaacagcttttgatattggtctaattttatatttcttaaattgtgtctttggcaacagttactttttgggtgtggaaagaaacatttctcctcagctccttggttagcttttagggaaaagttaaaatggtcatgaaagcatcagataaactaatagtaaccccaactgagtatacttttgtttaaataaaagccaagtgaagtctgtactgccatggtaatataatgcagaaataataagttaatgtatgtaacaaataatcaaagtttatagactacattcttaagagattatttttttcctccctttggaaagtagtgatatctaaggggaagagggtgtgggggactggcattttctcaacattcatagttggataacaaaatccacctaaaaataaaacatgtactcatatgcaaaaatgctaaacttacttttttgattattgacctttctttgcacaactctaaaacatacttgtcacagttttgttgactggtgatttcttgccattcctacagtagagcagtaagtcctgtgccaacaaacaatttatattattttaattagttttttaaaaaatcactttctgcctgattttatctcctgtgtttataatgttataatatgagctattaatttaaacacatttaaaaagtacgtttaattgattcaagtaatatttaatactggcctaccctgtgtcaggctatttcataggtgctatggaggctataagataaacaaagtattaatttcttggggcagtcatatctcctacagatttagttttttttagtaataggataatattattctgatttatccacactgttgtctctttcagaaatctaacttgaattggtgggatagttttagagaagtcaagaataatgtagaagataatttttctctgtgccaagtcaactgacctgactgggattgaatatgtagacctcatttctcttacctagctttcagatccagtctgaataattgcacatcctttttacatttgggaacttgactctttgggctttccctggccctttggaacatgactcaggttttatttttattgaattatagcagagtgttgaatcattataatgctgataactaaaacagaactaatattagacttggaaattcttctaaaaaattaatatgcctgtttcttaaaaacacttaacactcaaacactctgagacataccattgtggaatgctcataaggtaatgtatttcaagagtttcttactatcattagtatccagaactatatatactcaaaagtatttcaagtattcaaaactatgtatatatatgtttgccctcctaatttttattttattcaaccaatatgcaaataatgatctatctgatccttcatttttgctaatagtctaaaggtcatacaataagtagtttaggtctgggtttatttttacttataacagaatattatttttaaagtgagacgtaataacatgttttgacactttccagatctttcatgtaaaaaaattctgccacacatccaactatattcttatggtacaaaggttactattttggaggctagctttaggaaagatcaaatagctagatagaaccagagtaagcaacttcagcctgcaggtatttttaagtttttaaaaagctttgtaaaggaattttacagaatattttggatgatcaagctagtgatatgaattggttttatctgactcatttctgtgtgttaggcatggtattaagcatttttaaaatattattttacatatgacaagaatattgtcattctcatttcagaggttaggaaactgagggttacaaaagaagtaatttgctcaagttcatcccactaattcatggcagaggtgggaattgaatgctcaaggtctggtaactcctaagcctgattacagcaagtttctacctctttagagcaaaacagattaatgctttgagtccttttaatgttttagcttgtatcctcatcttttatttacttcagtaagtttttataatcaattgtaaaagacaaaccactgtcttccttataacataattttttttttttttttttgctttgcaggttttaaatgcacagagagcaggatacaaggcagccatagttcacaatgttgattctgatgacctcattagcatgggatccaacgacagtaagtacaggtatcacttttcttctctcctgtttgacagatcatttgtaactaaaaattaacaggattttccttctctcattttctttttaaaaagcaaaatttcttctctatcagataatccctcattcttaactctggatgattttattcatagtagagatgaaaatgactttcttttctgaacagtttttttttaaacatatatgttttatttattgatattttgttaaaaaccaaaatgggggaaacagctttaatagggataaacatgctgagttaagaatgccatagagggtgttttgtaatttatttagagattcacagcattattttagggtatgcacatacactaagtagctgctataatctgctggagttccaaagccacatacttgtgcttccttataccagttggttattagcccttcgtcatacattggtatgttcatagtttttcatttcagatgggaatgtctttctttactctctactaattattagcttgtagggaaaaacgagccaattttagtggcataactggctgtaataagacactgactttgaagctgtatgcctcacttaatgtagtttctattactcagggcactatggggttttatcaaaacctttctaattgatactaagatgatttactgtcaacactcatgattagaatttattttattcttttgagtgcataaccataatatattttgttattaagtcctattgattcatattttcagggtagagcaaagtatagacataaagctatagactgatagaaaacactggaatgtatttaggagtttaaataactgcatcctgaaaaggaaatattttatattccttaaccaaaaagtcttcttttagcctatgacagtgttttctgttgtttttgtttttgcccttcttctttatttttttttttttgagatggagtttcactcttgttgcccaggctggagtgcaatggtgcgatgttggctcaccgcaacctctgcctcctgggttcaagcgattctcctgcctcagcctcctgagtagctgggatgacaggcacctgccaccacgcctggctaattttgtattttaagtagagatggagtttctccatgttggtcaggttggtcttgaactcccgacctcaggtgatccgcccacctcagcctcccaaagtgctgggattacattcgtgggccaccgtgcctgggcatttttgtccttcttaaccctaatagagtgaggcaaaattataatatgtaaaaagtaaaatttattaatacatttcttaatttctttatattttaaattattattttaacctcctagctaattaaatcttcatgactgtagaatccattaagtacccataagaagttttagcatttcaggaatagtttgacagctactacatgggaattacaggacttacttaagtgagtttacttatcaaataaactggtaatgttagtactgccaatttgacacattttacttctcctttaactatttccctcttaaaaaaaattatcccagttgatacatcccatggtcagtaacttttgtgatctgtatacatttactggcaaaatggaaagcatgcgtagtctggaaatggataggcctgaattcgaaatcaaatcctacttgtatcagttgtataactttgagcaagttacttactctttgtgtgttttgctaaaggcccaagcccaggatttagcaaaccttcaggaccttctcaagggctgaatatgttttggattgaacaaattgattattatttgtaaactatttactcttttgacatgttttcagtaaaaattttgcaggctgaaattgtcagttccctttatcacttattttttctttgtaatactgtaaaacctttttgtgataatcatgtcagctcctaaagaaaatatgttcaatattaaaagtagcacacaaccatataagcctgctgttgccatggaaatgtttcaactgagttgttgttcaaagactgctcagaattttggttcttgactttgttgcttagattattttctatgatattttgctccatctttgcgcatgtgtttaaacgttttatatgtacagagacaaatgttgtaaagatctttaccattttcatgtttgctattacttggtagaggtaagaaaagcatagatttatcagaagaggcttgtatctgtccctcttttcaaggcctttcctaggaatactggtatcttataccaagcagagatactaacgcctggaaacaaaaggaagttgtaaaagccccttcctgttgacacttcacgtaaggaatataccaatttttatttcagccaggaacagaatggattaattcagtgagccaataacattctttatctttaggagacagcagaaagtggtaggaaggacaccaacttcagaaccaggaaatatgtgtttattctaagccaggctagttgttatgtgaaccagatacctgcgccctcaggaaagttacttaatctttataagcacattattttcatctataatagtgtgaataattttgataattatttgacctgacaaatttgtgaaaaccttatgagagaaggtatatgagaaaacccatgcaatggcagagtgagaggagcctagatgaggagtcagaagcctccagtttgagtccagactgtgcaaatatctaactgtataaccaggtcaagttgttaatatctctgggtcattttttttttcctttttttctttgatttctttcttcaacaaatgcattttgacagcctaccctgcactgttttaggcactgtgactataggaagtaatgatgcagtcagaggctctgccttcatatctttcattgaggtagtagagtgcagtacttaagagagtactttccgggtactgcttgttagggtttgaatcccagctttaccacctagtagctgtatgaccttgggtatattacctaatatctatatgcttcagtttttctgatctgtgaaattaggataataatagtacctaagttatttagttgcgatgaagattgaatgaattaaggcctgttaagtgtctagaggacttcctggttcttagcaatcatttaatgattgttcagatattattattgtgattattatcattttattgcattctagagtaggagagaagaaatgaacacataatcaaatagatgtgctataatgtcaagtagtgataaatgctatgaagaaaaatatcagcataaggggatatagaatgacagagatgaaaggaaggcagctattttagatagggtggtcagagaaagcttctgtgaggcattgcaatttgagcaccgatctaaagttagaggctgagtcatgcagatttctgaaggagggtattccaaggagacggaacaacaagtacaacaattcaaagataaagcatgcttggtgtttccaaagtgtggcataaagccacaatggctagagtagtgaacaagggagggagtggggggataaggttagagaaggagccaggggtcaaatatgatgggccttgtcagccatgataaggactttggaatttattctaaataagttttaggctgggcacagtggctcaggcctgtaatcctagcactttgggaggccaaggcgggaggattgcctgagcttaggagttcaagaccaaccttggcaacattgtgaaaccccatctctactaaatatataaaaaattagccaggtgtggtggcgtgcatgcctgtagtcccagctactcaagaggctgaaccacaagaatcacttgaacctgggaggcggagggtgcagtgagccgagatcgtgccactgcactccagcctgggcaacagagcaagactccgtctccaaatgattgaatgaatgaatgaatgaataaataaaaaaaaataagttttaaacagctgtgtaaggcaatatgacatatttcataaacggagcactttgctgttctttggagagaacactgaaggtgaaaggtgagcaaaagtgccaacagagagaacatttagaaagctgctgcagcagccaggcaagagtaatggtggtttggagtattagtagttaaagtcatgagaagtggtaggaatatggctatattttgaagctgacaggatttggtatagggagtaagggaaagggaggagtcaaggatgattccaagatgtttagtctgagaaactaagtgaatggctatgctgtttacagagatgagaaacagagttgatcgactgagagaaaagagacattcagagttcagttgagaaactttgtttgaaacatgtattaggcaatcaaatggagatattgaatggacaattggatatacgaatctggagagtttggggctggatcattcaaattgtaatctatctttgtcgatatgtacttcacagagttgttttacagatcaaaatagagtgttttaaaagtattttgtgaagtaaaacatatttagttttgttttcagtagataatgttgccattttcaagatggctactcatatttgcttacaatattttctccctttttcttaatcattttattaaagtaaggagctttctacatctctttagatgtcataattcaaagaagctaggttacttccaatattattagccagtagttacaaaccaaaagttattccttgagtttgtcatagtatcttcatgaaagaagaaagcatcatacaattccaagttttaagtatcaaataaaataagctttaaactcatatgtggtagagaaaatatcttagcaaaatagaaaatatctcccaaatataaaaaaaaatatagtcctataacaatacctctgcatctattaaaaaaaaaaatgcaataatgcctgtagccccagctacttgggaggctgagacaggaggggcacttgagcccaggagttacaggctgtagtacacaatggtgccatctgtgaatagccactgcactgcatcctgagcaacatagtgagactctgtctctaaaaaaataaaaataaaaataaatgatgaggtagatctgtatttattgacataacaggatatctgagctgtatcattgtgtagaaaaaaagcttacactttaaaaattatatgatcccattgatataaaaaataaaattttattgatcatgttgatataaaaatagtgattaaatatttcttgactaatattttttgtttctgccctctttggggcttacatgtttttttctggtgtgtatgtgcgcgcatgtgtgcgtgtgtgtgtgtgtgagagagagagagaatgtatgagagttgaacgtttatatttgcataaaacaatctagaagtgaaaaaaacttactctaccaaggatatcaagattttaaaccttgtctttataaggatgaaaacaataacagcaaaatagatcagtaatttataagtttagggggtaggggttgactgtatgagggaattttggtgggtgatggaacattctatatccaactgtagttgtggttataattgtatgtatttgtcacaacttacagaactgcttattactttaaataaaacatttgtccttggatgggaaagattatgattttgttttgttttctttttctttacttgcctcccccccttttaaatgcataatgaatatgcattgtttttaaaatgcagaacaaagttattttgaaaactataaaaagaaaacaaatgggccttctctaaagccaaatgtgttaaactaactcacagctaataatgaggctgctttttctattagcaacattaagaggattgtttttctttctattcctgagtaatgggtaattttgacgaaattctttttgggtggcatttgattttggttttgaatatgggtagaagagtcaaatatcttaagataccaatcaaacacaaaactttgccatgagcgccaggcttacaaggaaatagaaaccagctttcctgccctattccctttctcaacccctgtcagcctttcagtctggaaagccagagatgtgtggtattactttttagattgttgtgaagttgtcttttcttatattctctggcttatacgtctcctggaaatgggtatgtaaaagaagctttttctctttttcatttaggaattaagttatgtgtgggaagaaaacctaaaatttcttcatctttcttctctaataagttatgtctagagaggaagaaatcaaatggaaatattaaaaataaaaattacatctcaatcttatagactattgagagaattcaggtaatgtgtatatgcaaaatgttagctttgttactgtaaatgttatgtttctcaaccattttgatgatgaataaaatctgcaatctggaaaatcaagcaatagacaattaaagttgattgtaattgtttccagttgcatttgctgctattatgaagaaaagttgattatacactaaatatgggcttttaagaataatttcattattcttttatacagttgaggtactaaagaaaattgacattccatctgtctttattggtgaatcatcagctaattctctgaaagatgaattcacatatgaaaaagggtaagtaatggatataaaaaatcatgttgcttaaaattcttctttatattaaggtagaattatataatattgtaatcaagattatgtttcagaatgaactctgtagtgctaaattatccctttttaaatcattatgcttttaagacgtagtattttaaagtattttactactttttctttgtatgattatgttgaaaatatattcatgctagtgagagtaagtcacccttgttgctaaaaagataacttttcattttgaagtttaatcaaactactggtattttaaaacaatgcaatttatgtttatatgacattttctattaagaaatgtttgtatattactaaaaagatattttatatattataaacacagaatccaaaacattgtgttaagggactaacatttacaaaggcaaaaagtcagttttcaagttttagaagcttgatttgaatgagaacttttatatgaaactcttctcccctacccccacaaaataatctcattacaaagataacatacagactgaaattaacttaaggcacagctgtctcagctaatatagaaaacagagaaaacggtacaataaacacttcagaacttcttccatgacacacagatccccaaaacgtagttgaccagaacagactttggtctaagaggaacaacaacaaaaataataataaaagcagctaatatttattgagcatttagcaaagctgggcactcatgaaagcaagacttctacattttgttatccatttaatcctcacaacaaccctctagtggttgttattattatcacttattatctacatttgccagaagaggtaactggcacaatgaaatccaattctaattatttagggggaaaagaaatccacgaatatttctgtttgaaaatgcataaaaagaagagggcaaggttttctgtttactgttattgttagttccccactacagtgttgatatttaaaatactgttcacatattatatgctcagaacattttttttaagttaaggaatgtaattttggaagttgtatcaaaaaacagttatgcaaagtggtgttttgtcagccgtgtttgcttggttaaaagagaggagaattagtacttgcttttacctcaatattgctccctcgtttagaatacttctatatattttaatatgtattttaaagagtattttttgtttttaattataaaaccatactttttaaaattaagaagtaatatatagatactagcaaaatatggaaaaattgaaatataaaatatttaaagtgaaagtctctatgtgacactattgcttaccaactactgttttttaaaaagccctttgtttttccccatatttgcttattcaccttaattagtgatcacatgctcataaaatggaaccatacggtgcctaataatttgtaacttgctttatttacttaatgttttgaccctttccaggtgaatacaagtttacaaactctcttatcccacctcttggctacagatatattgtggcattgaaaaatgtttgaattttaaaaagttaaataacattccaaatagaatttgaggcaacaccccataatcaaacaaattaatgtatctgcaataaatatatggctattttttcatgtcagttcacttcaagttgactgtcaaatgaattgcaaacattattttttaaagctttttaggttttagaattggtcataaggaattgtagacccgtacataaagatctactctatctatctatctatatatctgtctatctgtctgtctgtctgtctgtctgtctgtctgtctatctatctacctacctacctacctatacctatcatctatctatttatctgtctgtctgtttagtatctatctaccacctactttaccctcaagccccctctctttcagtgggcagaactaggaaatatatatggcttttaaagatacaataaatcatgagtgtatactgttgcttccaatttaaatacaaaggtctagaatttttactttattgaccttaaatgggtattttatttttctatgctgaaagacaccaacataataatatattgtcttttctaaatgtaaagtatgtacacaacagactcagaagaagaatatcaatgctattaccaacatttcttaaaaaacagttctttctctgcttagaatatgtcataatagataagataaagctaaattattatcattattattattatttttgagacaggctgttactctgttgcccaggctggagtgcagtggcatggtctcaactcactgcaacctctgcctcctgatctcaagcaatcctcctaccttagcctccccagcagctgggggctacaggcgaattctttttttaaaagaaagtgaaatagtctgtgtgctgatgttataaattgaaaacacaggtttatttgattcatttgctttcagagtttggcgattgctccccttacccccaactgtgattttaaaaattatatataaactctgagtcaaaatcagtgaaacaatgtatattcagagaagttcagattctaagtatcatccatcttgtccatcttgttcctctccttaccttataagtaataattaaaaaaagactttaatttattctttagttcattaaatttaaaaatatgtaggaaaatatatatctcctctcccctatcttctacccttagtgcataaacaatattccccatcctgcttttgacttgattgtttatccttgagtagatagagatattcttcattcttttgtacagctgcatagaactcttattttgtggatgttccagtttaatcagccagtcccctgttgatcagcatttgaatcggttacgttattttgtaattataaatactgctgtaatgcataaccttatgcctaagtgttttcatgtttttgccagtatacttttggaatagatttctagaagtgggattgctagttcagagttttaatgtatatgtatttttgctagatattgtcaattcccatccgtaagggtcatgccaacagtttatgagggtgtctcttttattgtaccctcaccaacaaagttgttgtcagatttgcttatttttactaatcagataggtgagaaatggtattctattatagttttcatgtgtatttctcttattacaagcacatttaagcatttttttcttatgcttaagcgctacttatattttatcttttatgagctgtttacctctaggccagttttttgtattagattattggtcattttcttccctatttttagaagttctgtattttattagttatgttggtcctttattttttaatattacttttttttgtattttgaaatttttatttcactatgatgttgggttttttttaatgtaaacaaaaatcaaatatctcttcccttgggctgttggtcttgagtcttaataaagttttccctactcctgtgttatagaggaattcacccacatttatacttgtatggttttgtttttaatattaaatcttttgttcatttgtaatttatcctatatatagcttgaagaatggatccaatcatatctttttccaaatagccatcagttattccaatggggtttttttttgtccttcccaatgaaatttttaaaacaattttattaagatatatctcacataccataaggtttacccatttaaggtgtaaaattcagtgatttgagtatatttatagaattctgcaatcatcatcacattctaattttagaactttttcaatattccaagtagaaaccccgtacacatttgcagtcacttcctattccccagtccttcttcgtccactccagccccaggcaatcactaatctactttctgtctttatggatttgtctattctggttatttcacatgaatggaatcatataatattttatgattttttttcatttaatgtaatgttttcaaggttcatcatattgtaacatgtattggtactttattctttttattgctgaatagctttccattgtatggatataccatgttttgtttatctattcatcagttgatggatggacatttagcttgtttccacaacttggctattgtgaataatgctttttttttcactatttgtgtacaaatttttacatgtgcatatgtttttatttctctttggtatatacctagaatggaattgttgcattatgtggtaactctatgtttaacactttgaggaactgccagactttttcccaaagtgccttcaccaatttatattcacaccagcaatgtatgagggttccagtttttccttccaaaggaatttaataatcaactggtctagcttcagaaaaacctgataagatttttattgagattacattatattcataaattaatttaggaagaattgacatttttaggataagtctccttattcaagagtgtggtatgtcctttcatttgttcaattctgcttttttttttttttttttttttttaatttagaaagggtctcactccagttgcgcaggctggagtgcagtggtgccagctcactgcagccttgatctccgaggctcaggtgatcctcccactgcagcctcctgagtagctaggaccccaggcatgcaccaccttgcccagctaattttttgtatttttagtagagctggggttttgccatgttgccaaggctggtcttgaactcctggactcaagcaatctgtccgcctcagctccacaaagtgttgggattacaggtgtgagtgagcagcgaattctgtttttatgtattcagctttgtttagtttttttagtccaaaatctatgtgagataaacatttcttgttaaatttatgccaaggtattttattgtttgctatcataagtggagtctcctctttcattacatctactaactggtttttatttgtacagctgaaagctcatttttgagtgtggatataataacctgcaatttgactaaattctcttactgttgatggcagttttttcatataaatagaaatagttttatcttttcctttccaattcttatgcttctaattgctttcccttatctaattgcattggtaataactttaacaccatgttaaatagtagtagagataggcatctttcccttgttactccctttagtaagaaagcttctcgtttctttaagtaagattctggttttttatcatattaatgaagtattcatcaattattgttttattgtactttattctttttagctactgttcactcttttaactacttttaaaaaggatggtatattctggatttaacaatagtccattgtttagatatatcctaatttacttagccagtaagccaccgactataagcatgacctctggagtaagagctgtgtggattcaaatcctggcttccatcacttgttagctgtgtgatcttcaacaaaaaatttattatctctgggccgtagcctctctcctcattaaaatgtgaacaataatagaacctacagcatatagcattgctggaaggattaaacacattaataaaattcttagaagaatacctgggacatagtaaatgcttcataaatgttaatgcttaccttccaattcttgtctattacagaaagtgctataatgatatccttgaccatatactatgtgcaattgcacaaatgtttctttagcaaaagcacctaaaagtggaatttttttgattaaggagaaacagttttaaatttcagtaaacaattgtcatattgccctttaaaaagcagttatgtttccaccaacattttaggaaagccaatgttttcccctactcttgccagtaatacatattatcagtctttttatgacctcccaatctgacaagaagaaaatgagttggtccgattagcatttctttattcacagtgaatagttttataaactgtttggtgtcctttgtcaattttggtcttttaaaaacttaaattctagaagcattttgtaacttttattagggaaggcaaattattggataacatacaacttttacaagttgtgggcagagacaaagcttgtttttgatcagagtgagtagtgcagttcactggagggattgctggggtgtggcctttgggagggtatttaatcttcatggacatattttctcttgaaaatgaagagttagaacaaagaatattgaggttcctttaagatttctatattctctctgatggttagggattctattttttcacatttaatccctagcaccaggcccattgactgtatcacagtagacatttagtaaattctaatgaaattaaactgcttttatgttacctcagaattcctcaagaagacagagcagtgcactggcagtaaatggggacacagagcctgtttattaagtgatgtaagatgtttaatgaggcagctgtgagctttgtctgaaaggagcaagttcaaggaagtagtcagatgaaatagtggggatatccagcagttgggctgaatacaggttattgcctggaaagctgatctataggacagaaggctctgctgtgtggctgtaaatccactgaggcttagtagtttgattggtgggggttggatgtcagaaaagaacagacaagacttcatgtgtcaacagaaggatggggaaattagacaggttattattatcaagcttaagcctaggcagctggtttgaaattagcctgggaagtcacacaaaggaaaataagaccctattttctgggttgcttaggactctgcttcagtgatcaaatcttagctgcagagctcataagatgtgctgtatttaggcatggacatagaggcagtgtggtaggataattacctgtttaaataccttcttcctcaaatacagattaatctgggactagggcaaggatgaatctgcaagttcagctgtgggagacctgggctgacagaagaaatagaaatggagccagaggactgaaattccattgtagttctgttgtagttccctgtatcatcactatcaccacatccactgttagcaatttggttaagaaaaaaacagtatcttgagtgtacattgagcttttgattcaagatgctcaaaacctttttttttttttttgagacaaagcctcactatgtcacccaggctggagtgcagtggtgcgatctcagctcactgcaacctccgcctcccgggttcaagctaagtttccagccttagcccctggggaagctgggactacaggtgctggccaccatgcctggttaattttttttttttttttttttgtatttttagtagagatggggttttgccatgttggccaggctagtctcaaactcctgtggcctcaagtgatccacccaccgtggcctcccaaagtgctgggattacaggcaagatgctcaaaatcttttatcaattgttgaccctttaaaatccccacaatatatcttgacggtaaactaaaatggtatttagtttataatggaaagcattaataggatatgtagaatattagatttagaacccgggcgtatgaatcttagcataatgcttcctgggaaattctgaaattgattccatttctgccgttacaaacacacacgaagttcctagttcactgggacttcctgatttgttcttttagcttgctccttctcacctagaagctctgtttatttctgagcaaccctggggcttgtctcataggacaggatttatttatctcatcaaggctgagtgtgccttaggaagtcataaacataaaaagagaagaaaaaaaaaaacagaatatgagagttgtaagccttcctactgctgagatactaagttacaatgggttgaatttaggatatgcaatagtctggcttctaaaccctgatagtgtttatttatagcaggttagtggctgtggggtagggaggttatagaggattagcgtctcatggaaaggctcttatacttaaaagtggtaccactggctcagggcagtttcagagggtatgtgccgggaacagggatattaattgcggagctggctggcctcgtgctggaagagatggtatcaaatagagcagcttaggccctgctgctgctgattttcttttttacactgatgatatattagttactttagtattttgtgcaaagctatacaaatgtgtgtgaaatcctttgtcatcccccattctgctggaaagtgaagtaaaaagctacttgtattctagcaatcgtagcaatttttggaaagtttaaattattggggtaaattcctggtattttttgtttgttgaagcttgatagagccccttgtgtgtgtgtataagaaataatagcataaagatttaaaaatagtctcggaaaaaaataagttgcatacatgttatttgtcttaagtgctatggtgtcctaagcacctctgtatgaggaaaggagtaaatctgttattttcctttatactgagaacgattgttttgcattgaacctttcggttatgaaatacctggcttcactacttaaaaaattaactagcagtggataacagagtagctttgctggcaccgtactagtctagtagcacagtggacccaatggattcatctgtcatatctgtcatattactgaacattatacaaactcttccctaaactaagggtatttttaatgcagagctttgatgccatgtaaaatttcctcatgtaacacaaatgatgtgcttattctgattacagttttatttcatgggtccctgtcaatttttataatgataatgtcacagtaataacatggttaatgataaatgagaattaaggcatgtagcatttcctattacccaccttacaacatacacatttctgtagtttttttcagtccagtggtggagaaggtgggggatatacaggaagccataactcttatgaattatttgaccagtttttcattccatatctcatagataattgtagagtataggacctgtatccattgtacctgatacaacagatacatgtaaagcagatagggaggaaacagtataatttttatcaatactgacgctagagtttttccataggaagaacttatgaacagtaatttgattgaggtggaggttctttttggtacccaaggtactaccatgattttacgtataaaatataacttttgccccagctactaaattcaataaacaacatctctagacctgccgtggtggctcacgcctgtaatcccagcactttgggaggccaaggcaggcgaatcacctgaggtcaagaattcaagaccaccctggccaacatggcaaaaccctctctactaataaaaatacaaaaattagcagggtatggtggcaggcacctgtaatcccagctactcaggaggctgaggtaggagaatcacttgaaccccggaggtggaggttgcagtgagctgagattgcaccactgtactccagcctgggcaacagaacaaggctccatctcaaaaaaaaaaagtaaaataaaataaataaataaataacatatctccaggatagacacagtaagaattgattggctagttttctttacccagtttaatcatataggcatgctattaggaaaaatatgtaaaatagacttaaagatgtagaaagcattccttaaattattgaaagtcatattttagaaaatgaaatgtatgtagtggatttaattgtaatgtctatatgtctgtttttaaaaatattttttcctgtttttaattaacatcagaatttaacaactcttcatttctcaattattgatttttgttttcttctaggggccaccttatcttagttccagaatttagtcttcctttggaatactacctaattcccttccttatcatagtgggcatctgtctcatcttgatagtcattttcatggtaggtacattaacttttaataatttttaaaaaatagtatggatgaatctaaaaacattgtattgagtgagagaatttaaacaatgtgtacataaaagagtacatattatataaattcatttatgtgaagttctagaaaaaacaaagataatgtgaataggaaaaagtaagaatggtgatttcctctgccgcggggggttagagagaagtgatcgatttactgaaaagagtataagggaacttttgggggatgacagtcgtgttctgtatcttgttagagatgtgggttgcaaaaatgcatggcatttgtctggattcacaaaattaattgtgttgtacatttcattatatgtaaattttacctcaaaacgaattgcaaaaaaaatttactaaacctagtaatgacatgcatgccaaagtattttagggaaagtacactgatatctgcaacttactttaaaatacactgtaaaaaaataagaggaaaaagtaagatgtattgatgggtaaatagggttgtgacaaaaagcacagtaaaatgttaattatagaatccaggtggatatatgggtatttattataaaattcaactcttctgtatgtttgaaattttttatattaaagtatgaaaaaaataatgtgagagcttaaggttaagggggaatgacatattatttctccataacggtggttatcaaaatacggttacaagactattagtaggtctgcaagctcaaaattattatgtaataatattaaggtagtatttcctttggtcactctcattctcttagaggtgtacagtaaaaatttctataggctacatgatgtgcaatatcaaaatatttgaaaacagaagcagtttgaaaatccctctgtattctatttggacagatattaaaatagatttgcaaagatataaaacagtcccactcttcttgccaacttctttgtcataaagaatacatattttcatattcagtacatttattattgtattgaattcatagattagtttaaagattaaatgctatctttaaaatgttcagtcttcctatgatgctatggtatttttaaatttacttatttaggcctttccatcagttaaataatttttttcctataaatgttttgcatgtctttttttagacttattacacatatagtaagtttttcttgctaccaaaaaaaggatttttgaaattatattttttaattggctattcttataattgagtattagagcattgctttttattaaacatttaattttggaataatgttaagatttacagaaagtttgcaaagaagagaattcctgttcatccgtcatctactttcccgcattgttaacattttacattgccaggagacttttgtcaaaactaagaaactgacattggtacattactgttaactaaactccacattttggattttaccaggtttttcattaatgtactctttctgttccaggatcaaatccaggataccacattgtatttcattatcctgtcttccctctggtctatgacaattttgctgttcttgtttttcatggccttgataattttgagtactagccaggtatcctgtagaatgtctctcaacctgatttttttctcatgattagacaaggctacaggtttttcaaaagagtatcacagacgtgaagtgcccttctcatcacatcatatttgagggtatatggtatctgtagaacatcactgatgatgctaaccttcatcccttggttaaggtagtgtttgctgaatttctccacttataaagttaatattttttcctttttctactcttttctttctttagaagtgaggcactaactatagcccacccttaagctgggaaggggagggcatatctgcattatttgaaattcttctacaaggaagatttttctcttctcagcatttatttattcaaccactttcattagtatacactcatgtatatttattttacacttaggttataatccagtaatattcatacattatttttgttttttgattgtttttaaattgtttaactttggctcttgtcatgctggatcttgtgttcctttgattcaacgctatcccttttttttattattaagcacttcttgactactatcttgtactataagatgcttcaggttcatcttatattttttatatttttcttgtcccagccctagcatcagaccttttcccagggagtcatgttttttttaattagagagctatatttagaaagcaaggtttggtcaggggacattatagatttttatatattaatcatgtaatcatgtcattaatcatgtaatcatgtaacaaattccattatggtaatttgtttgttgattcccttggggtttcagcatagaagcaagaaagtagagagtaagttagaaaaccaaaaaacaaacaaacaaaaatacccttggaaaaccaggagtacaagtaaataaccttatacagataaagaatatagactaaaaacttaaaataaacattattaaatggtgaaatgctagaagccttcccttgaaactcaagaacagcggggccgggtgcggtggctcacacctgtaatcccagcactttgggaggccaaggcgggcggatcacctgaggtcagcctgagttcaagatcagcctggccaacatggtgaaaccgcgtctctactaaaaatacaaaatttagctgggtgtggtggcaggcgtctataatcccagctactcgggaggctgaggcaggagaatcatttgcacccaggaggcagaggttgcagtgagccaagatcacaccattgcactccagcctgggcaacaagatcgaaactccatctcaaaaaaaaaaaaagtcaagaacaggaaatggatgtctattgttgtacctcctttaacattgtgctatattttttgggaaaataaaggggaaaaagcagtataagtcgtggacataaatcagatttttatttgcttgacttttttaaatgggtactggattatatgttttttatctgttgtaataataattggtttttctctcttttatcatgtttgtgttgggttacattaatatgctttgtaaattttgaaattccttatattctggggataaatcctgtttatgatgtataaattttgtccttacatctctggattattcagatttctaatatagattaattttttatacttggatatcgatgtaaaaattctagaatattagcaatctggatattcaggtaaaagaaaactttggttttatggggccaccttgacatcaaaactagacaatcccttgagcactgttggtaggaaggtagaatggaacaaccactaaagaatacagtatggcaactcctcaaaaaataaaacatggatctggtaattccacttctgggtatataccaaaaagaattcaaagcaaagactcgaatagatatttgtacaccatgtttatagcaatattatttacaatagccaatgatgaaagcaacccaagtgtacattgatggatgaagggataaacaagatgtggaatatgcatacaatggaatattattcagtgttattaaggaaggaaattctgacacatgctaccacatagatgaaacttgactttatgctacgtgaaataagccagtcacaaaaggacaaatactgattctacttacacgaggtacctggagtagccaaattcatagagacagaaactagaatggtggttgccagggactgaggggactgaggaagggggagttattgtttaatggatacagagtttcagcttaataagatgaaggctgtgaatggatggtagtgatggtagcacaacagtatgaatgtacttaagccatcgaactgtacacttaaacgtggttgagatagtaaggtttatgttgtgtatattttactgtaattttaaaattaactaggcaatcaaaattatagcctcataaaactaagctttctcttactttctaaaatagttttttttttttaaagaaaattggggttatctgttacttgacatttttgtagaggatgcctataaaatcatctaggtctagtgaccttctcatagttatatagacattcagatggttttccagttcctactaaagtgtatttctaagaaatttcctgttttcaagtgtagtggaataaagtgatttataatattcatatactcaaataacaatttaaagagaatttctactatttgtggaataagttatctttattcatatccatctgtgcctttcacaatgttgtcagaaattattgccttattagtctttcaaagaagtaggctttcattcaataaatatttattctgtacctatggtgaactaggcaccgttcaagggtctgcagattcatcagtaaacaaaatcggtaaaaatccctgatgttaagtagcttacattttagtagaacttaatgctaaattctttactttctttatttttatcatgaatttttgttcttatcattttctttcttctaccttgtctggttgtatgtctggttgttgattcccttggggtttcagcatagaagcaagaaagtagagagtaagttagaaaaccaaaaaacaaacaaacaaaaatacccttggaaaaccaggagtacaagtaaataaccttatacagataaaaaatatagactaaaaacttaaaataaacattattaaatggtgaaatgctagaagccttcccttgaaactcaagaacagcgggttgtatggcttttctttttctagtttattcagctaaatgcttatttttttctttctagtatatgcatttaggttataaatttttctacaacaataactttagctgaaacccacaacttttgataaggaaaattcttactttcatttgacttaaatttaaaagtttttcattttaatataggatgtttctttatcactcttaatgtttcaatccatatgaagggggaactctagttactatgactcttagctgttctctgcccatttactctttccaccttagaggagataaagtgtcttatctgacactttaggaagggcaaattgggcacacttggttcagctccaccatctttgttttgttattaacctgactttgggacatagatgttcattcagctcctccagggttagggctggttctgcaattctgcggcagagtgaagggaaggcctacttcattccaaagttgtctttgtctatatctaagtggctaaggcaacctaattctattgctcaataaaaaattctgtttcttgcactgcacgggggtcatgctaatcttctctgtatcattccaattttagtatatgtgttgctgaaacgagtacagaaagttctgtttctgtctccagtgagaaacacttcctccttctggccagttcatggtcttatttctcaagttatttagaatccaggtggcaaaggggcgcatgctgattataacaccccctcagaaacgtagatattcattatgatttgttctgtgacttatgaattacttcagtacagttttacatttccaaaatatgtatttttttctattgatttctaattcagttgtgttgaggtaagaaaacattgtatgttatggattctttggttattttcaaaaacctcctttgtggcatggttttctgattaaattttgtaaacattccatgtgtgtgaaaagatgtgaagtgcagttctatgtccattagttcgaacttgtgaatttgttttgtctagtcttttaacagctttattgagacataattaatgtaacttaaaattaactcatttaaagtacacaattcaataattttaagtatcttcacagaattatgcaaccatcaccacaatcgttaataattttctgcgttctttttctattttctgaagcagtgctaagaatagaacaatattatgagccacattttattgtaattttaaattttctggtagccaaatttaaaaggttaaaaaaaggaaacagatgagattaattttaatactatatttatttaactcaataaatctaaaatatataacaacattcagttaatacaaatatatgatatttttatattctttttgtatagtgtctttgtaatctggtgtctattttatacttacagcacatcccagttcagactatctatgtttcaagtgctcagtagtcacatgtacttggtggctaccatattggacagcacaggtctatagtcttctaaattttttgtgtgcttaagctataagttgccgagcttgtgaatgtatgtatttcactattttgtttctagatgaggtgttgtttttattgttgtcatgactctcctaatgatgctttttgccttaaattctattgcttgatattctagcttttcttttgcttaatattttcatggtagatctttatccctttattttattttgtatgttaatttggttattttatgcagggtcttgctctatcacccaggctggagtacagtggcacaatcatagctcactataacctcaagtgatcctcccacctcagcctcccaagtagctgggactagaggcgcacatcaccatgcccagctaattgttttttttttttttttgtagagatggggcctctctgtgttgcttaggctagtctcaaactcctgggctcaagcagtccttcagccttggcctcccaaagcactggaattacaggtgtgagccactgcacctggtcctatccctttattttttacttttatttttgtcctaatgtatcattcagttttaatcttgtgtcttgtaaatagcatatgatcggaatttttttcttatacaatgtgatacactccttttgaaaacggtggatttaatccatttaacatatattgtgatcacacatgtatttggattaatttctattgtttactttttattctgtattttcttctgtgtaaatttgcaataataacttttactttctttttcctattgatatgaacatttgcattatattgctgttcttttagtggttaccattaaactttaaaaaaatttatggaggtatgatttgatataataaattacacatatttaaattgtacactttggtaagttttgatgtaggtttataagcatatatatcacttatgcatatgtatatcacatatatcatccatatgtaacagatatgtatgtgtatacctgcgaaaccaccaccaccacaatcaagataatgaaatattaaccaccctaaaaagtttggcaatgccttccttctaccccttccaacttttccttcatcctcccctcactacccttctccatgcccagacaactacaaatctgattttagtcactatagattactttgcattttctacagctttatataaatggaatcataaagtctgtactcttttgtgtctgtcttctttctgtcaccgtaattattttgagatttgtatatgttattgagtgcatggattgttcattcctttttattgctgagatatattccattgtgtgaatataccatgatttgtttacccatttacctattgatcaacatttgggttgtttctagtttttggctattacaaataaagctgacatggacatttgttgtatggaaatatgctttcatttctattgggtaagtatatctaggagcaggacagttgggtcacaggataaatgtgtgtttagattcataagaaattgccaagctcttttccaaagtggttgtaccattttacaatcccaccagaaagtgtatgagagtgccagtccctccacttccgtgccaacgcttggtatagtcagtgttttacattttagtcaccctaataggtatattgtattatagtatttatgatttgaatttttgttttcctattgactactagtagacattgcacatctcttcaagagcttatttgctgtttgtcttgtatagtgaagtatcttcaaatattttgtccattttctgttgggtaacttgttttcttattattgagttttgagaggtttttatatatattctggatacaaatcccttatcttgtatacaatttgcaaatattttatttcagtctgtggctcatctgtatttttcatttttaaattttatttatgtattcatttacttatttatgttttggagacaggccctcactctgttgtgcaggctggagtacagtggcacaaacatgagtcactgcagccttgacatcctgggctcaaatgattctcacacttcagccgcccaagtagctggaactacaggcacacggcaatgcgccaggctaatttttttctttttagagatggggtctcactatgttgcccaggctggtcttgatttcctggcctcaaacagtcctcccacttcagttgtcttttatttttttaacagtgccttttaagcagagaagttcttaactttgacatagtcaaatttttcctttacagagggtgtttttggtatttggtttttggccctgtgtactttctttttattcttgcaagcatagcaatttatagtttaaaatattttgtacattttatccggcatttctgaatatttgtagtgaaggtgttctgcattatttctgcctgttattctgtagtaactaataagtgtatgtttgaaatttttatcagtttgtaatatataggaatatcaaccttcccattctttttttttttttttttttacccattggagtctttataaaatctatagtttaccatttgtatttttgcaagcaaacagttatatgatttttataatgtctccgtaggtaattcaaagataatcaagatcaattaataaaaaattcaaggggtaattcatgggttaactaatcactaatgtaatttaatgctttaattaacaatactattgcaattagaatttaaatgaattgaattgatttgcagtagctatccagaaacttaaaagatatttgttattttaatggtcactttctctttgcacatttaatatctgactcctttttttactcttttatttttagatcacaaaatttgtccaggatagacatagagctagaagaaacagacttcgtaaagatcaacttaagaaacttcctgtacataaattcaagaaaggtaagtatttgttttctaaataattatccttagtttatttaagactgcagggtgactatactctttaaaaaaatttttattattattattatactttaagttctagggtacatgtgcacaacgtgcaggtttgttacataggtatacatgtgccatgttggtttgctgcacccatcaactcgtcatttacattaggtatttctcctaatgctatccctcccccagccctccaccccccaacaggccctgttgtgtgatgttcccctccctgtgtccatgtgttctcattgttcaccttccacttatgagtgagaacacgcagtgtttggttttctgtccttgtgatattttgctgagaatgatggtttctagcttcatccatgtccctgcaaaggacacgacctcatctgtttttctggctgcatagtattccatggtgtatatgtgccacattttctttatccagtctattattgatggacatttgggttggttccaagtctttgctattgtgaatagtgccacaatacacatgtgtgcatgtgtctttatagtagcatgatttataatcatttgggtatataccctgtaatgggattgctggatcaaatggtatttctagttctagatccctgaggaatcgccacactgtcttccacaatggttgaactaatttacatacccaccaacagtgtaaaagtgttcctatttctccacatcctctccagcatctgttgtttcctgacttgttttttttttcttttgagacggagtctcactctgtcacccaggctggagtgcagtggtgcgatcttggctcactgcagcctccgccccccaggttcaagagattctcctgcctcagccttccgagtagctgggattacagatgcctgccactgcacccagctaatttttgtattcttagtagagacggggtttcaccatcttggccaggctggtcttggactcctgaccttgtgatccatccacctcggcctcccagagtgctgggactacaggtgtgagccactgtgcctggcctgtttcctgactttttaagactatactcttatactaccttctgtgtccctaccataaactatgcctaacgctaagtagactttcagttaagaatgaatgaataaataaatgaatgaatgaatgtgagagatgatgttttgctgtgatctggtgaaagcaggagaaggatgcacagtctgcagagaatttaaaaacaataattaaactaaccaaaatgcttgtaaatattatcaccatgtgccattagttctaaacaatgtcagtagataaaatatttttctgtaccaggtgaactactctcacttaccttcctcctattctgtctcccacaatataacactgtatagtgttgtattaactaaacacataggtaggtagctgttatatatcatcacttatatatatcatcttaattttcatacttctatgaactgtatactcttattattttccctttatagatgaggaaaaatcgggtcagggacattaggaattttaatatcacatagccagtattgacagaactagaggagaggtgtgactataataccatagccaatgtaagtttcccctatagtatagtttctctgtgatttagtgaccttttagtgcagatacctacttgataaatccttttggctggcacttcccagacttcattttcatataccagtaaaaatattctgttttttaattcagcagtgaaaaagtgtagggagtggagggagaaaatagagaaaaaggcaataaaacatagttctgccacatttttatttttcaaataataaaatgttttataaacctgccatttaccattaacattaaaaaatagaacacttaacaaaaaaaagtaggaaaaagaacatcatgttaaaataaagaaatgaatagacatttctaaaaatgcactgcattttacatttacattattattatacagtgatttacattatcattatacagtgtggattagttaatagtttttttttgttttgtttttaagagatggggtctcactgtgttgctcaggctgaacttgaactcctgagctcaagtgatcatcccacctcagcttctcatgtagctaagactataggcatgtgccactgggcccagcctggattaaagatttccacatagaccagaactagtttgaagattaggaattacttttttaggcttcattttgtgtgtttaaaaatatgtttaaaatggccaggcacggtggctcacacctgtaatcccagcacttagggaggccaaggcagacagatcactaggtcaggagatcgagaccatcctggccaacatggtgaaaccccgtctctactaaaatacaaaaaaattagccgggtgtggtggtgcgtgcctgtagtaccagctactcaggaggctgaggcaggggaatcacttgaacccgggaggcagaggttgcagtgagccgagatcacacgactgcaatccagcctggtggcagagcaagactccatctcaaaaaaaaaaaaaaaaaaagaaaagtttaaaaaatggtgatactgtcctgggtttaaagggaaaacatgtcattggcttttcctctgagtaagatgggtagctgtagtaggatttggaacagaggagagagagaatgtctcagttaactgttaaaaggatccttctgctgacattaagaataggttattagatggcaaagggtataaacagagagaacagacaggaaagttattgtagtaattcaggtgtgatataaatgtggcttggggtgatatcagtggaggagaagaaatctttaaatactggctgtatctggagatggaatacacagaatttactgatggactagatattggaagaggagacaaggatgactccagattttttggtctgaacaacaaaatggatggtctatttaaggacagtccttaaatagcaataaggatggttaatgtatgagagagcaggttttaggagggaaattggaagattggtattgaacatatggaatttcagatgtctattagatgttagaagtttaagagagaggtctgaactggaaataccagcatgaaaatgtatttatatcattagactggatgagattaccaagagagtgcgtacagagagagagaataccaaagacaccgtggggcattccatcattcagtagaagaggaatcagaagtggcagcagtggagactgagaaggtgtgaccaattacataggaagaaaatcaggagagtgtgatttaccagaaacccagtgatgcaaatctatcagggagcaaggaatgataacctgtgtcagtgctgctgaacataagtaagatgagagctcagtattgaccactagagactattgatgatcttgatgagcagttgacagagtggtcaggccaaaaatctgattgtagttgatttaagagagaatggtggaaagagaggaattagagatagtttttgtaagaagtttaactaaaaaagggagcaaagaaatggggtcatagctgctgggggaagttgagtcaagaaataacagcatgtttgtttgctaaaggaaattgatgtaggtgacagatgggagagtccctgtaatgttcttgagaaggcaagaggagattggatatcttgcacaaaaaggtgaactggccttaggtagtatcatagagacttgagctaagggaaagtagaatatgtgggtgaaaaatcacagtaggtgggtatttgtagtggtgagtctgtggaaatgttctttgctttaatttctctcaggtaggaaatcaccaactgagggtgaggacagaggaggaggtattggagcttttaagaacagaggtataaaatactattattccaggagagtaggaggaggaatggactagggaaatataatatggttgcttggcagcctgaacccattttgaacccatcagcataactgtttttctctatggagtggtgtttatcatcacttttttcaaaatgtgaagtataacatttatacagaagagtatgtagaatacatatttctagaatcatccagttcaagagatagaacattactgccaccccaggagctgttatgttcccttctagataaataatcctttcttgtcctctggaggtaatcactatcctggtttatgataatttcactgcctttctcaagttgtaccacatacgaatgcatacctaaacagttggcttaattttgcctatttttgaattgtatttttcttacctctgattaattttttaatgaaatttatacacttagttgcatttaggtatagttcatttactttcattctgtcttttaaagattttacttacccactttactgttaattgacattctttttttttcagtttagggctattataaatcatacttttgagaatatacttgtacatatatcctggtgcatatgtccatgaatttctttagcatatatacctagaagtagattaatttgatcatagtatatagctattttcaattttattgggtaatgcaaaatcatttccaaagtgattgatggtaccaatttctactctcaccaacagtctataggagttcctgttgttctatgtatttatccaatactttgtactgatggacttttaaattttagcattctggtgggtttataactcgttgttttactttttatttcccttcttgcaatgaggttaaatatctgttcacattatttgccagttggattttcactttcacgaagtacctttcatgatatatgcccgtgtgtctgtttcatatatgggaggaattctttatatgttcctacaagcctccagagggaggcgtagagtatggcaatttagttcttcaataattcttgtgttttaactgtctttttctagtttatggaccagaattcttgcctttcatggtagtattcttctatttttgttttgttttgtcttgatttgtttttttgaggcggagtctcgctctgtcccctaggctggagtggagtggtgtgatctcagctcactgcaagctccgcctcccgagttcacactattctcttgcctcatcctgccgagtagctgggactacaggcgcccgccaccatgcctggctcctttttgtatttttagtagagatggggtttcaccatgttagccaggatgatctcgatctcctgacctcatgatctgcccaccttggcctcccaaagtgctgggattacaggcgtgagccaccatgcccagcctcttctgtgtttttagagtacgttttctatcccaagatcatacagatgttattttatattaccttctgaaagctttatatttttgtcttttgtgtttaatccacatgaattgattgtgtaaaactggagtccaatttaagttttttttccagtttgatattttatataagggtatccagttgttccagagctaattattgaaaatacactgttctgcagtgtcacctctgatgtaaattaaggtccagatatgtgtgggtttgtttctggatttctcttggttttattgtttaaccgtttatcagtatcacactgtttcaattacagtaggttcatggtaagacctgatagagctagtcttcccactttgttttttttcaatagtgtttacctatgtttaacactttgcctttccacttaaaggtaaaaatcgaattgtcaaggccaccccacctccaaatatatgcacaagtgattgtattttttattgtagcagaatacacacagcataaaatttaccattttaatcattttaaagtatcttcatattgttatgcaaccatcaccaccatccatctccagacttctttatcttcccaaactgaaactctgtacctgttaaacagtaactccccatttccacttccccccagccactggcatccaccattctacttactgtctctgaatttgactactgtaggtacctcacgtaagtggaattacctgatatttgtcctgtttctgacttatttcacttcccataatgttttcaaggattatcgatgttgtagcatatatcagaatgtctttactttctctggcggaataatagtctgttgtgtatttttaccacattttgtttattcattcatctattagcggatacgagttggttacaccttttggctattgtaaataatactgcaatgaacattgataaaaaagtatctgtttaagtccatggattcaattattttgggtatataccaaggagtgatattgtttaactttatgaggaacctggatactgtcttccacagttactgtaccattttacattcccagcagcaatgctcaagggttcatatttctccacatccttgtcaacacttgtattctgttgttttgttttaatatagctatcctaatgggtaggaagtggtaccttaatgtggttttatttgcatttccctactgactaatgatgttgagcatcttttcttgtgcttattgtccacttggatatttcctttggcaaattatctgttcaagtacttttcttattttcaattgggtggtttatcattttgttcttgagttataggagttctttgtatattctagataacatgatttgcaaatattttttcccattctgtcagttgtcactttcttgataatgtccttttatgtacagaagtttcaaattttgatgtagtccaatttaccttttttctttttttgcttatgatatgaagcataagcaaaaacctttttttttttttttttttgcttgtgaaggaaattaaagaagacctcaataaatggaaaagcatcccacattcatggattgaaagacttaatattgttaagatatcaagactacccaaagcagtctacaaattcagcacaattcctatcaaaattccaagaactttttttgcagaaatgaaaaatttaaaaattttgattaagtccagtttttaccttatgtcatatctaagaatacactgtcaaatctaaggtcataaagatttaccctatgttttcttcaaagttttatggttttagcttatatttaggtcttttatcaatttagagttgattttcatatatagtaaatatgaggtagggctcccggcttatttttttgtatgtggaaatccagttatctcagcaccatttgttgaagagactgttttctcattgaatatcttggcactctcatcaaaaataagttggccatagatgtatggttttatttatggactctcaggtacattcctttggtctatatgattatccttatgccagtcccacactattttgattactctagttttgtagtaaattttgaaactgagaattgtgagtcttccacatttgttgttgttcttcagtattttagctattcagggtcctttgcaattccataataacttgagaataatttgaggatagaactttatatttttgcaaaaaaagttatagaattttgatagggattgtgctaaatttgtaggttgctttgggtagtcttgacatcttaacaatattaagtcttccaatccatgaatatgggatgcttttccatttattgaggtcttctttaatttccttcagcaatgccatgtaattttcagtctataagtctttcatctccttagatttatttctaggcattttattgttttagatactattataaatagaattcctttctaaatttcttttatggattgttcattgctggtgtggagaaacacaactgatttttatgcattgatcttataacctacaactttgatggatttgtatatagctctggtagctttcttgtggattcttggggatttcctatatagcagattgtattagcctgttctcacactactataagaaatacccaagactgggtaatttataaaggaaaggttttaattgactcacagttccacattgctggagaagcctcaggaaacttctaatcatggtggaaggcaaaggagaagcagacatcttcatagggcatcaggacagagtgagtgcaagcaggggagatgccagatgcttataaaaccatcagatctcgtgagactcactatcatgacaatagcgtgggggaaactgcccccatgatccaattacctccacctggtcctgcccctgacacgtggggattatgtgtattataattcaagatgagattttgggtggagacacagccaaaccatatcacagatcatgtcatctgtgaataggtgtagttttacttctttctttccaacatggatttatttcattttcttgtgtaattgcttatagaacttacagtacaatattgaataatagtggtgaaagtggccattctactttctttctgattttaaggcaaaaatttgcagtacttcaccagtgagtattttagttgtgagttgttgttgttgtttttaataaatgccctttatcaagttgatgaagtcccctactatataggttcatttttttggcatgttgaaatctacttgttccagcattatttgttgaaaagactgtcctttctcccttgaatcacctttgctccactgttagagagcagttgactatatttgtgtgagtctttttctggaatctctattctgtcccatttatctattctttcaccagtaccacaccgccttgattactgtacttttgttttgttttgtcttgaaatggagtcttgctctgttgcccaggctggagtgcagtggtgcaatctcggctcactgcaacctccgcctcccaggttcaagcaattcttctgcctcagcctcccatgtagctgggagcacaggcatgtgccaccatgcctgtctaattttttttgtatttttagtagagacagggtttcactatgttggctaggctggtcttgaactcctgacctcaagtgatctgcctgcctcggcctcccaaagtgctgggattacaggcgtgagccactgcaccagctgattactttatagtaagtcttaacattgggtagtgtcagttcattgactttgttacttcagtatggtgttggctgttttggtgttttgccattccgtatatacttgtgaactagtttgttggtatccaaaaaaagaaattgctgagattttgattgggattgcattgaatttataaatcaagttgggcatcccacttggtcatggtgtataattttttatatacggatattcaattttctaatattttgtttaggatttatcatctatgttcatggtagttactagtcagtagttttcctttcttgtgatgtctttgcctagttgtgagatttggataataactggcttcacagaatgagttatgatataccctctgctgttttctggaagaaattgtaaagaatttgggtaatttctttcctgagtgtttggtagaattcaccagtgaacctatctggatatggtgcctgctgttttggaaggttattatttatcggttcaggttctttaatagacctaggcctattcagattgtacgtttctttttgtgtggctttcggcagattgtgcctttctgagtaattggtacatttcatctgttaccagatttgtaggcatagaattgtttagtattcctttattattgtttttatattcataggattaatagtgatgaccacttttctaaaatttttgatattaataatttgtgtcttttgtctctttttcttggttcacctagctagatatcgatttcatttatcttttcaaagaacaatattttggttttgttgattttctggtgtttttttggttgtgtgtgtgtttttgtttttttggttttttttctggggggacaaggtctcactctgtcatccaggctggagtgcagtggcacaaccatggctgactgcagcctcgacttcccaggctcaaccaacccttccacctcagccttccaagtaactggaactacaggtgtgcaccactgtggccggctaatttttttatttttatttttttagagacagggtctcactatgttgccaggtctgaactgctggcctcaagtgatcctcccactttggcctcccaaagtgctgggattacaggcatgagccaccacacccagcctgattttctgcttttacttgcattgatttgttcaatttttatttctttttttctgctactttgaatttaatttgctctgtttctagtttcctaaaggtaaagcttagattattgattttagctcttttttcttttctaacatatatatattcagtgctataaatttccctgtactgctttcattgcattttacaattttttattgatatataatagttgtacatatttatggggtacatgttatattttgatacatgcatacaatatgtaaggatcaaatcaggataattgggatatttatcaccccaagcaatgatcatttttgtgtgtgtgttgggaataattcaaagcttctcatctagctatttgaaatacataactttattgttaactatagttgccttaccatactatcaaaaactagaacttattccttctaactgtttttgtagccagtagccagcctcccttcactgctcccttccacccttcccagcatctggtaaccaccagtttgctctctacctccatgagatcagttttcttagttcccacatacgagtgagaacatgggatatttgtctttctgggtttggcttatgtcacttagtatcatgtcctctagttccatccatgttgctgcaaataacagggtttttttttatggctgaatagtattccattgtgtatatatgccacattttctttatccagtcatccattgatagacacttaggttgattccatatcttggctattgtgaatagtgctgcagtaaacatgggagtgcagatatctcttcaatatactgattttcctttcttttggacacatatccagcaatgggattgctggatcatatggtggtttcatttttacttttttgaggaacctcaatactgttttccttagtagccatactaatttatattcccaccagcagtgtacgagtggtcccctttctcccgccacatcacatgttcctcttgcgtagtacaatacaatcatctcttcccagtagtatccaaagtcttaactcattccaccatcaactcaaaaatccaaagtctaaagtcttatctgagactcaagacacatttctttccacctattagcccgtaaaatcaaaaacaaattcttaacttccaagatacaacagtggtgcaggtattaggtaaacattcccaatccaaaagggaggaattggccaaaagaaagggaaataggccccacacaagtctgaaacctagcagggcagacattaaagtttaaagctccaacataatctttgactctgtgtcccgcatccaaggcacactggtgcaaggggtgggctcccaatgccttgggaagctccatccctgtggctctcacaggttggagtctggtgtctgtgccttttcaatgctgagggtgcaagctgctggtggctctacccttcttgggtctggaggatagcagtcctgttcccatagcttcactagactgccctggtagggagtctgtgttggggatccaaccttacatttcccctcaatactgcactagcagagtttctgtgtgggggctatgtcctgggacagacttctgcctgggacccaggctttctaatacatcctctgaaatctaggttggaacctggcaagccttctttccttttgaatgctgcacacctacagccttaataccacatggaaaccagcaaggattacagcttgtgctctcagagcagtgccccaaactgtaccaggggcccttttgagctgaggctggagcagccaggatgcagggagcagcctcttaagatggtgcagggcagaggctccgcaggcctgacccactaaaccattctttcctcctaggcctctgggcttgtgatgggaggagctgccttttgaggcttttttttttttttaaattgtcttggatattagcacttggctcttttttagtaatgctaatctatctagcaagtggttggttcacagcccacttgtattcttttgaatgctgcacacttacagccttaataccacatggaagccaccaaggattacagcttgcgctctccagagtagctattgtaaatgagattactttcttatttttcagattgtttgctgttggcatatacaaatgatactgatttttgtatgttgattttatatcctgcaactgtactgaatttgctatattagttctaacagtttcttttctttcttcttttttttttttttttgagatggagtctagctttgtcacccaggctagagtgcagtggtgtgatctcggctcactgtaacctctgcctgccaggttcaagcaattctcctgcctcagcctcccaagtagctgggactataggtacccacgaccacgcctggctaatttttgtattcttagtagagacggggtttcaccatgttggacaggctggtctcgaactcctgacctcaagtgatccacccgcctcagcctcccaaagtgttaggattacaggtgtgagccaccatgctcagcctctaacagtttcttgatggagttttctttggtttttaaaatatacaatcatgtcatctgtgaacaaggttaatttgacttcttcctttccagtttggtagttttcagcagtgaagccatccagtcctgggcttttctttgatgggagacttttaattactgtttcagtttcattacttgctattggtctgttcaggctttttctttctttatggttcagtcttgacaggtgtacatgtctatgaatttgcccattttttctaggttatctaatttgttggcatataattattcataaaatctctgatgatcattatattctagggtattgattgtaatttttttcatttatactttgagtgttttctctttttttgttagtctagcaaaaggtatgtggactttatcttttcaaaaaacaatttttttctttcagttatcttttgtatttttcagtctgaattttatttctgctctgatctgtattatttctttctactaattttagattttgtttattcttgtttttctagttccttgaggtggattgttcagttgtttatatgaagtttttctcctttttgatggaggattattgctatgaacttcctacttagtattgcttttgcttgtcccatagattttgatatgctgtgtttccattttcatttgctcaaaaaaatttttagatttcctttttaatttctttattgacccattttttatttaggagcatgttgtttaattttcacatatttatagttttcaaagttccttttttttttttcctgaggcagtgtctcactctttggctcaaggctggagtgcagttgcacaatctcagctcagtgcagtatccacctcccaagtagctgagagtacaggcatgcactactacacccagctaatttttttgtagagatgaggttttaccatgttgcccaaggctggtctcaaactcctagactcaagtgatctgcctgcctcagcctcccagattgctgggattacaggcatgagccaccacacctggcccaaagttcccctttaaaaaagaataaaaatctagttttattctgctgtggtcagaaaagatacttgatacaattttgacttttttgagtttgctgagacttgttttttctcctaacgtgatctgtcctggggaatgttccatgtgctgatgagaagaatgtatattccacagagctggatgaagtgttctgtaaatgtcagttatcattatatagtgattttttgggtctctttttaagtgtttgttgtttattttatctgatataaatatagctattcttgctcttttttgttttccaattgcatggaatatctttttccacccctttactttcagtctatgtgtctttataggtaaagtgagtttcttatcggcagcagatcattgggttctgtttttctattcatttaatcactctatgtcttttaattagaacatttagttcatttacattgttattattgataggtaagaacttcctcctgtcattttgttgtttgttttctggttgttttgtaactccttttttactttcttttctttctttctctttcacctttctttatgattgtgcaaatttctctggtagtatgttttaattccttgctgtttatttttagtgttacctattataggtgttttgctttgtggttactatgaggcttacaaaaaacatcttataagttattctgaatatatgagaactcaatgttgatcacaaagaaaacgacaaaaaactttacatcgtaatttcatcccccacacacattttgacctcttgttgacacaatttacatctttttatattgcctgacttttaacagattgttgtagtttttactttggtagatttagtcttcatactagagataccacagttacagtattagagtattctaaatttgtctgtatatttttaccaataacttttataacttcagatattttcttgttgcatgttagtgtccttttgttccagattgaagaactacctttgacattttttataagatgaattccttcagctttcgtttgtcttcagaagtcattatctctcatttatggttgaaggatagctttgctggggacactgttctcagttggcagtttttttttttcctttagctttttaatatgtcatcccactccattcaggcatgtatggtttctactagatgtccattaacagatgaattagagctctttatatgttatgcttcttttttttctgcttttatgctcctctttttgtttttgacctttgagaatttgattattgtatgccttgggatagtcttactggagtttaatctgtttggtaatctttgaccttcctatgcctggatatttatctttctatagatctggaaagttttctgttattatttctttgaataagctctgtaccccttgctctttcttaactatgtcttgaaggccaatgactcttaaatttgctctttttaggctattttctagatcttatatgtgttcttcctttttactctcctatgtctcctctctttatatattttcaaattgtctttgagctcactgattctttcttctgcttgattagttctgtcaaaaccctctcatgcattttcagttcagccaatgtatttcacagttccaagatttctatttttttaattttttaatctgtttgttaaatttttctggtaagtttctaaagtgttttactctgctatcttggagttccccaggtttctccaaaattgctattttgaattcttgatcagagaacttacacatcttcatctcaggttggtagggtgtcactggctccttgctttgtaaatttgggaaggtcgtggttccctgtttgatgttgtttcttacagatgtacatttatgtcttcatattgatttgttatttattctagtttttgctatctgcctttgcttggtctttcaggtgtcgtttgttgcattctcttagacttagatcactgccttcttttcagcactagatggcaccctaagcccaggtttgcctggctttcacaaacgttcggcgcactgaccatcttgggttaggggatgttccaaaggggattccctggctggggttggtggggaagggaattagctaggagtttgtgcgcagaggacccgtggaatgtgcctcctactgctgctgatccactgtccctctgatttggcatctcctttggctgagatgaagagcagccccaagtttcctttgctggagttgctagccctacttccacgtttgtccatagctgtcttcagattttctcccaacaggcactagcaatgcttcctgtgggttgaggcaggaacagctttcctgcatagtaaccctagacggtagggaaactggctgtctaccttagtctcagtttctccaggataggaaccgtaagtcttgggagacttttttatccagtgcctaataacttaagggaggggcatcatggatagagaagtcgaggggcatcatggatagaaaagtccattctctcttaatttttcacttttttgtgacaccaaggattgtcacagcctcagttttgagttctggaatattgatggtgataatgttgtcactgtatagttgtttttcattttctgtacgggaaaatcaactcagattgcttctactctgccattttggtaacatcactgcattttacaaattttgatatgttgtatttttattttcacttagctcaaaatattttaaaatttctcttgagatttcttctttgacctgcttgttactcagaagtgtgttttttaatcttcacatgtttgggaatttgccagctatctgtatttatatattattatatatttctagtttaactccattgtgctctgcatggtaatattgtaagacttatttttaaaaaataaagtatactttatgtcccagaatgtggtctctccgtggatgaatgttccatgtgagctggaaaggaatgtatattctatttcttgttggatgatgaagtagtgtgtatatcaattaaatccagttgactggtgctgctgttgagttcaactgtgtccttactgattttctgcctgctggatctgtacatttcagatagaggggtgttgatgtctccaactataatagcagattcatctgtttctccttgcagttctatcaatttttgccttatatattttggcactctgttattaggtacatacacattaaatattgttatatatatagttatgtatatatataattttttaaaattttttatttatttattttgagacagagtctcgctctgttgcccaggctggagtgcagtggtgcgatctcagctcactgcagcctctgcctcccaggttcaagcaattctcctccttcagcctcccaagtagctgggactataggtgcagaccaccatgcccggctaatttttgtattttttagtagagatggggtttcactatgttgggccaggctggtctcgaactcctgacctcaagtgatccaccagctccaaaagtcctggaattacaggtatgagccaccgtgcctggccatattgttattattattttttttttttttggagaattgatccctttattattatgtaatgcctctctatctgtgatgatttttcttgcactgatgtctgctctgtctgaaaatatgcttactctcacattttttggattagggttagcatgatatttttgtcaatctctttacttttaatctatgtgtcttaatttttttttactttattaaaatactgagttttatttcacatgtatatttttgcctccccaccatttccatgtctgaccaccactactactatgtcctatcataacattccatacatacttaaaaccaagcaaagggtggagttccatctttaaaaactaaacaggcattttgggcaacacattcttggcaatagagcctggacaacatttatcaaacacagtagggaaagttctcactgcattataaaaaggacagccagatatcaactgttacagaaatgaaataaaatggaaaatttttaacaaattgtttaaactattttcctaaagagacttcctccactgccagagattttgaataacctcctggtcagtcatccggaagcactcctcacataattgatgaactgcttgcattttaatgtcttctacagaactaggtccttttcgtgttttaggagttttttcctgttttttgaaagattcttgtccttttgatcttggtgttgatggttttcagtcttttccattctgatttgacttctgtgcatttttggctggagtatctcgtatggatttcctcactggtgctttttatccagtttcctcatcatcaaaatcatcatcatcgtcattttcatcatcatcttctgcatcagcagcaagttttacttttttctgtggaacttttctgccacctccgggggcagatcgctttccagataaacttgagtttcacatactcctcttcttcatcttctgactctgcatcttcctccacagctactaagtgctgtccactaatatgcactggctctgaagcacacttcaaccgtaagatcaccagtggtgttatttcaaggcccccagaaaccattggctgtacagacattttcaaagttgccagtgttactttaatcggactgccttcataattcattgcctctgtttcaacaatatgcaatttatcctttgctccagtccctgaaatcaccgttcttaaagataactggtgctcattttcatcattattcaccttaaagtgataatctttgtcggccttttgttgacaactgaaaagatagttctggggcctcagagggctcatgtccatgtccatcaaatcttccatggggtggtgacacgcacttaggtgggagagaaggtggacagagataaacgactgctgctccagagaacagccgcgcaggatggaatcacaccagggtatgtgtcttcatatttaaagtgggtttcttttcaacaaaatatagctggtcttattttttttatctgatccactctgacaatcttttgattagcatatttaggacatagatatttaaagtgattatgaatgtagttgggttaatatctattatatttatcattgttctgtatttgttgcccctgtttctgtttttctctttcaatcttttttcatcatttgtggttttaattaagtatttcataatgattccactttcctttcttagcatattaatgttatttatatgtgtgtatgtattttcttttttagtggttgccctagagtttgcattgtacatttacaactaatccaatttgactttcaaataacactatacttctttgtgggtagtgcaagttcccaataataacaaaatattcctaatttctaccctccatcccttatatcattgctgttattcatttcacttatatatgttatacattcatagcatacataattgaatatattattgctgttactattttgaacaaactgctatttgtttgttcacaagtaaaatcaagtaagaataagaaaagtagaagtttttattttacttttacttatttctcctccaggatgtttactttctttatgtagatctaagattctgacctatatcatttttcttctctttaaagaacttattttaacatttctcacaagtcagttctgtgggcaaaaattacctcaaattgtgtttatgaaagtttttattttttcttcacctttttttgcttgcattttttattgtagaaaaacacataacaataaatttacaatcttaaccatttttaagtgtacagttcaatagtgttaagtatatttacattattgtgcaaccaatctctagaatttttttcatcttataacactaagactctgtacccactaaatactaataattccctctttctcttctctccagcccttgctaaccacatttctgctgtttcttttctacaatttgactactttagatacttcatatgagtggactgatacagtatttgtccttttgcaactggcatattttgcttagcataatgccctcacggttcacctatgttgtggcatgtgacagaatattcttttatttttaaagatttcataatactacattttatgtatataccattttccttttccattcgttgtcaatagacatttggattgtttccactctaccccttgtctattataaataatgcttccatgaacatgggtgaaaatttatctttaagatcctgctttgaattctttctggatatatatccagaagtgggattgctgaatcatattctaattgtctttttaattttaggagtatctccttactgcttgctctctgtactacctgcaccattttacattcccatcaccagtgcacaagggctctccacatgctcaacttacattctgctcttttgttagtggccattctagtgagtatgagtcgatatctcattgttttgatttgcatttccctgatgattagtgatgatgagcatcttttcaagtatttattggctattcgtatatcttctttggagaattttctatccaagtcattttctcatttttaaattaggtttttttttttttttttttttactgttgagttgtagaagttccttatatagtctggatattaaccccaaatcagatacatgtgttgcagttatttttgcccagtccataagctgccccttcactctgtcgatcatgtctgtttatgcacaaaagtttctcgtagtcccatttgtctatttttttcttttgttgcctgtgcttatggtgtcacttccaagacataattctcaaatccaatatcctgaagtttttcccctatatttttttctaggagtttaatagttttaggccttacatttaggtctttaatcccttttgagttaattttatgtaaggtgtaagttaaggtccagcttaatatttatttatttatttatttatttatttaggcatgtggatatcccagttttcccagtaccatttgttaaggagactgtcctttattcactgtgtcatcttggcatccttgtcaaaagtcatttggccatatatacaagggtttattcctaggctctaaattctgttccattggtgtatatatatctgtctttattctagtaccataccatcttaattactgttgctgtgtagaatgttttgaaatcagggagtatgagtcttccaattttgttcttttcaagattgttttggctattcatagtcccttgagaattttacgatgcttttttctgtttctgcaaaaaatgtcattggtattttgataagaattacattgaatctgtagatcactgtgggtagcatggacagtttgacaatgttaagtctttcaatctatgagcctggaatatctttccatttatttctatcttctttgatttcttgtggcagtgtttagtttgtagtgtagaaaccttttaataagctcaagcttattccaaagtatttatcctttttgttgctatagtaaatggaattgttttcttaatttcctgttttgttttgttttttttacaggttctttggttgaaggataatttcctttgtgaattgattgttagtgtatagaaatgcaatttttgaattttgattttgcatcctgtaactttgctgaatttgctaattttaacagtttgtatggaatatgtcttctgtgaagggaattaattttactgattttccaatctgtatgttttctatttcattttcttgtctaattgctctggatagacctcctagtactgtgttgaatagtagtggtgagtgtgggcatccttgccttattcctgctcttagagggaaagtttcagtcttcttttgttgactatgatgttaaatgtagccatctcatatatgacttttattatgctgggatagtttttttctattcctagtttattgagtatttgtgtcatgagattgttgaattttgtctgcatcaattgaaatgatcacctggttttgtccttcatcttgttaatgtggtgtattaaatagatttattttcatatgttaaaccatcctttcattccatgaataagtcccactggtcatggtatataatccttttaatgtactgttgaattcagtttactagtattttgttgaggattttcacatcagtatacttaagggatatttgcctgcagttttctttttttgtatctgtctctcattttggtgttaaggtaattctgacctcatagaatgagtttggaagtgttgcagttctttttttttttttttaagactttattttttagagcagttttaggttcacagcaaaattgagtagaatgtactgagatatcccaatatcccctgccctcacacaggcaaagccttaccaattatcaacatcctgcactagagtggtccatctgttgcaactgatgaatgtacatgaacatatcattatcctccaaagcctatagtttacattagggtttactcttggtgttgtatgcctcccctattatcaacatcctgcaccagagtggtacatctgttgcaactgatgaacctacatggacacattgttatcctccaaagcccatagtttaccttagcgtttattcttgttgttgtacattctatgggtttagacaaatttagtgacatgtgtccatcattatagtatcacatggagtaggttcactgccctagcaatcctctgtgttctgcctgtttatctctcccttcccccatcccctagcaaccactgaccttactgtttccacagtcactttttcaaggatgtcatgtagttggaatcatatagtatattgcctcttcaggctagcatactgtgttcttttgtctttttttttttatatatatactttaagttctagggtacatgcacacaacgtgcaggtttgttacatatgtatacatgtgccatgttggtgtgctgcacccattaactcgttatttagcattaggtatatctcctaatgctatccctccccctcccccaaccccacgacatgccctggtgtgtgatgttccccttcctacgtcccagtgttctcatcattcagttcccacctatgagtgagaagatgtggtgtttggttttttgtccttgcgatagtttgctgagaatgatggtttccagcttcatcctacaaaggatccctacaaaggacatgaacttatccttttttatggctgcatagtattccatggtgtatatgtgccacattttcttaatccagtctatcattgatggacatttgggttggctccaagtctttgctattgtgaatagtgcctcaataaacatacatgtacatgtgtctttatagcagcattatttataatcctttagctatatacccagtaatgggattgctgggtcaaatggtatttctagttctagatccttgaggaatcaccacactgtcttccacaatggttgaactagtttacagtcccaccaacagagtaaaagtgttcctatttctccacatcctctccagcacctgttgtttcctgactttttaatgatcgccattctaactggtgtgagatggtatctcattgtggcatttctctgatggccagtgatgatgagcattttttcatgtgtctgttggctgcatcaatgtcttcttttgaaaagtgtctgttcatatccttcgcccactttttgatggggttgtttgttttttttcttgtaaatttgttggagttctttgtggattctggatattagccctttgtcagatgggtagattgcaataattttctcccattctctaggttgcctgttcactctgatggtagtttcttttgctgtgcagaagctcttttgtttagttagatcccatttgtcaattttggcttttgttgccattgcttttggtgttttagacatgaagtccttgcccatgcctatgtcctgaatggtattgcctaggttttcttctagggtttttatggttttaggtctaacgtttaagtctttaatccatcttgaattaatttttgtataaggtataaggaagggatccagtttcagctttccacatatggctagccagttttcccagcaccatttattaaatagggaatcctttcctcatttcttgtttttgtcaggtttgtcaaagatcagatggttgtagatgtgtgatattatttctgagggctctgttctgttccattggtctatatctctgtcttggtagcagtaccatgctgttttggttactgtagccttgtagtatagtttgaagtcaggtagtgtaatgcctccagctttgttcttttggcttaggattgtctggcagtgtgggctcttttttgagccttggtcattgctagcacagcagtctgagatcgaactgcaaggcggcagcaaggctggggggtggggggtgcccgccattgctgaggcttgtgtaggtaaacaaagtggttaggaagctcgaactgggtggagcccaccacagctcaaggaggcctgcctgcctctgtagtctccacctctgggggcagggtatagccaaacaaaaggcagcagaaatctctgcagacttaaatgtccctgtctgacagctttgaagagagtagtggttctcccagcacgcagcttgagatctgagaacagacagactgcctccttaagtgggtccctgacccccaagtaacctaactgggaggcaccccccagtaggggcagactgacaccccacacggccaggtacccctctgagatgaagcttctggaggaacaatctggcagcaccatttgctgttcagccatattcgctgtactgcagcctccgctgctgatacccaggcaaaaagggtgtggagtggacctccagcaaactccaacagacctgcagctgagggtcctgactgttagaaggaaaattatcaaacaaaaaggacatccacaccaaaaccccatctgtacttcaccatcatcaaagaccaaaggtagataaaaccacaaagatggggaaaaaacagagcagaaaagctgaaaattctaaaaatcagagcgcctctccccctccaaaggaatgcagctcctcaccagcaacggaacaaagctggatggagaatgactttgacaagttgagagaagaaggcttcagacgatcaaatttctccgagctaaaggaggaagtgcgaacccatcccaaagaatctaaaaaccttgagaaaagattagacaaatggctaactagaataaccagtgtagcaaagtccttaaatgacctgatggagctgaaaaccatggcatgagaactacatgacagatgcacaagcttcagtagccaattcaatcaactggaagaaagggtatcagtgattgcagttctttcaaagagtttctgttttgattctttcaaagagtttgagaaggattagtgttagttcttatttaaatatttgtggacttctccagtgaggacttctccagtgaatctatctggtcctggccttttttgttgggaggcttttaattactatttcaattctttactagttacaggtatgttcacatagatttcttatttcttcatgatttagtactggtaggctgtatgtttctaggaatttatccatttcttctagattatctggtttggttgtaatttaatactagcctcataattctttttatttctatgacatcagttgaatgtcttctcttttatttctaattttagctatttcagtcttctctccattttagttattgcagctaaagatttgctaattttgttcatcttctcagaataccaactgttggttttgttgtattttttctatcttttttcctgtttgtttcatttgtctctgctgtaagctagttgtggatttagcttatttttcattattcctttaagtgtcaggttaagttgttgatttgaggtctttcttcctttttaataagactttcctcttaatactgtttttgttgcattccatcagttttggtatgctgtgttttcattttcatttatctccagatattttctaaattcccttgtgatttcttatttgacccattggttgttaaaaactgcattaattcctatacatttgtggatttgcctgttttttgttttttttgctattgatttgtagtttcattgtgctgaggttggagaatatatttgtatgacttcaatcttcttacatttaaggcttttttcgtggtctaatatgtagtctgtcttggagaatattacatgtgcgtttgagaatgtgtatcccctgttgttgggtgaagtgttctgtatatgtttgttagttccaattggtctaaagagttattcaagtcatctgtgtcttctgtttgatcttctgtctggttgttctattcttactgaaagtggggtattgaagtcgcctgttagtattgtgttgctgctcatttcttctttcagttcttttttttttttttaaaggcggagtttcgctcttttgcccaagcttgagcgaagtggtgcaatcttggctcactgcaacctcctgccgctgggcttaagcgattcttctgcctcaatctcctgaatagctgggattataggcgcctgccactacacccaggtacttttttgtatttttagttgagatgaggtttcactatattggccagactggtctcctgacctctggtgatccgaccgcctgggcctcccaaagtgctggaattacaggcgtgagccaccgcacctggccatcttccttcagttctgtcaatgttgcttcacgtatttgactgctttgatgttagatgtgtatatatttattgttatatctttttggtgaatttaccattatgtcattatataatgcccccgtttttctcttatgatagttttttttcttaaagtctattctgtttgatatatgtatggccactcctgctctccagtttctcatttgcataggatatcttttccaccttttcacttttagcctatgtgtgctttttgtttgtttgtttgagaaggagtcttgctctgtcacccaggcaggagtgcagtggcgcgatctcggctcactgtaacctccacctcctgggttcaagcaattctcctgcctcagcctcccgagtagctgggattacaggcacacgccaccatgtccagctaattttttgtatttttagtagagatggggtttcaccatgctggccaggctggtctcgaactcctaacctcatgatctgcccacctcggcctcccaaagtgctggcattacaggtgtgagccaccgtgcctggtccccacgtgtttttagatataaaatgattttcttgtaagcactttattgttggatctcatattttttagccattcaatcaatgtcttggtatgtttgatctttttacatttaaaataattactgacaggaaaggactattacttttgttcattgttttttgtctgtcttaccgctttgtctttcctctcactgtgttttttgttgattttttctagtgacgttttgattcccttatttccctttgtatatattctacagatatcttccttatggttacccttgcaattccataaaacatcttaaaagttctaacaatctgttttaaactgaccttttaaatatttcaaactgacaaattaacttcaatcacatataaaaaccatgatccttgtctctctgcctcccattctatgttattgatgactcaaattgcctgtttttacattgcttatcatttaatgtaattattactttttatgcttttagaaaaattctgggccacgtgccgtgactcatggctgtaatcgcagcactttgggaggccaaggtgggcggatcacttgagttcaggagtttgagaccagcctgggcaaaatggtgaaacctcatctctacaaaaaaacacaaaaattagccaggcatggtggcaagtgcctgtggtcccaactacttgggggactgaggcaagaggatggcttgagcctgggaggcgaaggttgccgagagtcgagatcatgccactgcactccagcctgggtgacagagccagaccctgtctagaaaaaaaaaaaaattatataccagatttataagtgatttactcacctacattacaataatacaggattctatatttgtctatatatttaactttacctgggacttatgtttttattaatacatggttttatgttcctgtttatcagcttttcacttacttgtaggtgctcttttagaatttcctatagaataagtctagtggtgataaactccctcaatttttatctgagaaagtcttaatttctgtttttgtttgttttgaaagggcacttttgctaaacatagcattcttgattggcaccgcttttctttcgaatacatcatcccacttcctagcctgcagggtttctgctaagtctgctgagaatctaatatgagctcctttgtatgtactgggttgcttttttttttttttgctgctttcaagatctctgtcactagacagtttaattataatatgattatatgtctcagtgtagatcccttagatccctttagatttattctggttggaattatctgagattcttgaatttgtatatccatttctctcagatttgggaagtttccaaccattatttcttcacataggtcctctacccctttctttcttctccttctgaggttcccataatgcatgttttcttctatttgatgctatcccagaagtccctcagattctcttcattttccttcattctttttttttttttcttctcttcatttcttctctttttcttctttcttttttggggatttatcctgcttggtgttctcttaacttcctggatctgtggtggggtgtctgaaaccaatttcaggaaatccctagtcattataactttatttattgcttctattcttttctcttttaattttcttgatgtttccattatgcatatgctacattttctgtagttgttccatattcttgcatattattccattttttccgtcttttttctctttgcttttcagttttgtaagtttctagtgacatgtccttaagctcaaagatactttgctcaagatgtgtccagtatactaatgagctaatcaaatgcattcttcatttttgttagtgtttttgatctctagcactttttaattctttctcagaatttccatctctttgcctacattaaccaaccattgttgcatgttgcctaatttttccactagcaccctcagaatattaacggtggttgttttaaattcctgatccgataattccaacattcctgccatatctgagtctgtttgtgatgcctgctctgtctcttcaagctgtgtttttgccttttagtatgctttgtaattttttgttgaaagctggacatgatatactgggtgaaaagaattgcagtaaataggccgttagtcatgttagtagtgaggtacagggaaggggaagcattctatagttttataattatatctgaacctttttttaaaattaggacagagcgaagctctcactctggtacctaagctggaatgcagtggcataatcttgactcactgcagcctctacctcctgagttcaagccatcctcctgcctcagcctcctgaatagctgggactactggcacacaccaccatgcccagctaattttttttttttttggtagaaatggggtctttctatgttgcccaggctggtcttcaacatctggaatcaagcactcctcccaccccagcctcccaaagtgctgggattacagatgtgagccaccacacttggcctgtctcagtctttaagtgagcctgtggcccaagggtctgaacttcacaagtgcccgtcacttcttttcccagaattaggtgggacaagatggctggcgggagctggagttgggtatcttctgttccatgtaggttagagctgatgggagttgggtatttttgccctttccccaggtcagttagattctaaaaccacagtagattatgatctggtaaaatagtttttcttggggaaaggccttgttcagaacataatgcttctcccgaccacccccaatacctgaggggatttttcctggtagagcttcaggaggtaaaactcaaaaaagcactgggtcccctggaagtgttttaactctcagacttgtccacactgagtctctggcaatttatcacagttcaggcttggctaccagtactggttcttatggtggttttctactcagggtttctgctaagttgtgactctttgtatttgctgtctgtcagaaaagggaatgtttctcagctcttcaaaaggaatacttttcagaaggcccacaaagcagtgaaataactgaggatgcaagttgggtgaggaattactaccatggctatggttcctaagaaatcagtgcattcatgagttatttgaaaaggaactgttttattacctcatgtccagagataaagatcctaaggtctgtactgtaatagctttgactgaaggaaactgagagagttggtgctataggttgatttgtatcatggcactcttttatcatttgcctgtagctgtatttgcttaggagaaccatgcttcagtccacccctgcctctttctactttagttggggttgtttgtaccaaatgggttatttagaattaagttggattgggatgggcattgcaccaaatcaaaatttgataatttcacattttaggtcttataagcatgtaacacatactattatgtagtatgaaagcaaactgtgtactttgcatacatgaattcagttagttttcagagcagcctaattaggaaaaactgtcatgtctactttatggataaggaatatgagacttagaaaggtcaagtaaattacctgaggatacacgagcagctaaagggaagtggcagggctgcaattcaacctcctgactccaaacactagtaaatactactaccctactcttttcagtcactaccatttcatggctttcattcttcccattctccttctcttgtcattccctccaccctactcctacttttccttctcctcttcaactcactatgtcaaagagaaaaggaaagaccatttttgagacaaactaatttgctgaaagttcaagtctactagcagtatataatactcatttcatcatattctacattaacaaggtaaaatatccatttatatttctgctttaaaacctggcatgccctttgttcacatttctgttaggagcattactattttattattgatttgtatgcactatttagaaggaaattttatgtatgacttcctgtagtcacctttgccactcagagccgcaacaaatattagactaatctaatcaacaagcagaagtcatctagaagcaattgggctttatgcaaaaataatgtaggcccactgccccaagtgtaactgaaacggacaggttttttatttaatttcctttatatgtaggaaaagaaaaattttagattaggatgtacataaatttgagtttgttgaagttggctctggaagggtgttgtacaccctcatttcctagtggcctgaaaaagaataataaaagaataataatgaaccttctgtacttagtaaaaggaaatgctttttttttttgagatggagtttcgctcttgtcgcccaggctggcgtgcaatagtgtgatcttggctcatcacaacctctgcctcccgggttcaagcgattctcctgcctcagcctcctgagtagctgggattacaggcatgcgttacaacgcccagctaattttgtatttttagtagagacagagtttctccatgtcaatcaggctattcttgaactcccgacctcaggtgatccacctgcctcgacctcccagagtgctgggattacaggcatgagccaccatgcctggcctaggaaatgctttttaagtacttgaggtctggcacaatatttaccattccaaaactcccattacctttggtttttctcctcaggatgataaatcttcattcagaaaggctttgggtacagttgtagtttatctgcatagataatatcaaccaagttagacccaataaagagtaatatatagaatgactatttaaaatactatagggaaaagttggattttttttttttaagctagattacccaaagttaaatttggccaaagtggatatcaattcctagacttgggttttaacttaaatggatttatttatggcctctaagacaatcattttattctcactgcattcatgaaataattcactaacacatttctcccagagttgctaatgcaatgctctttccctcagtggagtcatctgattgttttagcgcaggcactatcatctcaccatcagaatatataagaaatgtttgaccttcaattaaagttgcagaatattatctgctattgtgtagcattctagaaatgtttataaaaatatgaaaccatgggagatgggaataaaaaatggtcttcatcccttctttgtgttaaatatctgaagaaaaaagtgttctggcttatgaattggaaacattttcatccctagtaaatacgtagctgcttaagtatatttcttaacactatgaatcgaaggggaatatttaaatgtgaccaaaaattctacatacataacctaggaggcaatataatacaacataacagctaagactgtgcaaaggctttagagcccaacagacctgggctggaattctggatcccccatttattggctgtgtgaccttgtgcaagtttcttaaccttgccaagcacccattcatgtgtaaatgtacctaatagtacttaattcacaaggtgtgtggtgggagggatttaaatcagtttatgaaaaatgcttacgatagtgcttggcacatagaactcaacaagtggtagcaattattattataaaagcaaaacaacctcttaaataaaaatcataaaatattagtgtcatcaaaattcagttattaaacatattttatgattaaaaagaagactgccaaaatcgtgaagcagttggaaaataaaaacattacacttgaaatttcaataacagtaagtttgagctagttgtatgtttgttttagaattttttggttatcatgagatttgacatcttaagtaaaaggtctgtttgttataccatgttctggtgtactctagtggttttgacaaggtatatacacacagatgttagaaaaaaaaaaacctttggttgttgcaattttctccttattgcatctaattgaaaacatagaggaaagtgtagaacacatctgtgggtacttttcataccagtgatagtaccatggaagccatggaagtctttaagagaactcctataggcttagaatgtagtgaaaatgttaggggactctataacatttgtattaccacccttacccttactccttacccacccacctgcaaaaaaacaaaaaagaaaaaaagaaactatcatagtaatcagctgcttcactgtgctaaaacgtatttctgttttggaaatatttgccaatgaaccaaaaagaatttggcatttggaaatatcttccattggcatagcttgtaatacaattcacagaaacttttaaaaacaacttgaatatagtatctgtaaactttcctatttaccacactttggggacaggatcttaaatcttcctatcttattcatcttcacttttgaagttctttcagaaatgttcatgctgattaatagttaaatgatttaagtattaacttacccatttctagcatatataatatagtagtagccttttagttgttttcttgcttctgaagcagccagcatccttacacattttttcattactcgttattgtcctcaaaaattgctcttcaagcaaaatgtggtttcctgtatttcctgtgtcattcaattaatgtatttctccaagtctaaccataagaactagataccacacactgtttcctaacagatggaaaatccttatgttttcacttaacatccctctattaagcagctctctctgggagctgtctcccttgccccattagtatgttaaagcagccagatccctgaaatataaatgataaaagtagatttcatatctgacattttaagttaccaggcatttttcctttatggcttaatcattgagatttttgaagattatatgtacaggaggggaaagatttttatttcagagactggaaaaaagcaacatagcattttagtagatttcataaaaatggagtaatagttaatttttataatttttttaaattttataattttttacttataaaattttactctagctattaaagacttctttttttataactacattttaacagcttttaatctaaccttaataataaatattagttcctttgcccagggcttggaaataatcagaaagagttctcaggcaaatctggctttttaaaatattttatcctgttgtattttgttgagatttcttgggaactggtacagggaaaagaagaataaaaaataagattcatttatttcttatttgctagaaaaaaagctgctattcataccaaacacacttttggactacagggcaattaaaaagaattcagtactaagaaaaaaaagctgctattgttttcttcactggcagaagcagcgagtaagtggcaactcatgactctaatgatgcatcatccctaggcagattatttataatgcatatgtaaagtcagtatcactagtgaaatctatatgtatttaaccctgaatcttcaatctcttttatcttttactttgaggaaacctattcttggtttacttgatacccgaactagtttggtatagaactgaacaattaacttctacatcaatttgtctgcactgtgactattttaactagctcagtttcaagccttgtttaaaaatggtaattcctctttctaaatttaattttatgtccaaatgtttttgttacagcctggccaaattcaggtccccatctaacttactatcatatttattcaaagactgaaagaaggccacaaggatgaagcatgaatgaagggtggattggtatgagatgagacaggatgtgggggtagagggatcaaatcatatatagctatatgaaggccatcataaggaggtcaaattttattctcagggaagccatttaaattagaatggcatgatgtgatatttcatttttaaaagatcactctaggtgctaaaaactacatggggcaggactagatgggagaccagagaggaggctcttagcataatctagaagattagaccagagtaatcaaggtgatggagagaaggggaaagattcaggacatgttttgcagataaaaggttccaggatctggtgacagatggtatgaaggctctaagcaaaagaagcatcaaagataggcctaggcctgatatttagttcatgccactgccttggctacctaggtctttgtgtgagtcttgttatgaagggccaatacttttctgtatctgatgagccaaagttttgggcttgaaatggggaaaaatcatggatgaacaagtttaaagaggagacaatctaagttctgtccagctacatgttttaacattcccagattgatgagatttactttaaaagtaccttcatgaaatttttctgaaactttattctacagcagttccaaaaacattccagacaaaagtgtgtcttattgtttcatataacagacatgaatctgatttcttccacaacttctgacatcttatccactagtgaattagcaaagttttgttagcctgcaggggtttctatgagggtttctcaccctcagcactactgacatttagatggggtactttggtttagggggctgttcagtacattatgggatgtttagcaccatctctggtccacaagatgccagccgcaactctcagttatgaaaaccaaaactgtttccagatatcaccaaatgtcctttgggagcaaaatcatccccagtttagaacccaactcatggtgctaatagtaacaaaactaacacttataaagcacttgttatagcccttttataatactaccagagccagtaggtaatgtttaaaatcttataaatcataaaaatagataaatgcctttaatttctattttaaatgtaattgtaaatccactcaacaattgatgttggaccacagccttttgagtatgaatccactggctggatttccaaattgccatggtacatgaagcattttctaccatttttagtttcaagtattttagtgggggaaaaactggattctgctttcatccttgctttctacatttgtccagtcttttagtttttttacccatacccaatttaaccactttttgactggggatgggttgaggggagcaactagctttttttttaaagtatttctaatgcattcaacctagctttcaaataaaaccagaagtcttttacactcacagtttatggactgctgaatatttaactaaattacataattaccctaagtaaaacaaacaggttcaatgaccactgccactagccttttgtaagcatgcagctgatcatctgttgggacaaaagcataaggttggttagagaatagcctcctagccagtcttctaccatgtgataagtaagtatgcctatcggctagttttactaggtaaaaattggttaagaggtattgtatgtgcgaaacaccatgtaaattactctacttgcattatctcttttaatcttcacaacaaccctaatacataattatgttaatgtttgtgttttgcctttgagaaaacaaacataaagataagtgttttacataaagttacatagctaataaaaggaccaggatgggaacctcaggcattctaatatgtgctttaccatttcatcacaagtccaaggccataaaggttaatttgctacagagcactaagctccagtttggtccatgatcacaaactgtaccttggaatcttgacctgtcatcttcaaactaagtgctacggcaataaaatatgggatattaatataaatctactacttggaacaattcaaaggattgataagaaagctcagtgattccaaatcatcaagtctatacatttaaagataacccaaatatacctgtattagtttcctatttatttgataacaaatcaacaaaagcttaatgccctaaaacaacaaaaatatattatctataggttagaagtttgacacaggtctcacagggccaaaaccaaggtgtcagcaggactgtgttcctttctggaggttccagggaagaatccatttccttaccttttctggcttctggagggcactcaattccttgacttgtgacccttcttccccctatcttcaaagccagtagttgcatctccctgaccattcatctgtagccacatcgccccgactctgaattttcctgcttccttcttccacttttcaaaacccttgtgatcacattgagctcacatggataatacaggctgatctccctacctcaataaaatgagccttagagccttggcacagctttgagccacagtcagttcctgttcagctacattaactgttttgtttttagtaggcgttttcaaaaggtgatgtgactcaaaggttgatttgtatgagaaatcagtcatgattgaattgcataactatctgtcctcaaagtccatgtaaatagatctatgtaattataattaaaaacaataattgcagatatatcagaggtcctttagtcttctaatagttgagtctaataagtctcaccaaattccacacacaagattctaacacatgtacatatgcatttgttacagaatgtaatttagatactatagtaaccaaattcaaggtaatggacaaaacttagtaattttcattaaagctttctatttcgggcttctcctgaatgtgtgttttaaatgactaggacattaaagggattgtttcagaagaactatcagcaccttttttatgtgtcatgttcatccagactatccatccagataattgctttatttctgatatgtcttccaaggttgttaccccgtgtgggataggcaatgaatttaactgtcttttgtccctaaaagttttataagtttttatctaacatattcatgtagtggaaaaaaactcacaaaagtgctttcaagcattcacagtggtgtctaagccactattaattgaaaaagctgctgtatttaaaaaaactgctagttcctgtgaaccaagatcatgccactgcactccagcctgggccaaaagtgcgagactccgtctccaaaaacaaacaaacaaacaaacaaacaaaaactgctagttcctttaaaaacttaaaaaacactggaactccaaaaagagctatgaattaataaatttctatgattataaaactgataaattccacagtaagacaattaaagtggcaatattaatagtataccctttattgaatacctatgtgcctggccctttgctcatttcatccttataacctgcaaggtaagttaatctttttactgataaagaactggatggcaaaggctaagcaacttgccaagcaccacagaatttggtaaatgctagagatttgaagtccagtgtgactcatttcaattctgtttttatttgctaatatagttaaacatttgagtatattctcatgtttccatttttatttaaaaaatgactcagtttgaacattttagtagtgaaattttatctggcattaaatatttcaaaactagcatttggttaggtagaacactgatgtaattatgagtcttactaaaatattttgcaaagataatcaaggtaaacaaatttgtcatcaatttttaactagtttaggtaaaatgttaattacttaaattgaaacttcaggtcctaggacttagataagcagatccttgagtccgatgcaaaaggcatcattcaaagataaatacatcaaaaggcagtaactgaggactaacttgaaaagtttgaaaggtgaaaaaatagttctctacatattttctgttttcaggagatgagtatgatgtatgtgccatttgtttggatgagtatgaagatggagacaaactcagaatccttccctgttcccatggtatgagtaattacgtactgctttgaatttacatatagtaatttatatttaggttccatattccaggggaagagatggaaaatagttattagcacaccagaagccaggccctgtactaattagtggtctcattcaaggatggaggtgtatttataaaaatttataaactttcaggccgggcatggtggctcacgcctgtaatcccagcactttgggaggccgaggcaggcagatcatgaggtcaggagatcgagaccatcctggcttacacagtgaaaccccgtctctactaaaaatacaaaaaattagctgggtgtggtggcgggcgcctgtagtccccagctactagggaggctgaggcaggacaatggcgtgaacccaggaggcagaggttacagtgagctgagattgtgccactgcactccagcctgggtgacagagcaagactccatctcaaaaaaaaataaaaataaaaataaaaaataaactttcttcccgtccctacatgatacatacagaacactgaataaatatggcaagagattaaatataaaagtatcaaccgcagcatactaactaaagatgtatattttgcttcaacagcttatcactgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccactttaagatccagt

SEQ ID NO: 35979 - DNA, 8054 bp, Homo sapiens
aaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggttcgtgtctaccctacccttctccccctctgcggcgtggtgcgcatgcgaggcgggaggaggccttaggcgagaggttgcgcatgcccagagggcagcgtccactgcccctaccgctcacatgcagaactcgacgctgattgggctgaatttaagtagggggtgaattcgggcctgtctgccccgccccctggctcggccttgtagcagcattggtgggggaggccgtcagtcatcacaagcgggttggggttgggggttgatctcagtgcttgggcagaccccacgctggaggaaacccagggccgggagtggtcctcgggtatctgggtttcaaggctcatgatcctttgtagatggaagggccttctgaaaacacttagaccaactgccgctgtttagagtggaaaaccaagaccctgggacgtgcaaagccggagaacgggcccagaggtcaggtctcccagacagggactctttagcagccttcctgctgcactaggggcttgttgggacagatgagggttgggaagtaaagaacctcccacttttctcctttttgccaggcccccagatccagcccctctgcccgcttctcccccaacctacaactccaggcttccctgcttctcctgtagttgcctcctcccggagtgcttttcccagctgccacttgtttgcagagtagggaacctcccaggggcagcccctgtgcccagcagagcagtcaggcaggacatgcacattgagcaaatgagcacatgccccctggccagcaccgtgccgaatcgggcagctaagcatcctagcccagtgcagtataagtgccctgagagcagaggggagctgcatggctggagtgatccgctgtatgaaaagatatcttctctaagaagagacaggatgtgtggtgtgggttcatgcccccatgtgctggggggttggtggcgttggaagaaggggctggcaagggggatcctggatggaacagacatcagaaggagagatgtgaacaatggcaccccaagatcagaaacaggtggtgttaaataaccaatcgccagcactgattgagtgctcactattcgaacattgtgctacatgcttcacacgtttatttcctacaatgtgagataggtactgttgttgattccgttttaccgatgtggaaactgacttcagagatgcagcatggtgcggcagttaagagcgtgggctcctctaaccatatcctgtcgagagttcaatctccaaacctcttttctctgcacccacccccagtgttatctctaaaaactctccctgcccggattactcccagatgcagctctccagtcattaactgtctcttaaacctgatatatagctccctactcaccatatccacctggaagcctggttggcaactcacacttaacctgctccacctgaggcttctccgtgtcaggggaaccaacaaccttcccgttgttcagggcaaaaaccttagcatctctgtggtcctcccagtctcacatccaacatcacatcctcaatatccagccaggatctgagttctcaccacttctgccatcactgcttgggtccaggccatcctcatctccagcctgggttactgcagcgacctctaactctcctgcctcttttgtccctctgtggtctgttctcgtcccagcagccgagcccatgccagattcaattccttttttgctcggagccactcagtggcttccatcacagagtgaaaaacagaggcctcaccatagcctacaggccctgtgaggtccacccctactgacctgggtgagctcccctgctgaccctgtggtgtaccccaccccctccttcactctgctctgccacactggcattgctgctcttgaacacatcatgcatttgaaacgggaagttcccttgtctccctcgcagggcgtgcgatgggggagtggctcgcttcttcagtgccccgctgctcagacctctgggggagcatacagatgggcaggctgtgggctccgacctcatggcagtgtctaggggtgaatatttacagctccgtgtgttctagggtgctcttttagtttgtctatgggaggcttgtgttaaccagctcaattagacccccttccttatcacaaggacagagggctttctgtagtctggggttttcttgccttgatgtactggagtactggagaattagatcacttgtgggcttggagaatgattgcaaatttttttttattttttattttattttttttttctgagatggagtttcactcttgttgcccaggctggagtgcaatggcacaatctctgcctcccaggttcaagcaattctcctgcctcagcctcccaagtagctgagattacatgtgcctgacaccaggcccggctaatttttaaaaatgtttttagtagagatgggcttttaccatgttggccaagctggtttcaaacgcctttttttttttttttttttttgagacggagtcttgctctattgcccaagctggagtgcagtggcatgatctcggttcactgcaacctccaccttctgggttcaagtgattctcctgcctcagcctcccaagtagctgggattacaggcacccgccatcatggccagctaatttttgtatttttagtagagacggggttttgccacattggccaggctggtcttgaactcctgacctcaggtgatccacccgccttggagatggtcttcccctggggttgggccacttggtggccccacctctcctctgactgccccagccaaactccgcctcttcctgccagttgatgacctgccagcgtgcaggtgcctgtcagtgtgatcttctgcttcttgctcccctgacatcctctcaatgaccaggagctcgtcttctgctgatgggctcctctgacatctggctgcctgtgggtctaccccctaggggtgttgggtttttataggcacaggataggggtgtggcaggccagggtggtcttgggaaatgcaacatttgggcaggaaatgcctgttctcacctaggtctgtgggggtggaaccctacccagggaccacgccctcctctacccagcacttcccttctccccttccaaattatttaacaggaccatgctcctcccttcccagcacttccatatcacattgtcccactgcaaggcttttttacacatgctgttcttttggcctagaaagttcctatcccagggtccacttggcttgctttcttccttactccccaaccccccactctgtttaatccagccccaaccctcttgccctgctgtttcccaagcacgtggcttcacctgccatgacatattgttttgtttgatgcccatctcctccctctagaagcgccatgtgagctccaggggggcagggacttttttgtgttttgcttgctgccatgttctggtgtctagcacagagcttgggcacatagtaggtgcttagtaaatatctgttgaggaatgactggagtcagactgcttggactcttgttcccactcagccacccactagccgtgtggcttgggcctattcctcccctccttgtggctttgttttctcaccagcgtgggaggatgaagccaggtgtaaggtcaggtggtgtccccggggaagccccgtcccttatgccgtctgcaggccggggactggacttctccttgggggtcagggtgagggtttgtgcctttgcctgacctcgcatgtggcccacaggccacgttccactaccggacgctgcacagtgacgacgagggcaccgtgctggacgacagccgggctcgtggcaagcccatggagctcatcattggcaagaagttcaagctgcctgtgtgggagaccatcgtgtgcaccatgcgagaaggggagattgcccagttcctctgtgacatcaaggtgtctgtcctgtacctgtctgcggtggctgtccagccaagccctattcctattccctatccccagggctcctcctccctccaccctctgctagactgccacccgctttctttttttttttgagatggagtcttgctctgtcgcccaggctggagtgcagtggtacgatctcagctcactgcaccctccacctcctgggttcaagcgattcttctgcctcagcctcccgagtagctgggattacaaacacccgccatgatgcctggctaatttttgtatttttagtagagacagggtttcaccatgttggccaggctggtcttgaacacctgacctcaggtgatccacccgccttggcctcccaaagtgctgggattataggcgtgtgccaccgcgcccggcccacccactctttccagaccaccacaccagcctgctgatggcgtcctggcctccattccgccttcccctattagccagactgaggccaggggactcgttctcaaatgcaaatgacctgtacatccctttgtttcaaacctctatgactcctggtcactgtaaggatagagcacagggggtcctcacttcatgttgctgatacattcttggaaactgtgactaagagaaaaaacatacatcaggttttttctcagccaccgtcatttctctcagcaaaattttgttagaacattgatgagaagaaaaattggtttcgttatgtattgtttcgcctacagtcacagtttccaagaacctacttaggacgttaagtgaggacttaaaccgtataagctatagctgctcacatagctttttgggggctggcccctgccgtctcaccctcttactcaacctccctgcttttcctttccattccccttcttagccaagatcttccctcttccttcaaagcttattcctgggtcaccacctctaggaagccctccctgactgctagtggttggctcaactcccatgtttgggtcctccaaccctcatgccctgcatggccaggatctgctcttctgccttgtcctaggctattgcagagcagggatctggcctgtttacttctagctttgggatgcccagcgcgagccagtccagagccaagactcaggaaatgcccgctgatggcagcccggcagtcagcccctgtccagacaacagggcagtgggaggagtggggaggacccgggtaggaggaatctggttatctggttcccaccagcctagcagctttgccaagcaagagattagaggctaggtcccctatgcctgtctccctgtggggtttttttttttttgactaagtctcactctgttgcccaggctggagtgcagtggcgtgatcttggctcactgcaaccaccatctcctgggttcagctgattctctgccttagctgcctgagtagctgggattacaggcacctgccatcgtgcccggctcatttttgtattttagcagagacgcggtttcaccatgttggtcaggctggtcttgaactcctgacctcaggtgatccgcccgccttggcctcccgaagtgctaggattacaggcgtgagccaccacatccggcctccctgagggttttgaagtggctggcctgggcccagctctgaggtaggccctcagtggggtgtgggtggggcagaaggaggagctgctgggaacagaatgtggggggccccagttctttgcatagtccagcaaagggccttatcctctggagggagaggaggtaagaattctactgggcctgtaaggaccagggagacaggggttgatggtaggcatgtgtctgtggtgggggtgaggagggggttaggtgctctgtttggtggccagagaatgtggcagaagctggggcttcaccaggagagagggctgagcgactggaggagtcctgaattaaaagcctcctgtgcttaaacggagtagggtcccagttgtcactctctgggccttggtgtttgttctcagatggtggtggggaagggggctgggccttgtggacccggtgaccagccagcccacggtgacagagcccccggcgcccttgccttcccgcagcatgtggtcctgtacccgctggtggccaagagtctccgcaacatcgcggtgggcaaggaccccctggagggccagcggcactgctgcggtgttgcacagatgcgtgaacacagctccctgggccatgctgacctggacgccctgcagcagaacccccagcccctcatcttccacatggagatgctgaaggtgaggggccaccgcgcctggtctcaccaggcccccactgcccagcctcagggcggcgctggcctgtccacccaggggtggtgggatccgcaggtggactgctgggggagcggacagagacaagaaaacctgtgcaggacccttggcagtaccctgggtctcctttcctcctccttcacatctcaaatgtcacctcctccaggaaaccggccctgcccacccggtctcctcattctctgtctcgcagcagctcatttcctttatagcctctgccgcaccttgaagtcccttggaattcatggatttccttgtccatttagggaacctgccatgcagcatgatctctgcgagggcagggcttttcaccgtcttgttcactgttctattcttagcacttggcacagtgctgggcacacaggagatgtgacatcgatgtttgatgctttttgagtgacaagtagctctgctgctggtgtgtgatgtctgggggcccagccagcccagatgtgggtcaggtctgctgctgacggacgcagctgtggtgtccccgagccccgctgtgatatgccccatgccctgcaggtggagagccctggcacgtaccagcaggacccatgggccatgacagacgaagagaaggcaaaggcagtgccacttatccaccaggagggcaaccggttgtaccgcgaggggcatgtgaaggaggctgctgccaagtactacgatgccattgcctgcctcaagaacctgcagatgaaggtactgcctggaggctgagggggaggatggatggaggggggtgtggagccagggggcccaggtctacagcttctccccgctccctgcccccatactcccaggaacagcctgggtcccctgaatggatccagctggaccagcagatcacgccgctgctgctcaactactgccagtgcaagctggtggtcgaggagtactacgaggtgctggaccactgctcttccatcctcaacaagtacgacggtgagcaccgggccctgggctgccgggggctgcgagtggtcagagagtggcctttctcctgtcactgctggggtcaagacctagcctttcacaacccccattctgagctcccacgggggcctgactaaatgcctctactcggcagggctgtgggccccattgtgccaatgaagcatgaatggtgtattgggggtggggtggcatcctcaggtcagggagggctctctctcccctgtgggcccatggtgccaggagacatgagggcaggcagctggccaggatcccccctcatgcccttgcatgcccactgcccactggcctcccctgcagacaacgtcaaggcctacttcaagcggggcaaggcccacgcggccgtgtggaatgcccaggaggcccaggctgactttgccaaagtgctggagctggacccagccctggcgcctgtggtgagccgagagctgcaggccctggaggcacggatccggcagaaggacgaagaggacaaagcccggttccgggggatcttctcccattgacaggagcacttggccctgccttacctgccaagcccactgctgcagctgccagcccccctgcccgtgctgcgtcatgcttctgtgtatataaaggcctttatttatctctc

SEQ ID NO: 35980 - DNA, 98296 bp, Homo sapiens
ctcctcccgggcgggataattgaacggcgcggccctggcccagcgttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggaggtaggggcgtcccgggtccgccgccccagcttagggtcccgaccccctcggcctcgcgctccctgcgagtttcggaaccacggggactcggagtccgtgcgttgccctgcgcggcgcccccggactgtcagcgccgaggcctcggcgacgcccccctcccccacggccagctccggtcctcatctcctccccggcctggggacttgtttcaaaaccggattcccccacccctcaaacacaccgtcctaccccagtcctagcaaatccagccggctccgggggccgcatcccgggccctgggggttcaggggcgctagctgggctgggggacgctggctgggggttaccgagcccagggcgccttgcacttgacgctggaagcgccctcggctatctttcctcaccgcttcccgcctccacccccaggtaggagctgttgtacccagcttgcggatgtgaaacttgagcctggagggtgggaagcagtcttttccccaggagacactagcggtcctgggataggggctggagaggaagaaatgagaaagccagggagcagcctggaggtttttggggcgtagctgggaggatggaggggatgcggacctggccacctcctccctgcctccctcccgggacagagggcccaaggcagtggttctgccgggctcggtgctcagcggggactggggactggtcacttccaccaacggcaagggggatggagttttccaagagcagatctgatcgatggcccagaccttaggccccaactctgggactgacagctccgggacagtgcccacccagcccgcgcttttctcccctctaaccctcaaggcctggtccctggggggactgccacgaggtcctctgatcagagcagctgctgggcggcagagctatgacctgtgacctctctgctgacccgtggcttctcagagccactagccaggcccggcactcctggcgtctttgtttctccagtggcccaggtccaggggagtgccctagaccaccctcagaatccgagtcttaatccctggtttagttgagttccttttaacctctggtgaccgcctttgttagtcaaaaggtcgcttgtcccaactaatgctcactgggggattccaggaagggggctgaagggggctggagggggaggggaggctgggagctgagctctacagagctttcttgactggctggctgcagcagagccctgtggagctctgattgttcaggcggtgctgggcacggcctgggcacctcgtggggttggagatggtgtggggaggcgcagagctcagtgttggcaccaggagccttcgcagcccctgggggctccctggaggctctttagaagagatggagcttgatgtaaggggagcgcgggaagagggcattccagcaagcagcaggccgggtggctgccagctggagggaaaaccccgaggggccctgggtgatgggtgggtgggacatccgagactcctgttagaaaaggaaggagcctcagaggccccgattgtgtcgatgaggaagctgagggcctgagagaaggcgtggtaaaactctccctggccccggagtctctgcgttccctctcactgttcttttctgtctgcggtttgcgaacaatttctccctatgtgtgtgtgactgaatgaacaccccaggacttgcgggcccagtgtggctcactgctgagccacagagaagtttgtaattggaagggtttaaaaaagcctcctaattgcacacttcgataaaagcagctggatgtcctgtgggccttttgtttcttttggggagaagtctctttgagtttcaacaggtttaatttggtacagtttgggaaggggcttttgaagactgcctggcccctatctgcagctgtgaggcccccgaagccctgtatgtaaggccacaagtggcaccgcccctgctctcagagagctgtggggccgcagatggtgagcctgttagctgatctgcagaaactcctttggcgacggccgcttaaatggagaagggcgctgatctttcttgccaaacggccgagaggagccgcctgtctgtcctgtgtctgtccgtcccgttgggctttactgagagctgggtgggagggagtggagaggaggaggtgttaggaaaagacgattgtgttttctccaaggctttcttggcctctggctgcagccgggcagcgtttccgactgattaaaagaaagttgggagggagaacaaaggccagggaggacttggcttgaaaacgtgtggtctgtgccgccactcctggaagtttcccagtcaggaggtgggggccagggcactgaatgcatgaagatgagactctgtgccatgggggtcagggctggggcctctcctgcagcacccacagctctggctcacgccccgctcctggccctgctgagtgccccccaactcagggctgcatttgccacccctgttaggtgtgtagggcaggagtaggggcacgcggctgactcatcttcaggtcctggagggctccacgggccttgtgagactagaaatcagtttgcatcagaaaaagccatgagatggtttggtggttttctcatttataaaatgaagggaacaaaaacctacttaggttgtcttgaggattaagagagagaacataggatagtgtctaccatggcagctatattattattattattattttattttatttttgagacggagtttcgctcttgtcgcccaggctggagtgcaatggcatgatctcgactcactgcaacctccgcctcccgagttgaagcgattctcctgcttcagcctccccagcagctgggattgcaggcgcccatcacgcccagctaatttttgtacttttagtagagatggggtttcaccatcttggccaggctagtctcgaactcctgacctcaggtgatccacctacctcggcctcccaaagtgctggaattacaggtgtgagccaccgtgccggctggcagccctgttattaatgttagctattattcctgttgtccccttctctaggaagtgttggcaccaggagccttcgcagcccttgggggctccctggcggctccttggaggagatgaggcttgatgtgaggggagcgcgggaagagcgcaattctgccaataccccagaattgttttccccaagatgcctctgcacattctactactactgaatttcccagccaggcgctgagcagaaggccccatggggctataggactggtagtcgtcagtgccaaacccgtgtcaggaaaggtggtgttcttagccattcagtcattcattcactaagggacagctcagtgccagacactgctctataacttgtggatgtggcaggaaaggagagagacccagtttttccccctcatgcaactaggagatccagaaaaatgaactgagccctactggcagagtcagggaagacttcccggaggaagcggcatgcaaactgggaacctaaggaggaaaaggcagtggctaagtctgtgggtagggctgggaggatgggggaaagggtgttcctggcaggggaaatggcagggccaaatacctggaaggaagagaaaacacgagacttccagggaaaccccctccttctacccacttccagttccttccagttccaccccctcctcaccactgggggagactgtgctgtctagagacttctccagcagcttccctgacctggtgagactttaagcccgggctctgagcactgggcacctggtcagggccgccttccaggtgaagtttattagaacagttctaagagggcatgtagttattttgccagcatattttatacaacaagattttccttttgcagaatagcaaatcataacaatttgatgaatgaatcctttcgtaggccccatatggttccagtttccttgtgatgatctcacatgtggccctataagtaaacagggtgggaggggggaaccactgtgtcaacttccctgggataggagaccccctcaggctggaggggagctcaggactggctaagtcatctgccacaagtcacccagcgaggagcggggctggggctgggcctagagctgggctgggccccacctcctttaaccccacagtggtcctaactagaggctggggtgggagggagcgaggcaccagtcgccatagcttcctacaggttatttgcgggttactacactgtgcggagccaacatgagaagggggttaggaagctgtgtgttggtcccaattctgaaagtgtctggagagatcttgatgacacccacaaactctctgcctctgtttccttcactataagatgtgagtgtcctctgggtaattattataggtgaaatgctttacatttagtaaccaatgtcgtcatctcagcagccctacgaaataggtgatccagtgttgttttgaacctatttttattttttattattatttttgagacggggtctcactctgccggccaggctggagggcagtagtgtgatctcggctcactgtaacctccacctcctgtattcaaaccattctcctgcctcagtctcctgagtagctgcgactacaggcatgcgccaccacacctggctaatttttgtatttttagtagagatgtagtttcaccatgttggccagactggtcttgaactcctgacctcaagtgatccacctgtctcggcctcccaaagtgttgggattacaggcgtgagccactgcgcctggccctgtttttcattttggatcctgttacccactggagtgaaaaggtcctgtgagttttgctacctaggtatgaagcccggcttcttgttttggcctagaactcctctatggacctgcacagtgccatttctgagagtcactgatgcgtgtgataggttgaggatggaaatccaacacctgtgcacccagcatggtctccccacagcacggggactcgagcaccttcctgccccacccctgccccagttcacctgtgttacctagctataccctcaccctagccctgcaaaggaggtgctgtcattgtccccctcatcaatgaggggacatggaggcccagagagtccaggtagcaagactgtgggtgcatagctgctaagtgacagcagcaggacttgagcttgggcagcttggccctgacgtcatacccctcaccagcacactggacagcctcgcgtatctttttttttgagacggagtcttgcactgtctggggtgtgatcttggctcactgcaacctctgcctcccaggttcaagcaatcctcctgcctcagcctcccaagtagctgggattacaggtgcccgccaccacgcctggctaattttttgtattcttagtagagacggggtttcactatgttggccagagtggtctctaactcctgacctcgtgatctgctcaccttggcctcccaaagtgctggaattacaggcgtgagccaccgcgcccagccagcctcacgcacctttagaagacttgaatctttaagtctagttcagggggggatgcctgtttcctttggagtgtgatggtggggtgtgtatgagctttacagtcagagctggatctgaagcctgcctctgcagaggctgcatggcctcgggcaacttggtgattctctctttgcccccactttatagaatacctaggatcatgtgagatcatttgtgcgttcattcattcacggacatttattgaatgactgcttagggcaggcatgggggcaggaggcagaatgagacagtgtctggctcagactcatggcactaagtacagagttaattatttgtgctaagtgctgggaagctcagagtacaaagagaccatgcaagaaagaaaacatatttgtcccatgtgcatgcgtgtatatgtgcatatgtgtgtgcattggcggtagttagggaggacttcctggaggaagggacctttgagctggtgtggcatgaacaagctggcctgaggagagcaagcgtcctgggaccctccagcctttgaagctccaggttccaaatgccaggtgcagaggatgcatgacaggtggccagaggggtgagaggaacaccaggggagatgcgtcctggaagcccaggaggcccttggagcagggtgggatgttgcagaaggatgaggatgcccctctgtgcactgggctgatgtaggaagttgctgccggggccagagctgcctggagggaactgtggggagaatgcttctcgccttcccagagaggtaccttctgctccttctctcttgctgcctcctcccggctggttcaccatccaagacccctgtcatctccatgacagatgctgggaacaggctcagcagtggacacagtcaggtcttgtgttggggatggggccaggagccctaagagcaggctccagttcgccctgcttcctcctgcagaggccaggtggtcttgaagaggggacacgagtctgtcctcatcctggaactgtaagggatgcagggacataggccaatctggctggacccctggtggcttcccagacaacatagtaaaactccgtctctactaaaaatacaaaaaattagccaggcgtggtggtaggcgcctgtaatcccagctactcaggaggggcagggtgcaggtgggggttgggtggagtcgcccagtcctgtttggttggaactttccatcagggtctctgtggttgacatcttgttgcatttcaggcttttcggttccttggttctggacaccacggaggccactccaactctttgctgtagctttagacaatgctgtggggcaggtggggtgggggcatgatccttttgtgtggtgagtccgggaggcacacaggatgaagcctcaagctcccattcacttttaaaaactcctgacgccctcagctgcctctgagtttttgagcttgagcagaggaaatcaaggaaattgaggctggcttctgatcacatgcctttacttcatccccagctattcacggagctttgccaacttaaaatatcctcatttgcccgatgaggatattaaaataaaaaacagacacccattcaaccaccatctcatatcgtcaccacttcacagaggtaggggacattttaatgccccggattttggaaggacgcggtctcacaataaaagacagtattgtagatggaatcgggccggctttgtagaggtccctggatcctgctttgctttcaccctattttgttgcaacccagtggaaattttgccagagcaatgcccttacacagggtgggattggggaagcctgctcttaactgcaggccaaatcctccattcagtttataaatgaaaaaactgaggcccggacttgctccgggtgggaaaactctcaaccatgagatcagaagcagactccaggcctcccggttcccagcccccagtctcccctctgtgacagtctgcttgctcagcaacctgggaattaagatcctcgtggctcacaggctgctggggatgggatcaggcattgcccaaagcttctgcgatgtttacagctagcaggctgacattctggaagcttccacccaaggagtggtacagaatctctctgagcatctgtagtcttagaaagagcacgtggccatatccttcctgggtgtccagggcatggtccccgcaggccatgtgacctgtgtttctctgcatgccttggaacatggggcatgccgctgatctacaccataatctttatggaggtttaactcacctggaaaaaatttagttttagcagctgtcccaggcaacaaacggtatctgaggcctgtgaactgagccagctccatccatctgcaccagttactccggcaggcatgtgtctctcctgaagagaggtggtggatgtggtggcgtgttggccatcgggcaccgtgtcagcctggaggagtgtgtggttcctttgaaaaagaatgttctcccaatcctggtgtgataacttttccttttgtttaattttgaagcttctgttttttcctgtggtcagtgtgctaatgtaagcacttttcctggattatctcatcaatcttcccccattttttttttttttgagacagagtttcgctcttgttgcccaggctagagtgcaatggcatgatctcagctcactgcaacctctgcctcctgggttcaagtgattctcctgcctcagcctcccgagtagctgggattacaggcatacgtcaccatgcctggttaattttgtatttttagtagagacgggctttctccatgttggtcaggctggtctcaaactcccaacctcaggtgatccacctgcctcggcctctcaaagtgctgggattacaggcatgagccaccatgcctggctttttttttttttttagacagtctcactctgtcacccaggatggagtacagtggcacgatcttggctcactgcaacctctgcctcccgggttcaagtgattctctcacctcagcctcctgagtagctgggatttcaggtgcccgccaccatgcccagctaatttttgtatttttagtggagactgggttttaccatgttggccaggctggtctcgaactcctggactgaagtgatgtctgcccacttcagcctcccaaagtgctgagattacacccatgagccactgctcccggcctcttcccccatttttacagatgaaggaagtgagcctccttgagtcttagtaagggagggagctggattcaaggctgagcagttttaacccgcagcgttgccttccctgggaacattcgagttgaaggttaacgagattttgcaagagtttgctcttggtttatatctaatattatgctttggatctaactcacatggtcagatgcaggggtcagattgagactggttgattgaaactcctccgaaacaacaggaaatgatctgggagagaagattccaggtcccctgaggccctgcttctctcttgatcccccacagcccagtgtcgagttaccagcgagtgcctgttctgcttgggtgggtgtccagtgtggtactggtcagaggtaatttttggatctcagagctgctcacagctgttggcggtctgggatggaagaagcaggcgtggcttcggttggcccacattatcctcctgactcacagtgttccagggctgctcagctgccctagggtttgtgtacaaatggccttgatttgacacccttctgaaggtggggggcctgactgatcaggcagttggttggatgctgttgacccccgcagaactcttggtacctatgaggcgtggagttggcgtgggggatctgttagccccagtcccctttttgcccccaccccagcctggccgagagtcctgggcaggcactgagaaggcaacacatggggtaggacttgatgagcaggtggataggacagtgaggtgggaggtgcctctgtgggcctcagatggtccccagcctgtgtgatggggcagcgaagctcaggacacctggtgtttggatatccacaggtgaccggatccccaggcaaatgagcagctggaagtccctgcagggatgcgggaggcacagccagggtggggctggaccccaggcccttccccactcccatcgccccaccctcacaggacacacgggggagctgtgatcctcagggtgttcttttgtttttagtttttttgttttgagacagggtctccccctgtcccccaggctggagtgtagtggtgcagtcgtggcccactgcaagcttgaactcctgggctcaagcgatcctcccacctctgccttccaaagtgctaggatcataggcttgagccaccatgcctggcctttttgttgttgttgttcttttgttgttgttaagtcatctttattttggttgcaaagttgcaatctattttttactgaacattttaagtctcatttgaagtttcatagcttgccgtgtaaaccattgcatacactgtcaaactgctgtacagaacattctgaaatacaatctactaaattaattcgcttgacactgttcagattactgcatgaaaacaacattgattgaagaaggcaagtaagtcaacgggcaaagcatcgattgctttcctactgtaggatgttataagatgaccaacaaacactaaattattttgcttaaaagatgtactttttattgtggtaaaatacgcatcacatgggatttgccattttaaccatttcctttttttttttttttgagatgtagtctcactctgtcacccaggctggaatgcagtggcataatccctgctcactacaacctttacctcccaggttctagtgattctcctgcctctcagcctcctgagtagctgggattgcaagctcaccccaccaaacccggctaattgtagctgggattacaggcgtgagccactgcgcccggcccattttaaccatttctaagtgtatggtccaatggtattaaatacagtcacattattgtacaatcatcaccacctccatctccagaacttttcatattcccaaactgttaaatactaactccccgtcctctcccccgaagcctgtggcacccacccatccttttccttcctgtctctgacaaattccctacaaatttaactcctctagggacctcataggtactcttatcctgggtcaccatacgtgccttactggcctttcttttcataaccagagtaaagcttgtttattttattttgagacggagtcttgctctgtcgcccaggctggagtgcagtggcgtgatcttggctcactgcaacctctgcctcccaggttcaagcgattcttctgcctcagcctcctgagtagctgggattacaggcatgcaccacacgcctggctaatttttgtatttttagtagagacggggtttcaccatgttggtcaggctggtctcgaactcctgacctcatgatccgcccacctcgacctgctgggattacaggcgtgagccaccgtacctggccaagcttgtttatttaaaaggggacagagacaactttttttcgtttctaatcggaatgtgtcttggaaaggatatgtctgaggggtgggagtggagttggttttgtgcttcagggaacctgttcctgccctgtcccaaggtaagcttgtaaagaggtcggtgcccttgttttggaacccaagttaatgacgcaccttttcttgtgtgggctacacacatctttaacctgctgcagatagtacttttgttggcatctggagccatgatgccaggcccctcttctccctgaagctcagttttcctctaatgggtgggaggtaaccagtgctgagtccactaggaagatcgaggcacatctccaaggctaagaaaccggcagttctgtagcctcagccactcccccacccctagctcatccctggcttttgccgaaattctaaccagccccgtattttgtgtgggtgggctccagcccctcgggattttcctgggggtcactgcctccaccccctgggacgatggaggaggaggaggcttgtttgtgggggcagaggatcttgccccagcagcctttgcatgtcaagagtggtcttgcagatcgggccccttgccctggctctgtttaactggtgcttactgagccgtgacgtttgtgctgggcatgggcaggtgcgacatggacagtgagaggaggaagacaccatccctggccccgaaggaggttttaattcaggaggagcaagaaagaacagtgttggaggctgccaggactgagcctgatgccagaactcagggcccaggagccgtgggtgagagcagtgggcaggagggcgtgggggcctccagtgtccactgagccctgtgaggagctggtcacacactggtttgctgtgggagcagggacaccttaacatgtatgttcatgtcactggtgacttgacgcttttcagcttcctctgttcttaattccatttggagcccaggcaggatgatagcagaatgaatggaaggggttgaggagtgagagccggtgaatgagaggggccttgtctgtaggcctttgtgggtcagggcccggcaattgattggtgagtgttacagtgaggatgatcgtccacctcttgggtcccctccccatgcctctgcctcgtcgccatccagcctggccatggtccctgcttggctctttgtggactccctgatggggctgtgcaggagctctcccttggctaatgacggggtgagctcagctcccctcgggcacagcccccagacagccctgctttgcagagttcagctctggggctgctcagaacatgggagctaccttctgagtttccggaagaccaaaggacttcacatttgattgtcctgctgagagtgaggttcacagtacccagactccccagcaggaagcatttccaaaccgtttctgcagctctgggtgcaaaattcccagggctacgggagcctgcccttccctgtgttttcctttctcagagtccgaaggaggctctggggccacagctcacctgcgggggattccgcacaccagcacccggctgtgtctcccccatttcttatgagcagcgataagtcaatccccttcgacggtttaatcctccagcgactgtttacagagaactttctgtgtgcttggaactttataaagtgcatccctcttctcagcaaccctgggaagacagtgcaagccccgttttcccactggggaagctgtgattcagagaggcggcgctgcctgcccagggttagagagcaagaaagtgctggagctgggattggaaccaaaggctgtttggctccaaagcttacactgtttctactcaactctgtagctgccacatgctggcatggatgtcgggggtatacaaggacaggagacagagcctgccctcaagacatttgtggctatgagggtaaggcaggcaggcagggctctggaggatggagagacatgcgccaggcacggggtgatatgggagcagaggggcacccgagctatgcagggtgggcaggcaggcggccaggagagggtgacagggcatgggaggtgggctaggataggagacgggctgtggaagacacgagggtgaaactgcaggtgggggctgagtgggcctggccagagaaggggtgaagggagtgtggggacagacatgggaaccggggttggctgcagaaagggtgaagggggtagggggacagatgggaactgggcttggctgcacaggggagagcagcctcgctgtcaggccacatggctggatcacatcctgttcatccaggagtgcaccacggcctgtctcgtctgtaacagataaggtccttggcttagtgagtacttttgcttttcttaatgaattagagcaagaatgaatgaatgagtgaatggggacattcaaggttatccccatgataacacggttgtcactcctgatgacttttcctctggtgctgggaggcaactccagacaacttgacattagctctgcctcctggtgaatctcacgttcaccgaagagcatcgctggagaggggacacctgaggtgggaggggggctgagtggtcaggctgctggaaactgttgggctttgctgtggcacgaaacttcacccttacccacgccactgcaggactcctcctgccagcctcggggagccgggtgagagtcagaagggtgggtctaccttgcactgcagaaagcagctctgagtttcctggaagccctggggaaaagggaaagcccagaagttgtcactgggggacatggttctaggtgagacccccctcctcctggccttgtggaatggcctggctgagccctagctcattcgtgcactgaccttatccattctggaatgtttctgcaagtttcccctcctcccctgctgagaacgggatggagcatctgaaggacgcatagtctagaagtgcttacagtggctgatgactgatagggtggtttagcaaggtgctgcctcacccagcagacagcagccgccctctgggccaccccgagggcccagcctggaagaagaatgtattcaggcagggcacccacagttgtgtgtgcggaaacgctgccaagcccagtgggatttaccctctaggggctggaaagccattaggaaggaaaagtggtgcttcttaaagcccagttttgtaacatcctgccgagaggtgaccttctgcccagcagctggggctgtcgtgctaatgctttctggcatttgagtcctttagaatgaggtccaagtatgtgggcacctggcacccggccgctcctcccttggggcacaatggggtcttctcccttccgtgagctgaggggctgggagggtgcccactggggctgtagcctgggctggggcatggggcacaagggcctgtgtgcccagctcatttgggccgtggcctggctctgagggtgtgggccggctgcttggagcgtgatcctttcatctgccctttttgcgagtgggagataagatggccaggctgcggttactcctgaacctgtgctctctgctttgccagtcctgtcctcaccagacttctcacaggtccccgtttctgtggaagaggggatcttgtggtaagtcaagggcagaaaccatcaccagcctcggtttcctcaatctgtagcttgaggcttatgtcccccctcctgcccctttgctcccaagattaaaggagaaaacacggatgtgggtcacagaagctggtctagaaatggtggtttttaggctgggtgcggtggcttatgcctgtaatcccagcactttgggaggccatggctggccaatcacgcaagttcaggagttccagaccagcctagccaacatggtgaaaccccatctctactaaaaatacaaaaaagtagccgggcgtagtggtgggcacctgtaatcccagctactcaggaggctgaggcaggagaatcactcgaacctgggaggtggaggttgcagtgagctcagatcgcgccattgcactccagcctgggcgacagagactctgtctcaaaaaaaaaaaaaaagaaaaaaaaagaaaatttttttttccttcttacttgactcagctcgttgcattttgaaccccctccctgtttgcagtctctcctctggaaagagtcatgtcggctgttccctgacctgctgggctgggctggccggcagcatggccgtgcctctgtcatcaggggctgtctttcttgcctactggactgtgaaggcagggaccctgtctggacagggaccgcatcagcatctccagcatgtggctggagcagggatccatgtgtgcttggatctcaggggctgagccgcagccctgtccaagctggattcagatgggggaggattcaggtctttcttctaggaaggagtggggtgtggactcgcagctggggtctggtggggttttcagtactggtttgcagagtgactaagggatgtgcccccagcctgatgctgtcgtcaagacagaaggacgtgcgtgtcctggtggtgcatctgggagggccctccacccgctgagtggtgagccacctctcagcttgttctcttccctgcacagtggacgcggatgtcctcctggaggcctgctgtgcggacggacaccggatggccactcatcagaaggactgctcgctgccatatgctacggaatccaaagaatgcaggtacgtttgccagtggccactgtttcactggaacaatgttcctttagagaaaagtgggggaggaagggacagtgtgtgccagacctctcgggagaggctggacacccaggcccggatccatccaggctgcgggtgctgcagtgggtgactcctgcctccctcctggcaccggcctggcaccgggccttggctcacccttcctgtgccactctgtgattgtcggggtatgtgtctctttcactgggctgggagcaagaagatctgggcttgcagctgtgggcaagtcagttttctcttttaaaaaaggggggacagttgtgggggagcaaaggagatgatgtgactaaagagctttgcgagtggaaacacggaccacctacagaccccaaaaatgccaatgagccggcgcagagtgaagcgttccaccagccggtttttcagcttctgcagcagccaacatctggatcgaccgtttttattcttctctccctacattgactccagctctctgaaaattctgagaccgtgtaagcttagaataaataatgagaagccgggcgcggtggctcacgcctgtaatcccagcactttgggaggccgaggtgggtggatcacctgagatcaggagttcgagaccagcctggccaacatggtgaaaccccgtctctactaaaaatacaaaaaaaattagctgggcgtggtggcatgcgcctgtaatcccagctacttgggaggctgaggccagagaattgcttgaacctgggaggcggaggctgcagtgagctgagatcgcgccactgcatttcagtctgggcaacaacagcgaaactctaactcaaaaaaaaaaaaaaaaaggaataaatgatgagattaggtcatgctgatcatcatcataaaaataatagtgaaaaccccagaatgcccgtgtggagcacctactttctgtgtaccgtctgcacggacagcagccagtctggccccgggaaggacaagggctggggaggtggaccaacctggttgggtttcaggctgggtgacctgagccagctcaaaggcaccatgatacctcctttctggggttgttataatgatcagagatcacccgggcgcggtggctcacccctgtaatcccagcactttgggagaccaaggcgggtggatcacctgatgtcaggagttccagaccagcctgaccaacgtggtgaaaccccgtctctactaaaaatataaaaattagctggttgtggtggcgggcgtctgtaatcccagctactcgggaggctgagacaagagaatcgcttgaacccgggaagcggaggttgcagtgagctgagaccgttcattgtactccagcctaggtgacagagtgagactccgtgcccccaccatcaaaagaaaaaaatcagagatcacctatgaaatcagcaccacaaagccagactgtggcaacgtattggttttctaggactgccagagcagagtataaggggcagggtggctcaaccaccggttcctcatagttccggaggccagaagtctgagaccgaggtgtcagcagggtgggctccttctgaggctcctctcctgggcctgtagatgccctcttctccctgtgtcctcacacggccctccctctgtatgtgtctgtgtcctgctcaccgcttcctcgaaggacaccagtcctttggattacagcctgccctaacaacctcatttaactatgtcacccatttaaagtcactgtctccaaatagagtcccattctgagatactgggggttaggacttcaccagatagattttgggaagacacaatttagcccataatagggagccactactattaatacttagtgaaataaaagaaagtgaggcatcagcccgtgtaacccctcaacgtgcaggcagaggaactgaggccgcagattcagcagcactctgggccttgcttgtgaatggggattttagtcactatcaaatgtattactgacttctactcactaatgtctttggtaaattttggagttatcttttttctttattttttgaaactgagtcttgctctgttgcccaggctggggtgcagtatgttgatcttggctcactgcaacctccgcctcctagattcaggcgattctcctgcctcagcctctcgagtacctgagattacaggcacacactaccacaccaggctaatttttgtatttttagtagagacagagtttcaccgtgttggccaggctggtctcgaactcctgacctcaggtgatcctcctgccttggcctcctaaagtgctgggattatgggcatgagccactgcgcccggccaattttggggttatctttaatctccattgagtcccagaggacaaacacattgccttcttagaaatttcagacatacattagatttcctggaatgtaagaaataccatcagaatggctgagagggcattccttctctctttaagtgcgggtgcaagtccagactcctgggtatcgtgagtttccatatgacagtgtccctgaaacacgtggctcaatgcccaggacaccactccagggtcaccagatgcaagtgactggcccattgtgtcacttaggccccaggaggcccattgactcatcccagtggacacacaggccaggggccacatacctgtcctaggctgcctctcaagtgagctactgagctgcccagctctgcctgcgtcactgccctgtggccccaggtgctgtccgctgccctccagcccttcctgtgtgcttcccctttaccctgttctcactggggtccaaaccccacgcagcctgtgccaatcagaggccaagcctgggctccaggtcacagtgagacggagcccacataagggttcaggaggcagtcactgatgtggctgtgggggtcctcgggtgagcaggaccccgccccagcctccccaacctggggaggtcagagctcctgtctggttgaggcaagggctgtggatgcggggtgtggccagcagtgcagtgatgctaatgaagggattttctaatgagttttgtatagattttcatttttaatgaaggcagggaagggatagggcagatcagaaatcaaatcttatttacaagaatcctcttaatagtgatatttaaaagatgcaaaaaacagggatcactgaccacctggtttgtctgttgtgttagccagctctttttttttttctttttgagatggagtctggccctgtcgcccaggctggagtgcaatggcgcaatctcagcttgctgcaacctccgcttcctgggttcaagcgattctcctgcctcagcctcctgagtagctaggagtacaggtgcctgtcaccatgcgtggctaattttggtatttttagtagagacgggagtttcaccatgttggccaggctggtctcgaactcctggcttcaagtgattggacgcctcagcctcccaacatgctgagattacaggcatgagccactgcacccagccaaattctcttcttttgaagtggctttctgtgaggctcaccagctgaagtaaaatcagtttttgttcattcaacaaatctttattggttcttgatgctcaggaagaggcaggatgaaagccatgagcaggcaggcaagcccaggccagccctcctggcagcagtcgagggtgtgaggccctgagggtccatagggcccaaaggagggggtatcagctccctgagtgggtgagaggctcagagaggactgcagggagaggccgacctctccgcaaccatgggctgtagccaagcaggggttaagcagcctgcagcttcaacaaggacgtgtttggggtggtcagaagatggcagctttgatgttttcccatcatgaatcatcttgactctaggtctccaccaaggcccgacattccttgggatccagatctaaatccacctaaaactttggattagattaaacccacatgtccttcagcgtcttttggaggaatctggacacatccagtgaaacctaaagcaagtcccaagctgacattttccagcccagcatttctctaaccccttctttattttgcaaatctcactgagagcctgctaggtgccaggctccgttctggtgagtggggatcaatcggtgaacgaaatatgcaagtcccctggcctcgtggaggcggcattctataggggatgcagaatgcaaagaaagtaataagtccgtctgatggtttgtaggaaggcaggatgtgccgtgggggaaacagggaggcataggggcttctgctcatggtgggtttataattttagagccgtggggttggcctcactgtgccaggacctgaatggggcgtgggcagtatggaaagtgggaagagcatcccaggccgagggaacagccagcgcaagagcccagaggagagggtgtgtacagcaaggcggccagggtggctggagtggagccagcaacggccagtcccagggaggaagcaccagatacaagggtaaccaggtggctgagggggccatgagatagaggctggggtgttgggggtgagcctgaggcagctggacaccctgaggtgcctgggacacttgattgcttccaccttttggatgttgtaaataatattgctgtgaggccgggcgcagtggctcacgcctataatcccaccacttcgggaggctgaggcgggcagatcacttgaggtcaggcgtttgagaccatcctggccaacatggcaagatctcatctctactaaaaatataaaaaattagctgggcatggtggcaggtgcctgtaatcccagctgccggtgaggctgaggcaggagaatcacttgaacccaggaagcggaggttgcagtgagccctgatcgcaacattgcactccagcctgggcgacagagcaagactccatctcaaaaacaaaacaaaacaaaacaaaaaacaacaacaaactgctgtgaacatgggtgtgcaagtatctgtttgaaaccatgcttcagttctttggatatttacccagaagtggaattgctgggtcctatgattattctatttttaattttgggaggaactgtgctccacggcagctgcacccttttccattcccaccagcaatgcacacgggttccagcatctccacatcctcaccaacacttgtgattttctggctagccaatagtttttgaatggatgcacgcatggctggtggctcgctctggcagtttagtgaaacgccgttatttgcaaatccaccgaaagcatgagtgaaatgtgtgctagctcagctcggtaattccatcctggagcctgaaggcagttttgagacacacgggcagccgggttcagacctccagtcccccagggaaggttgggggaaggtgcactggcagctgccatttttgtgcagaggtggcctggctggcagtgcagggaagctggggaggcccccaccctctctcctggaggcacgagttgggtggctcttcctgcccttgctggctttggctggagctggggttattttgggtctggtcaggggccacccgtgacacactcctctcctgctcattgcctttggagcccgcccacgccagcccctagctgtcacagcctcatggttgtgttggaggagctgattttggcaggtcgaggacctctccccagagccccggcagggctgggaggtgtgggctttgcagctaggtgccactgcagccaccatccctccctctggggccttgggcaggctacccaacaggactctcagaagctgtttgctctgagcctggaagatggaacgagcactgagaagagcttgacctgataaaggggtggaaggttgggcccagagtcagccccccgccgctttttggttttcaaatcagcaggaacattgtgcgggtgaagcctagtgctcagaggagtgacgcggccactctggtgacaaaactgggcctcctggctctgactccagacaccatactacattctgtctttctttttttaaaaaaagaggccaggcatggtagctcacgcctgtaatcccagcacttcgggaggctgaggcggggggatcacccgagctcaggagttccagaccagcctggccaacacagtgaaaccccgtctctacaaaaatagaaaagttagccaggtgtggtggcgcatgcctgtagtcccagctactggggaggctgaggcaggagaatcgcttgaacccgagacgcagaggctgcagtgagctgagatcacactactacactccagcctaactccatctcaaagaaagaaagaaagagagaaagagagaaagggaaagagagagagagagagaaagaaaaacagagagaaagaaagaaagaggaagagaaggaaagagagaaagggagaaagagagagagagagagaaagagagaaagaaagaaagagagaaaaagaaaagaaaagaaagaaagagggtcttaccatgttgcccagactggtctcgaattcctgggctcaactggtcttcccacctcatcctctcaatgtgctggcattactggtgtgaaccactgtgcccggccaagcctttctaactaaatgctaattgagctccttctgtatgccactggggcactgtgtatttctctctctgtgtctgtgggagcagggaaggggaggctcaaaggtgagagcacccccacccccgaggatctcgtgccctgggccccctgcgcacagagccttggcccagcccacccctcacccacaggatggtgcaggagcagtgctgccacagccagctggaggagctgcactgtgccacgggcatcagcctggccaacgagcaggaccgctgtgccacgccccacggtgacaacgccagcctggaggccacatttgtgaaggtgagagccaaagaccatgtggggtcgctgcccgtccccactagtcggcagacccaggccctcccagccaagcggcactgtctgtcagcgctccctgcctcaggccacctttctttgtgagcagctgggggttcctgggccaggagggaggtggaaaaccccactgtttctccccctccactgtagccgtaaaccccggaggacacctggggccgagtctcccacgaggccggggggtgaagtgagctggccttgccctgagaaccgcctgtctccaggcattgggcagatgcagaagtcaaagcagggctcctcctgggcttccagaatcttcttctcaattcagggtcggcaccctcaccctacccaggaggctctcaggcttctctacccacagactcgtcagggtccagaggtaaaaatgggccctcactaagacctctgataagatctgacctctataacgaccctaaaagaggaaactgaggttcagagaggcccagcctccaaaatggcctctctgcagtcctgtcagggacccagacgggatcctgccctgaaggtaagctgtgaataaatggcatagtcctcttccctgagtgctcctaggaccctacgtgctagcaggtcactcaggaccgctatggccgtggaagggctgtgtctttgcaagaggtggaaaggtgcctgacagcattgcctacaggcagtaaacccaaggtgtccaggccatccctcccttaccacccagccagcaaggaaaacaagcccggccaggaggaacttgggcctggaggagctcgggtttggaagctgggcttctgttggaggtgccagatgacgaaaatgcattccctggaagaagcttcccgttccttttaggaaggtgatggaataattttaagaaacaagaatctgaatgaagtctggattccaggagagggtgtgggagctcctttgtggggattctccacatagattgggctgtggagggactccgtgtggaggagttgggggtcccgagtcccctgcccaccttggcctgtgtgggctttcacagggcagggctctggcccaggagagagctgggtggggtgatggtgggggtgcctgggaaccaggactttgggcgtttcatgactgcccccgcaccctcccacccaacacccaatgcagggctgggccttgcagatgccgtcggtccggcacacagctgtgcccatgtccccagacttgagaggtgtggaaaaagcacagaacattctagcaggagtgggaacagatctctctggcagatgagcgacttgtgtttccaggaaggattactcacaccccaaaagatggatgaggtgactgatgctccctacactttctggcagcggagggcgtagaataagcagcctggaagacccatcagtgccacataactgaggcaaagctacacctcctggctcctgctggggactgtttagaaagttctgtgctcctcttaggataaccacttaataaagactgaagcagggcttttcgtgtgtcagggcaaatgttgcttctgggactcaggtgtgaggccacagggacttggaagtaactattgggacctgggcccaggtggcagacagccaccctgtcctttgaccttgcttgatgactcgtcttgaagttcctgtgctttcaaatgcacggtgcaattcctgctgccagaacccctctaactcaaaaacggagaggcagcatgcatgtgtgtcatttttccgggcatggtagagaaatctcagaccatgcaaaaggaacagaactttggagctggtgcatggtgctataagaagctccctcttcctggatgtgtgcgagcagagccgggtggtctctgggcggggcagggatgttgaggggtgcaattgcatgttggggtggggaggggaggtggatgccaggccctttaagcttcctttcaaaactgggacctagatgatttggagtagggggatggccttgctttgctatttgttgctgacatttagaagtggtatctaagccagacttgagtcatcactctacaggttgtgtggacagggggctcagagaggcctcccctgaggcctctcgtggaccccgctgggctgtctgcccgctcctccatctgggatctccacctgtgtttgcagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacgggtaactttcccccttccttccctaatgagcagtgtattaaggttctccgggatgtgtatatagagcgagagtggagagagagagattttaaggacttggctcatgtgatcgtggggctggcaagtccaaaatctgcagggcaggccttcaggctggagccccagggaaggaggggcattgcagctggagttcaaaggcagtgtgctggcagaacgccgcctttcccggggaggccagtcttttttctctgaaggccttctgctgattgagtgaggcccacccatggtatgaagatgatctgcttttctcagcatcaacagacttacatgttaatctctttttttttttgagacagaatctctctctgtcacccaggctggagtgcagtgcagtggtgtgatcttggctcacggcaacctccgcctcccgggttcaagtgattcttgtgcctcagcctcccgagtagctgggattacaggtgtacactaccacacctggctaatttttgtatttttagtagggatggggtttcaccatgttggccaggctgatctggaactcctgacctcaggtaatccacctgcctcagcttcccaaagtgctaggattacaggtgtgagccatcgtgcctggccaatattaatctctaaaatatagcttcacagcaacatccaggctagtgtttgactaaatatttgagtaccataccccagcccaattgacacttacgatgaaccattacaggtaacacgtgcatccgtgtcaccattgccttaactcagcacggactaactccggttgtcggagccattcatgtttgtgaccttatctgaaagccgctgtcctggagtgacgctgagtgcttggagtctgggatcggacaaatctgtgctcccatccgggtcctaatgtgtaccttggtcccctcatctgggaagtggggatagttgcagtcctacttcatcaggtgctgggaggatggagtgcgagattgggtgtcaagggttgggtagagcacctggccccataaatgtctgccctcaccatctgcccttgtcccttcagctgcccggggcagcatgggtggctggccttgctcccacttcttgggtgagggtctgatgctgaagatcgcacagccgacacgtggaggagggagagcctggccttccacctcctggccagtgccctctccatctggagctgacgatgtatgggcgagcagctgggggccatcgctggctaatagctggctatgctctgtcaaatcatagacacttactcagcaaaggggcatgtgaccccaagagcagcttcaagagcgctctcagctgtgtgcccccccgttctgtgtcctcgccctgcatttctgtgtggttcagttacagggttcaggagactttgtggctgtccagtagcctcttacacttaggccacggtttcttgtgctgtaacagaattaacctggaagaaggcaggactccgcctgggccaagcttgctgtgtagttttcggcctgttccctcctctctctgagctttgcccccactctcttaaaaaataaaagaggtgtgagctgggcacggtggctcacgcctgtaatcccagcactttgggaggccgaggcaggcggatcacctgaggtcaggagttcgagactagcctggccaacatggggaaaccctgtctctactaaaaatacaaaaattagctgggcgtggtggcgggcgcctgtaatcccagctacttgggaggctgaggcagggagaatcgcttgaacctgggaggcggaggttgcagtgagccgagatggcgccattgcattccagcctgggtgacagaacgagactcagtctcaaaaaaaataataaaataaataaagaggtggggaggtgccggaaggggcgaaagggaagaaccctcagacctgtagtctctaagtcaaggtaatggctgtagggtcctgggtgacacggaacctttcacttcttgttcttaggttttcaagtccaggctgtagggcccctggtcacagaggacccgggtcacccgggactcatctttcacttattgttcttagtttttcaagtccagggccccatggatgccactgagatgatttcagatgttacagtcatcaagagggattggggccgcattctgcctcattccttggcttttgaaatcagagacgacattttcactttaaacaaacccaaaccattcctgctggtggaggatttctcctgcatctcgggggtggattttcactgatttatgtctgcagcgtgagcagtctctgggcttttctgcagctccagatgttagatgttttatctctccgtcttttatctgcttcagtccttgccccagactatcctcgcatgctccctcctctgggagggcttcctgtcttcacagccgcaccttcctcccactgctaccagtgccatggacccactgtatgtttcctgggggccatgcagaaggtccccagaccagtgctggcctgcgacaaataagtacagaaatggagaataacccttttcaaacacataatagcatttgatagaatcaatcaggagactcaagtttttactgcgtgcattgctttagacttggagggcgtgtgttggttgttagcaaggctgtgactgcatttgctgagatggtcaagtaatttggactatgggaatatcacccagcatgaagtcaatgattacaggcctttgtgtctgtggtctttctgttataactgatcttttttttttgaaacggagtctcgctcttgttgcccaggctggagtgcaatggtgtgatcttgactcactgcaacctccgactcctgagttcaagcgattatcctgcctcaacttcctgagtacctgagattacaggtgcatgccgctacacctggctaatttttgtatttttagtagagacagcatttcaccgtgttggccaggatggtcttgaactcctgacctcaggtgatccgcctgcctcggcctcccaaagtgctgggattacaggtgcccgccaccacgcctggcctataattgatcagatatcaattatacattttcaagtgtaattctagcttaaagaggataaagttaatacttagctgtttatataagatgttcaaatgggcattactgcctgatagtgacaagaagagagaatgttgggagtttcttttaagataagatgggtgtttggataaatgtctgacttggtctttttcccccttagataagatcattgaggttgaggaggaacaagaggacccatatctgaatgaccgctgccgaggtgagactcgggcgtctcccatcagttggtatttaaacaaaccccaaggggccagcaaggtggctcaggcctgtaatcctagtactttgggaagccaaggcaggaggattccttgagcccaggaggttgtggctgcagtgagctatgactgcacctttgcactctagcctgggcaacagagctggaccccgtctcaaaaacaaaaaaacaaacaaacaaaaagcaaaaccaaggaatctcggtgctgatctcactggaagttggaatccaggttttgctttggtttaccctgcaaagtaccctttggctgggagccagccatgagccacttccaccctgaggagtcgtggactcccagctcctccttccctttccccttccagatctagggctggctggggaggggaagggtgggcttaccaaggaggggccctggtgaggccctgctggggagggtggcccaggcccagggccagagctggtgtggaaagcctgcacgttaccgagcccccaggccttgtgaaggtgacagaggcctccctcaggctctcaggggagaggagggggctcagcgttccctgcctttgtgcccctggagccccagccacggttctgtcaccattggtgatattcatttgcctcacagggagatgtctgcacatttaactaagggcctcgcaggtttgtttttcatatgataaaactgcttttctttcatggaacattctggcatgtctagacctgcagatctgcctcacaagctctttcagtggttccccctgtggttagggtgttaattaggggccagtttaattcttaaatgatgcagtcagtgtacagtgacagttggtccaggggcgctgtccaggggcctggtggagggaggaagggagtgacctagagccccagcaagcctcagggctatgggaggagctttctggggaggggagagctggtctgcaaggaggaggtgggattagctgggaaaataaccctgaaacggtcctcagggagacctgaagccttgtaaagggcacggacccactgtagcagggtactgggaggcagtgggctggggaaggaggtggggttacagggccagagagaggggccctagaagcaggcaggctggcagcagttagaagtgtatctcgtagaatctttccctggttgaggcttatcctgatgagatttgcactctgagcatcactctggccaccctgtaggaagaacaggttgtggggtgcttctgggctatgcagaaagaccaggtaggaggctgtggccacagccaggtgggcagctgcaggaactgaggccatggtagtgggcttggagcagtgggacagctcgagagttcagtgaggagcaggtacatgaggcctagttggggcctggccttccacgtggagcccacacccccatgtctgtgaccggcagtgagctcttctctgcttcgccccttccaggtccaccccagcctacaaagggcaccctgcacaccacctgattttccagacggggaggttgggacctgaagcagcagcccctggggggtgtccagagccagagcctgggggtctcccagtagggcagcaggtgggctccagccaggtcagcctgccttcctgggttcgtctgcccagagggcgttttctatgacccagcctgaacggagctagaaaccaggcggtgcctgggtgcgtccatccctggctcatgcacgctgtgcttccaggaggcgggccctgcaagcagcagtgccgagacacgggtgacgaggtggtctgctcctgcttcgtgggctaccagctgctgtctgatggtgtctcctgtgaaggtaatgtccctatcccaggtgccagcaggactggccggtcactgtgcttgggagctctgtgctggaggactgaccagggcctgccttctacaacccagaccccattcaggggtggagagcagcccaggacgcgctttctcgtgttcgctggagtttgcagcgcagaggcccctgccgagacttccctccaagacaatataagcactggggttgggaaagaggatggagttggggtctaaccaggttccggatccaggatctgctgagtggccttgggcacatccttcagcctctcctggcccccgcgtctgtgagatgggggagatggagaagatgctgcccctccgtggggttcttgaggaccacataactacagtctcagaaaaagcagtagatatgaacgttagcaggggagagaaatcactgctttcgactccgtgcagtccacagcccggatgtgcacatggtggacctgagctcagtttgcgagggtgcagggaagcacttccaccgtggctttggcacattcctttctaggatgtattaggatgggtcgttcttgctggtcacccccgcactgcctcggtctctcctagatgtcaatgaatgcatcacgggcagccacagctgccggcttggagaatcctgcatcaacacagtgggctctttccgctgccagcgggacagcagctgcgggactggctatgagctcacagaggacaatagctgcaaaggtacagcatgcgctccgagtctgcaaacctggtcttccaggcgtagatacggcgcggtgggaagggcagctctggggtctgggctcccgcagtcctgcgccctctgtggctgcctgggcgactgcctgctcatctgcaggagggaggtggttatacccaccagggtgtctggacaggtgggatggaaggtgaaagtgcttgccaataatgttcagaacattgaaaaagttgacagtagtgcaccggtgccagctagttcagctgttaggaaagatttacgttcttatggtgcagagtaaacgatggcagatttgggtttctaaaaaggctcagtgcatgactatttaaaatcaagaccagggatgaatttcaggttctcacatgtactttctacaaaaaaaaaaaaaaaaaaaaaaaaaaaagcaaaaacaaaaatcccacaactgtttttgcacaacagctgccttccatccaaatccaggcttccttgaagttcaaagcatatccccttccactgcataaacacatggcatttctggctgccagcctttccccgccaagccttaggtgttatttggcagatggggaggctctgatgaggatcgtttagaacacagttttgcagagggtttcaagcctttcagaaggacaaatccacttgtgtaaaaatgtcactcactgtatcatgagagtgacttcaaagcatggcacaccccttctgacatctgagggccacagagcaaattctgtcctccccacccccacacaccagctgggtggtttggacccctagagcccagtggccaagccagctgagtatacacatttgaccatttgacagccatgaacttcaagggaagggcagcccatcacatcccatcatgactgtaacccttgttaatatctggattattgtgaagacttcagaatggatatgtttatagagactgtgtttgttgccactaagataattgctttatgatctaaactaaacatacacttagcctgaatgaatactaatatatatatacctgccaggaaaatgccagggtgatttattataacagacagtttgcctcataagagccttgggaaaaaaagtcagctttttaagtctttagcaactggagcacgatttggctcagtgaagtcttttttgtgtatgatttctctattagaatgttttgggttatagtctgagtaatgcgcattagaaaaaagctttcttgtgattttaaagtgttgtaagatgcttctggcaggactcttgctaacaatttcctttttttatgatgtaccagatattgacgagtgtgagagtggtattcataactgcctccccgattttatctgtcagaatactctgggatccttccgctgccgacccaagctacagtgcaagagtggctttatacaagatgctctaggcaactgtattggtaagaggtgtgccgccaggattagcgggttattccaggaggggccagcgacctagccttggggcaggcctctagaatctgcggggccgcatggtatacagaacaggggttggcaaactttttgtgtaaagggctggacagcaaatagagcaaatactttagccgttgtgggccatatggtctctgtcataatagtcaactctgctgttatagtctaaagcggccaagggccatctgtaaacaaatgggtgtggctgtgttccaataaaactttatttacaaaaataggcagtaggctggatttggcccaaggaccacagtttgctgatctgggtttagattaaagagcttgggttttggagttagagtgacccaagaaaattacttctgagctttaattttttcctctataaaatgggagtaatcataatacctggcttagagacttgaggccaggattaggcgagtacttgcgaagtactggtacacaggaagcactcggtgagtggtgattccctgccacaggcatttagcctattaaaaaattattttaaaaaatacttggctgggcacagtgggtcacgcctgtaatcctagcactttgggaggccaaggcaggaggattgcttgagcccaggtttttgaggccagcctgggcaatatagcgagaccccatcactacaaaaaattagctgggtgtagtggcgcatgcctacagtcccagctacttgggaggctgaggtgggaggatcccttgagcagggaggtcgaggctgcagtgagctgtgatcgtgctactgcactccagtctgggcaacagagcaagaccctgtctcaaaaataaaataaaatataaaaataaaaaacagtctgtgttagtatttgaattcatagagacagaaagtagaatggaaggtgccggggctgggcagggtgggggatggggagtgagtgtttcctgggcgcagagtttcagtttgagaagatgaaaaagttctggagatggatgggggtgatggtggcacgacagtgtgaatgcagtaatgcccctgaaccgtctacttaaaatggttacgatggcagattttgtgttacataaaatttgtagttcacatgtagttcaccacaatgagaaaagaaactctggccaggcacggtggctcacacttgtaatcccagcactttgggaggccgaggagggtggatcacctgaggtcaggagtttgagaccagcctgaccaatatagtgaaaccccatctctactaaaaatacaaaaattagctgggcgtagtgatgggcgcctgtaatcccagctgcttaggaggctgaggcagcagaatcgcttgagcctgggaggcagaggttgcagtgagctgagatcacgccactgtactccagcctgggtgacagagtgagactccatctcaaaaaagaaaaaaaaaaagaaattgctgatatcagagaaatactaatatgaaaagagagaatcccatgtgaacttagtatgaatttaggaggcctgggcaagaccgctcacgctagaggagctgtgtggggtgcggccggggagctggccggcctgggttactggttctggaaagacaggaggtgagtcctgctttccccagccgttgtcaggttaactgcctggctaggccgctgcagtcagcgcttaagtcctgatccaccggctctccctcggcctctgcttggcagacgcccctgggtcctgcctttgaggtcagagagactttttaggagaagaggtgaggaatccgagctacagatcacactagtcagaacctccccacctggggtggccccatcacctctcccctgccatgagcaagggggtatacatttccatcttgcttcgatttcaacttttccttagcgaaatctgtattgatcatttatttgaaatagtggtttggagagagagctcttcccccactgcattatttttaaccactgagatatttaaagataagtggatgtggccgggcacagtgactcacgcctgtaattctggtactttgggaggccaaggcgggtggatcacttgaggtcaggagttcgagaccagcctgaccaatatggtgaaaccccgtctctactaaaaatacaaaaattagccgggtgtggtggtgggcaccttgtaatcccagctactcaagatgctgaggcaggagaatcgcttgaacccaggaggtggaggttgtagtgagccaagatcgtgccactgcactccagcctggacaacagagcaagactctgtgtcaaaaaaaaaaaaaaagataaaaagacaagtggaacagtgagcccttaggacaggggcctcgtctgaaacccgccccagccttcctctgttacagcttccctgtcatcccctgggggagacttctgagctggggcgctgtggctcagctgccagttggcccctcgccagtcccttgccagcagggaggggtggttttcgctcagcgcagggggtggtgagcagggaagccatgggctctccgggaccagcggggaggatagtcctgctcagacttgcagcctgctcaaaggggggtccggaggaggctggcgtcgactgaggatggaaaccctgactcatggcaaaatcagccccgatttccacaaagaggcaatgtttgcaagtctcaacctagccctgactttcctctctacagggtgcagcactgtgtatgggctgaggctcgggagccgtccccttactgtccttccaggactggcaagcaggctgtgggctgaaggccagcctggcggcactgagctgttccgtgccatctccctgggtcctcagtgacagcatcgaaagccaaatgttcagctccctcagggtccccttagcttgggatgctgggatgaggatggggttccccttttcatgtgctctcaatccttgcaatcaagctcaggaatcattgttttaaaagatctctatttatttcaaaaattatgtatgtcttgacttataaatcagcaaacaaaacctaagtgtaggaagtaaacgctcctcccctggccaatcctgcccgcctcttggcagggtccatgagcccttctgggctctgctcccttgagactttttgtttttttatgaaaatgggatcagactgttctgccacttgcttttcccccccacttgacagggtatttagaaatcatttcatgtcagcacctttatgttatctttttaaaaatgactgcatcagcagaaatacgtctttctaaggagaaaatacatcaagatagaaggtagtttcaggccgtctgggagagggctgaaaaggttctatgtcaggtcctggtcccccagcacgcaccctgggtcctctgctcccacacctctgcccatggtacccgctccctcacccaggaacagcatggtccgtggtgggaagcgttgatttccttgtgtagccagaatccatcttcctggagctcctagaaccatcctggggccccaagagcccatccgagcctcctgcctgtagcagaagagctcttcctgcagagctagtacaagggatgggtcagggtcccagaaagtggaggtctctgcccctatcatgcatggagaattttctagaaccttaaggttgggtcaccgagggctttgagaccagcatggctttgtcgggttttctttgctcttttcttcaaattccctcctcctgctgctgtattcctttctccttctcctcctcctcttccccctcccatcctccccctcccttctcctcttcccctccccctcccctcccacttccctcctccccctccttcccttccccttctctccctccccgcctccccctttccctccttcttttcttcttttttttttttttttgagacagtctcactgtcacccaggctggagtgcagtggtgcaatcttggctcactgcaacctccaccctgctgggttcaagcagttctcctgtctcagcctcccaagtagctgggattacaggtgcccacaaccatgcctggctaatttttgtattttcagtagagatggggttttgccgtgttggccaggttggtctcgagctcttgacctcaggtgatccacccctcggcttcccaaagtgctgggattgcaggcgtgagccaccacgcccagcctctgcctttcttcttgagtggggaggaaggaatgggccagggcttcccacgtgccctggctgaccttgcctggggatgtcggcaggtcctggggcaggaaggggttccactgaatctaggaagcactgggtgaagccaagtgaacggggaccttggtagcttgggcttttcccatgtgaatccctgagagggagagatcgggtgccctgttcccaaactcaccctatgctttacattgatttgctgtctgtttattcattcccattcattcattcattgatagccaggtcttacccctgtggagtgcacgatgttctgagggacactgttgttctgtggaacagagtttggggaatctagtctgagtgaggaacctgcagcgccagtgggaaggcagccaccgctctgctaaacgctgcatttattcgtgttacagggcaggggccacccagctgtttctctaaagggctagatggtaactaacaacttcagtctctgtggcaaccactcaactctgccttttgcagtgtaaaagcacccctgagcaatgcataacagagtgggcctggttgcacgctaataaaactttatttacaaaagcaggtgtaagccgggtttgaaccaagggccatcatttgctggccactgatttaagggagctggaaagcaggagaccctgattctagacctaggccctggttggcccctgacttcagccatgagcccagagtcattcagtctccggaccttggtttcctgtttataaagtgcaggcagtaatgatagtgataccggcctcacctcacttgcaggctggctgtggtgctcgagagcggtcatggatgtaaaagcttttgtaaactgtaaattgctgcacggtcagcgcgaagggctgactcatttgactgaggagggtggacttggctggcagggagaggggtacagctgtcctcctttctgacttacgctcaggggtcttccaccatcactccctctctttgttcccccataccagatgctttgtaagtgtctgagcaaggttctccaaggtgatgtttagatgcttaggtccttttccactccctctatcaggaagtgcaatctgtgtattcttcctccgaatttgagcagaaggagggtatccctgtgtagcatggccctcctggaccattcatgggttcacacttgctcattgtatgtcatcaaaggtaaatgccccacggtccccatgtcagagatgtgtccactcaaggaaggagactgccgtgcagtgagctcagggagccatggcacctcccgggtgggcctggctcagcataggccctgtgaagcccagtcatcggaggggcctagagccttgctgggagtcagagttgctggcaccacgtggacagtcacctgtctccttaataccgtgcccagtgtgtggagtagatgaatgcaggagaagccaggcaggcaggtcccgatttggcgcagcgaacgatggaggtgctggagatttagggacaggaagaagggccagagaggtggtgtttgaggcggtatgcagtgataaaatttgggagccagctgggaggcggctgtgtggtccagagtgagggggttgagcccctccatttgtggttttgcaaagaggtgggaaggggagtttctttggagatccagtttttgggttctgggacaccctccaggtttaaccacatggtctctgtcttttcccgctgtagatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttggttggtattaagaaaacaaatctgaaatccactttcctgtctgcttccagcatgcaccctgccttctctggaagcagaaagttgatccccaaagcaaagccatttctatcagcccatccatcccactgtcagttcccaagcatggggcttcattgtcttgcctggactggtgcaccagcccgtctactgcctcagccttgtctggcttgtcctgagcccaaagctctcgcaccccaccctgtttacagttccatcagctccccgttggtgacaaaggatggatgcctctgcttacagtccagtcccccagagctggcccaactccacaaaccttgtaattcaggcaatgtgggtctgccactccccacacaagcactgtcctttcctctctgtgtgggtgtttgctctcacgtcattccctctgcccacctgctcctacgttcctttggatccagggcacccagcctgcctagatcccgccagggaaggagccttcctcgcataacccccaggacacttcttcagtgtctccctgggttcctgggcacttcctaccttaatgagagtcattgctggcctgccagccaggtagggctgcctctgggtcagctatcttcccagtccagggcccggcactcagtaggtgctctgtgaagtcgtgttgaaatggaatgcctgtttccatgtccatgtgttcctttcttgctttcctttctgatcatcttggggggaaaaaacccaaactaaaggttttcatcatggctttctttctcctttgcaagatgtggacgagtgcgcgccacctgctgagccctgtgggaagggacatcgctgcgtgaactctcccggcagtttccgctgcgaatgcaagacgggttactattttgacggcatcagcaggatgtgtgtcggtgcgtggggggccccgcaggcctcgggggaacccagccacgtggcaccagggacacatttctgtggcacctcgagtgatgtggtctgatcctcatctcagataatcccaagtgcaggcagaccctgagagaagatcctgagtcaggagaccccattctagccccagctctgctactgcccagccaggcggccactggcaccacccccctgtgtgtgagcctgctccccatctgtggaaaggggttctgcttgacccaggacctccaagtgctgatgagccaggtctacacatgtgggcagcatcagcgatttcctggagattcaccgctgagctgtagatccccaggagctagagatgtgtgcctttagcccagggcagcgaggggaaaagttgaccaggagtggggtcaggtcttgtccagccagtgcctgctgtcaccaaacctaggtgctcagggaagcctggcagctgccaaccactcccccaaagtgggcactttgctagatcctggcagaccctccttgtgggtcctggggaggaggactggcaggagggcacaagttcagatgtgctgccgcagaaggagcacgaggctcgcccaccaggcaggcacagcgcggcagtcccggctctcccactgacttcccgcatgctcgggacaagtcactttgcattccttgtctgagaaatgaggctggaggccaggcgcgatggctcatgcctgtaatcccagcactttgggaggctaaggcaggtgaatcacttgaggtcaggagtttgagaccagcctggccaacatgacgaaacctcatctctacaaaaaatacaaaaattagccgggcgtggtggcacatgcctgtaatccctgttacttgggaggctgaggcaggagaatcacttgaactgggaggcggaggttgcagtgagctgagatcatgccactgcaatccagcctaggagacagagcgagactccatctcaaagatgaaggaaaaaaaagaaatgaggctggaggaggtggaggacaaaggacatgagctggccttactaggagggtggagtgtggtgccactgtgttggacattgccctgagtcagcccacccctcactttcagatgtcaacgagtgccagcgctaccccgggcgcctgtgtggccacaagtgcgagaacacgctgggctcctacctctgcagctgttccgtgggcttccggctctctgtggatggcaggtcatgtgaaggtgaggctggggccccgtccactcacctcccccaggtcaccttcctcctggggaagccacccttctgcagaccggtttgcagcagatccgcgatggtttccctgttaaatgacatgttagcaggggaagtgcctgtaaaatattgttcatcagagaggactgcccgcctgcccacccgatttctcctgatgacatccaccctccgaggccgtgtcggggttcataggctgcggcagaggccatgcgggatgtggctaggattatggggcttggagcatgacacccacgagtcacagggccttggttatgcccgacctctccctgcctccgtgtcctccccggggagaggggttgatgtgtgaaacagcagcgaaaactggacacttgttttgcacaaagacagtgtgtgggttttaatcagatgctgcctaggggagacaggcctctgtgtccattgatctcaagtcacccaaacaaaaggagggaggctttgtaaatgacgagctgtgagaggaagtactgaggcctttagggcgtgggtcactgtgcacctgcctctaacttctttttttttttttgagacggagtctcgctctgtcacccaggctggagtgcaatgctacgatctcggctcactgcaacctccgcctcccgggttcaagcgattcccctgcctcagcctcccgaatagctgggattacaggtgcacaccaccatgcccagctaatttttgtatttttagtagagacagggtttccccatgttggccaggctggtcttgaactcctgacctcagatgatccgcccacctcggcctcccaaagtgctggcattacaggcgtgagccaccgcgcccggcctgcctctaacttcgtgttggagttaggctttccccacccgcagagacagggagaagcaccctggccttccggatgacgacattccccaggcatgtccccagcccttgagaaagacactccttggttgcacatctcaaagggacagagaaaccgtttacatttgcaagtttttctaaagtagatgcttctaaggaacatggaggtcagcgcctgtagtcaggtttgggctggaaccaagagaaaattcttttggcagcattgatctttctcagacaggcatgtcaagggggctgggtctacatcctggatacctggtcttgggccaatggcagccacgctgaagttgggtcaggtctcttggtatgtgggggttggacagagttgttcctgccaacagtcttgtggttctcagataacaccaacctcctgggctgatgggaaggtcacatgaactgcatgtcagcccagggcctggcacatactaggtgcttggcagatgtcgtgtcttgtatacggattaggttctgagctgagcagacactgagagctttggatggccctccacaatcgtccacattgccgatgacaccctgtttggtgccgtgcactggctcacaggacggcttctgcagcctgactcaaacatggcaggtcctaacattttgccatgagaattttccttcctgatgagatggtcgcaggggttggatatgccacagtgagctgtggtgtgcatgattctcaaatcggaggacggacggtgtgaggggtcctgggcttagttcacaagaacgtgtatggacaaggaacaagattcacgagttgagtctctcaggcttgtgttcaaacctgacttctgccatttccatggccttgaagaagtaactcagtctttcctgggccatggtgtcctcatctgtaaaacgggcatagtaggaccaaccccatagggggttgtgaggatgaaacgagattaagcatgtgaagagcttatcacagggccaagcacaggatgaagagctggcggtgtggaggctgctggctttattattatttagtagaagtagtgggattcctggcttgtgcttcctctagtcattcataaattgctgaaaagtcggcattcatatccacattagtggacaatattgtggatatagaaccagagcctggccaaccttgctatgtgaccttactaaccatttgttagggtcctgccccgggtgtgtagcaagaactcggtcctgcactggggagtgtctctagcgggggatgagagaccacactggacaggtggaggccaggcctggtgtgtgggggccacagagatgaaacacggggtggaaggctattggacgttctgtgacagccacatagtatagatttaaggcttttccagccacaatctctgttgcaaccgctgaactctgctgtggtagcagagaagtggccagaggaccatggtaaaagaatgagtgtggcagggcacagtggctcacacctgtaatcccagcactttgggaggctgaggcaggtggattacttgaggtcaggagttcgagaccagtatggccaacatcgtgaaaccctgtgtctactaaaaatacaaaaattagccgggcatggtggtgcacacctgtaatcccccagctactcaggaggctgaggcaggagaactgcttgaattcatgtccacatttagtggacaatagcctcccggaggtggagattgcagtgagctgagattgagctacttgtactccagcctgggcgacagacaaagactttgtctcaaaaaaaaaaagagtgaatgtggctgtattctttattttattgttattattattttgagacggagtctcgctctgtcgcccaggctggagtgcagtggtgtgatcttggctcactgcaacctctgcctccttgttcaagcaattctcctgcttcagcctcccgagaagttgtgactacaggtgcgtgccaccatgcctggctaattcttgtatttttagtagagatgggtttcatcatgctggccaggctggtctcgaacccctgacctcgtgatccgcccacctcggcctcccgaagtgctggaattacaggcatgagccaccatgccttgccgggctgtgttctaataaaactttatttataaaaacaagtgttgggacaaatttggcccatagactatgatttgctgacctctgctttaggtaaaggggacagttgagcagtagttcagagttgctgagtggcccagtgagttctgtgcattggagtatgaggagtactggcgtatgggctgggtggccgaggacttccttgtgtgccgtcatctgtttaggatgccatcttggaggtgaagtggagagcacaggatcagatttccatttgagaactagaatggactctggcagccaggtcggggcagacttccaggggccaaggctggaggcgatcgctgccatcctggcaggagaagttgtggtcgaagcaggcaggagcagggatggagggtccggagccaccagcgatgacgcctctccctcggccacaccccccgggacctctgtctctccgagtgtgttaacctgagggaggtggagaggagattttctgttcactgaccctgagggctactgtggaggcagggacgtatgatgctctgagcggtgaccctcgttttgtatttcagacatcaatgagtgcagcagcagcccctgtagccaggagtgtgccaacgtctacggctcctaccagtgttactgccggcgaggctaccagctcagcgatgtggatggagtcacctgtgaaggtgcggacgcccctgcctgctgagggggaaagcaccccctggtcttgccatgacacagcagcacggcctctgactttcaaaatccacagggaagagcctgctgggatttcttcacctgacaaaccttccatgtccacccttggaggcaagcgggtggtttgctgttttccctccaactgaggtttttttttttttttttttttttttttgagacacggtcttgctctgttgcccaggctggagtgatatggtgcaatcactgctcactgcagcctcagcttcccaggctcaagtgatcctcccacctcagcctcccaagtagttgggaccataggtgtataccaccatgcctggctaattttttatttttaaaaaattagagacggggccttgctgtgttgcccaggctggtctcgaactccgtggctcaagtgatcctcttgcttcagcctcccaaattgctgggattacaggcatgagccaccgtgcctggcccccaactgaaattctaatatacttttcccatccttaagcgtgagggtgggaaggcagcaaaccactcctgacttgttctttaataaatgtgcacggcggtaattacaacatgcactgggaccttgggccgcatatctcaggtcttggtggtggtgcatggctgagaggtaaggagggggctcagggaccacctatatccctgactcagagctctaactcttcatctgtaacatgatgattaacttcagcctcaccagatcattggaggattaaactagatgacagcaattacaggcaattaagggcaattacgatgattaccattttcatgtaaggtgtgtgtgtattttgtttgcttgtttgtttttgagacagagacagctctgtcacccaggttggagggcagtggtacaaacacggctcactgcagcctccatctcctgggatctagcaattctcccacctctgcctccttgagtagctgggcccacaggcatgcaccagtatgcctgactaacttttttgattttttgtagacacagggtctcactttgttgccgaggctggtctcgaactcctgggctcaagtaaccctcctgcctcagcctcccatgcctgggattccaggcatgagccagtgcacccagctgaggtgtgtttcttattattgaactgtggtccatatttccccctgcccgccacatgcatacttcacaccatgaacttgctgtgtgaccctaggctagtcccatcgcctctctgagcacgatggtctctgaggcttcctgtgttcagcttgtcctgtgctgctgccctcccgggccccagtgcagcccccagggcgatgtagcatggccagcagccatggccaggtgccaggacactgaggctgaggtgggctttgccgttgcagacatcgacgagtgcgccctgcccaccgggggccacatctgctcctaccgctgcatcaacatccctggaagcttccagtgcagctgcccctcgtctggctacaggctggcccccaatggccgcaactgccaaggtgagcaggagggatgccctggggtccctcacgctctgcttggggccctgcaatgtcgtggggctgaggctgggctcgggggctgtgcttccccaacccaagggccacagcacagatggaatgcattcaggaaaaggaggcccaccccatccaaggggtgtcctggggtctgcagcaccctggtctcctacacccaggccccagcacacttgtcctctggattgtctgagcctgtggcggctgcatccggcaggaacacttcagccctcctcccctcccctcagcagccccgtaaaggctggaacagaggcctttaggaagatgcccgccagggaggaagcagtccaggccaggggatggcgtggcctggtgtgggatggcccagggatactcatggctatgggtcagctccagcatcggctaagtaatggtggccaatggcattggttctgcattcagcccccttttctacgaatgctctagggggcagtgtgtgtcccccagagccatctgataaccatccattcaatcactgacagcgggtgctgagtagatgtttgtgagcgcgtgatcctcagtgtacacactgcgcccagaagctgagtcatggaggtggggctgtccagccagttcctcgggagccccacacaggactgtggatcctggggctctggaagccccctgggtcccacagatgtagcttctggtcatgaggaaggtgactttgatgaaaggcaggcaggagctgcggtgtttcctgggaggccccctccgcttgccctgggctctggatggaaggctggttgtgtctgcatttctgacggagcaaatgacttttctcctggccaggctccctcaccacagcctggggtcccgcccagactcagcataaacacattcctgagccgggcctttgaggctggggagtgttgtttttgccaccgatgctcaggcatttggcacctcttaatggatgtctcccagggttggtgacagcccctgagccccactgtttggctgctccagagtctatgggagttgggctgctcccccatctccaggggcctctcagtgtggtgccccaggccccatcccaggagtcccagacctggtggttccagtccaccctgaacagccaccaaccccaacacacaggcaagacgtatgatccctcgaaggctgtttttctcattgttgtgtggagctagcagctcctgcccttttctcctaagaggttgagtcacacctagggtaagggtgctgagcctcgggagccacagagaggctctggttagttagtgtatggactctgatgccagcctgcccgggttcaaagctcagctctgacatttataaaatgtgtgacctcaggcaggtctcttaagctctgtgagctcctcataaaatgaggatcataacagtatctgcctcattgagttcttaggaggattcagtgacttatccttgcgaggtactcccaggacccatcatgtagtgtttacttttaccatcgtcacgctccctccagggattgcgaatgataagttaacactctataaatgtaaataccctataaatgtaagaactggcacaggacgctgctctgaagatcagccagtggagggcagggatggcctgatcgccacccctaaccctagttgatgggaggcctgggctcctccgtctccagatgggtatggctcctgcagcctctgccttcactgtgctgctgtggggtctcttgcagacattgatgagtgtgtgactggcatccacaactgctccatcaacgagacctgcttcaacatccagggcggcttccgctgcctggccttcgagtgccctgagaactaccgccgctccgcagccacgtaagtcccttggaccatgccatcgtcgtctgtctgtgttggccttcctggtgacccagttcccgggtgggtgggttatcaggctgtgacctcggtgtcctcccatgagggactcagggcactcaaagatcacctgatccctggccctcaagcccctaaatgctagtgacactggtctcggaaagtcaagggggtaactgcaaatgagtctggggtctatagtcatgttttcaggccaaggctgtgcacagaaccaggagaaaccacagccctcttttttcctagggtggaagccttgggcaagctctctgggcctcagtttcctcatctgtaacatgcagatgtcagaacgtgctctgactgagatgcataggtagcaatgtctccatgtcagcccaaagccagggagccgatgtgacctgttggacgttgttgttaggtgcccacctgaaagccagaattcgtccagcctggtgaccgtgtgggaacggcatcaaagattccagatcctaaacgtggggctgcgtgcccctatgtctttgtaagctcactcactcctaggccatcacggcgcccacttgagaccacggttcccacttcctatcccccttgcccctaattgtattcagaaagtctcatttagtgccacagtcagttgcttcaggaaaagctccatgctgggaccgatctcaggactgtggacttgtgacctctcccagcactctgagtgcacgatgcaggcagccagctgtttccgaggccttggccccttgaccttcagcctgccttgggctcttggccagctgcccccgcgacctgagggtcagtggtagtgtccacctcttgaccctaggggcagctgccctggcttgtggcatagcaaggcttctgggtacccgagcagccccgttgtccctggcagccctccatattcttcctggctttgcgattctcattggctggcccagccatttccctgtttcccagcacggatttctgtctgcttgaaaacccaacatcttgtttccttcctgagcttgggttaggaaaaagctgccccaaaactgggtttgcaagtctgtagcatcccgaagagctcatggttatgcaacagcctgccccaggcagtgacactgcttctctgagccattaagaaagttcgatggccttggctgcaggctgtgcagccgtctgtcattgtaagttcactctctccccagcctttgtcagcgcctgggcttgaggattccaggaggctggctgtggttgtgacctcgatttctaacttgcgcacagtcgtgaaaccacctttcgaagagggggaggctgccctgcacaggggccctggcgcctcctaagcctgagggtgggcgggttggccatgtgtgctgaggtcatggctgaaatcaggggaacccagctccacccctcatgttggctgtggaagcctctgccacccctcagtgctggagaaagtcgtttcttcctggacctactgcgtgcaggcacctgggtagacagcccacagagggctttgtccccgcacaggctccgccttcggcgtgtgtgctaggagggaggaggggaccccacctggctgggcgtgagggtgggcagggggctgtctggagtgggccatgcctgcatggaggtggaagggggagcgaattaggcagaagcggcgggagtatggacacatgtgcggtgaaatggggagttcagcctgaaacctgggccctgtgtgctgtgcagtaagggattgagctgctgggcgcctggcttgttccagcccttggactcccgggactgatagtgaggaggggccaccccctctcagcactgctaacccctcagactggagttttgtattttacagccccttttcctgctcatcaaaaatcgaagctgcttaacacgttttttcatctaagcttcagaaagcaatttttaaaatctaaaagagccatatttaggagggacccatggccggcgcttctgtggttaacaactcagcaagagcgcctccttcgggagccttgacagacaggactgcagagtccgctgctgtgcctttctctctctctccactcagacggcttccatctggggaacatcccggcggccgagggctggtaactggagcatgacccaggaagctgggccgcaaaccacagggctcggccttgtggacaggaccaggctgttacagtcctgcccacacaattcccttctgcccgcaggaggaagtgtgcaaagctgtcccacagccttcatggggccggacacatcctctttatcccctcagtggggccggcgcctgatgacctgtggtctagaaagctggagcaaagccgggtggccttggttgccgcttcccggggatgggacacgagtgaacagctgtgggcctgagggtgtaacacggtggacggtggcagagatagagccgtcgatggcccccctgccttggccagttcctggggcttgtctcccggacgacgagcgtgtgaaagtcaggaaaatgccggcagggatatccacaagcacctggggtggccagaactgccgtgcctcccaggagaaggagggggcctagagggccttttttctctggtgtgtggtggcttaggatcatttccatagagcttgaggtgttagggtcaaatgtgttgaactggcaagttggagcacattgtcctctaacgcatgacatggcccaggatgggtggcctgctgaggggacatgtctggaaaccagggcctgcgtggcagggggggacggggcgggctcgcctatgccctgctctgtaatacattcagtgatgacaacccgtccctgacctagacacactggctaaaagggatttttgggccgttcccagtctgacaggcagtttgccagacagttatgtttctggtgttttaaaaagtttgagtagagcgaagtacgatcattgaagccaggacttaccaggaaaatcaaggacatgtttatttttgtgcattagtcatttgcaaagcacatagcgggtgccccaggccctgctctttgtccagaaggagccagcccagaaactcctagtgtagagaaggttttggggtgctctgaggaatgactgtgtggggtcggagggggagcctccaggggaggagtgaccagtcgctgtgtgtgatgacggcgggagctgcaccagaacaccacgcacacctcccattgctttcctccgcttccctctggcaaaacaaattccatccctggttagtacccgccatgctgagagaagcgggaagccgaaatcccaccagggcgactctagcgccacctgctgaccagccccatccaggctggtcctgaagttgctggtgtgtgtgcgtgtgcgcgtgcttgtgtgtgtgcatacattgtgtgtgtaaaagctttgaagtaagacaggccgactttgaaagccaagcttgccccttacgacacaccacggagctatcagcaagttctgcatcctcaatgggcgtctgtcttccagccagtagagcgggaggacgatgggagacagtggagggagcgagtggaaggaaagtctgctgcttgcagcctgctccctgcacccggaagcgcagttcacctgcacccggaagcacagctcatgggtcccatgctcctcccccagttcacggacgctttggtcatagctcctcagaggcccccctgggggagagctctcagatcgcctggagcactcccgtttggcctggacctgggcatctctggggcaggccaccgccagcagcacccgtgcccaccttctttcctgcctctgttttgggcccctcccaggcaggactcccccgttcagtgcccctgactcccaggccagtcctttctaagagcttggaatgatcactagccaagtaaatgcaaggcctcctgtcagtcctgacaaacctggaaagaggaggtaaaaggagaccccagtctcgataaatgcctcaagcaagtccaagtaacccagcacgagacatggaaacttaaaaagccaaaagggagatgtgatagaaggccaggacgagaggatgctcctgacctcagaatccagacacagcccagatggcagggcttcctggagcacctgggccaggtcctctggggctccgcacctgggccctgcttcctcaggcagccaccttcagagtatgatgggccaggagttcagtacacaggagacgacccctgtcccatcttgtgacaagaaattagaacttgttactatcctgtagcggaagataataccgatctccatcctgtcacaggaggttagaatctgtaacaggaagttggaatctgtgctcatcctatacaggaagttaggacccgtccccgtctccaccacaggaagttaggacccgtccccgtctccaccgcaggaggttaggacccgtccccgtctccaccgcaggaggttaggacccgtccccgtctccaccgcaggaggttgggacccgtccccgtctccaccccaggaggttgggacccgtccgtgtctccaccgcaggaggttgggacccgtctctgtctccaccacaagaagtttggacctgtattagggttctctagagggacagaactaatggaatatacatatatatatatatataaaatggaatatatatatatatatataaaatggaatatatatatggaatatatatataaagtggagtttattaaggattaactcacatgatcacaaggccccacaataggccatctccaggctgaggaacaaggagagcagtctgagtcccaaaaatgaagaaaaaatgagtccaatgtttgagggcaggaagcatccagcacgggagaaagatgtaggctgggaggctaggccagtctctcttttcacgtttttctgcctgcttatgctgtagccgtgctggcagctgattagttggtgcccacccagattaaggatggatctgcctttcccagcccactgactcaaatgtgaatcttttttggcaacaccctcacagacacacccaggatcaatactttgtatccttcaatccaatcaagttgacactcagtattaaccatcacaagtccaccccttgtcaacttgaacccatgcacatctcctgagatcatacataatcttcaaataaagacaataataagatcataattacacctaacataactatacttcatacgaccagaaactcaccaatccccaacccaaatactattatataaagttaacgatacttaaatgctgatgtgaattcaataaatcttatgtcacttgataaaagagaaaggaaataaaatgaagtcatttttgttagtacaagtgtatacatgcacaaacatttttgattgttttttgtttgtgtgttttttaagacagagtctccctctgttgccgaggctgaagtgtggtggtgtgattttgtctcaccgcaacctccacgtcccgagttcaagtgattatcctgcctcagcctcctgagtagctgagattacaggtgtgcaccaccatacccagctaatttttctattttaagtagagatggggtttcaccatgtgggtcaggctggtcttgagctcctgacctcaagtgatcctcccgcctcggcctcccaaaatgctgggattacagtcgtgagccacagcacctggccatgtttttaaaagaaggaggaaatactcacgacaattacagtcctcgtttctgcaactggtcacatggctcgtagctggtattgatgactgccttcttctactacccattctgtattccctttgccttcagcaagcaccttggcagatcttgttttttttttttcctggtggagtgacccaaaccttcattcctgaagggtctgggtcatttgtagtcctgcctggattgggctgttgtagtttcccattgaccttaatcacagggcatggtaatactgagagatgccctaatggatctcctgtattccatgcatactctaacttatcttcattttggagtagtagactgatttcatcttgatagtctgggtcagccaccccagccaacactgtaactcccttcttagcctgttgacttaaaggtaggaggagcttcaagtgtccaggtggcaatcttaatttccagtttaatggaatccttgttctgtctcctggtggcggcgttcctccctctggaactaagacctctaggccagcagaacgtaatgttgcaggaacaggaagcaaaaattttgctagtggatcactaggggtgatggtgagtggtgccacttccatttccacccttggatgcctggacccgtgaatcctggctatgggagaaacagtgccataatattggaccctgattcagagcatacatggccttctgtagaactttgtcccagccctgcaaagtactgtcacctagttggcattgtaattgtgacttcaaaaggccattccactatcctatcaatctacctgcttcacgacgatggggaacatggtaaaaccagtgaattccatgagcatgagcccactgccacacctctttagcagtaaagtgagtgctttggtcagaggcaatgctgtgtggaataccatgagggtggataaggcattctgtgaacccacggatggtagtcttggcagaagcatcgtgtgcaggataggcaaacccatatccagagtaagtgtctattccggtgaggacaaacctctgccatttccatgatggaagaggtccagtataatcaacctgccaccaggtagctggctgatcaccccgaggcatggtgccacatcgagggctcagtgttggtctctgctactggcgaattgggtactcagcagtggccatatccaggtcagccttggtgagtggaagtccatgttgctgagcccatgtgtaacctccatccctgccaccatggccactttgttcatgggtccattgggcaatgacaggggtggctggggaaagaggccgagtggtgtccacagaatgaatcatcctatccacttgattattaaaatcctcctctgctgagctcttttatgtgatatggtgagcactctcatgtgatacaaatatcttcacagtttttgaccactcagagaggtctatccacatacctcttccccaaatttcattgtcatcaattttccaatcatgcttcttccaagtccctgaccatccagccaaaccattggccacagcccatgaatcagtatgtaatcgcacatctggtcatttctccttccatgcaaagtgcacaaccaggtgcattgcttgaagttctgcccactgggaagatttccctttgccactgtccttcagggatgtcctagaaaggggcagtagtgctgcagctgtccactttcgggtggtgcctgcatatcgtgcagaatgatctgtgaaccaggccctagtcttctcttcctctgtcagatgatcgtagggaactctgcatgaggccatcggtgcaggctggagaagagaaggcaagttggcaggagtggagaccacgggcatttgagccacttcctcatgtaacttaacttgtgccttcaggacctgctcaagcccgatcacgtatataccacttccatttgatgatggaatgctgctgttcatgaccaactttatggctagatgggtcagaaagcacccagttcatgataggcagttcaggtcatatggtgacttgatgacccagagtcaaacattcagtttccaccaaagcccagtaacaggccaagagctgtctctcaaaaggagagtagttatctgcagaagatggcagggccttgctccgaaagcctagagaccgccactgtgattcacctatgggggcctgccaaaggctgcagccagcatccttatctgccactgacacctcaagcaacattggatctgctgggtcatatggcccaagtggcagagcaacttgcacaacagcctggacctgtcatagagctttctcctgttctggaccccactcaaaactggcagcctttcaggtcactcgataaatgtgctggagtaacactcaaacgaggaatgtgttgcctccaaaatccaataggcccactaggcgttgtgtctctttcttggttgtaggtggggccaaatgcaggcaacttatccttcaccttggaatatctcgacaggccccaaaccactggacccctagaaattttactgaggtagaaggtccctgaattttattatcagatttattttccatcctctggcatgcaaatgtctcactaataagtccagtgtgtttgctacttctcacttactggatccaatcagcataatgtcaccaatttaatggaccagcgtgatatcttgcagaagcgaaatgcgatcaaggtctctccgaataagattatgacatgaataagattatgacacaaagccggagagttgatacacccctgaggtatgacagtgaaggtatattgctggccttgccagctgaagacaaattgcttctggtgggccttggaacaggaatggagaaaaaggcatttgtcaagtcagtggctacataccaggtaccaagagatatggtaatttgctcaagcaatgaaaccacatctggtacagcagctgcaaattggagtcaccacttggttaaacttacgataatccgctgccgttcaccaagatccatctgtcttctgcacaggccaaatgggagagttgaaccgggatgtggtgggaatcaccaccccgcgtctcaagtttttgatggtgacactaatctctgcaatccctccgggaatacgatattgtttttgatttactgtttttctaggtagaggcagctctcatggcttccatttggcctttccaaccataaaagccctcaccctaccagtcagggagccagtgtgggggttctgccagctgctaagtatgtctctgccaattctgcattctggcactgggaaaatgaccacaggatgagtccggggacccactggacccactgtaagtcagacctgagctaaaactccattaattacctgacctccttaagcccctatttaactggagggccacaatgacgttttgggtcccctggaatcaacctcagctcagaatcagtgtccaatagtccccaaaatgtctgatcatttccctttccccaatgcagttactctggtaaaaggccagaggtctctttggggaaggatgggagaaagattcactgcataaattgtcagtaatgtagtggggtccttcctcaagaggacccgcctccccttcattcaaggggttctgggtctgtaaactggttcaagtctggaaattgattgaggggccgtgattctctttttttgtaattcaaattagtcttttgtccacttgatctagaagttttcggcttatacaaatcaagtaggaatgcagtaggcttcctatcaatttcacttctaggaacactgtgattaattagccaatgccagagctctacacgagacagactattctgattgctgctttgcctctgctgtccattacagaagctacacccaccttgcctttgatggttgagtgctgtcacttggccactgccacctcaggatccaattatttccattgtatttaaattttgtagttgagtgactgtggttcccactgttagatctgacataccaagacgagcaattacagggctcttcaaagatgcaggtgctgccctcacaaatctgtttcgaaagacattggtcaagggtatatcttctgaatcctcccaacttggttgagtaggtctaaagtgactaatccactccaccatcccaatctccctaagtctttggattccttcctctacattaaaccaaggaagaccaagcatttccagcttgctcacagtgggccatctcttcatccgtatttcagctaaaccagcaaataaactattagaaccttttttaactccccgagttgcaacattaaatgcagagtccctgcttagtgggcctaaatctgtaaattcagcctaatccaacgctatgttccttccaccattctccgacacccttaatatccattctcatgcccgttctccagattagtttctataaattagaaaactcaagcagttcttttcgagtgtagctcacttcctcatgggtcacactctcaacctcatctctaggggcccgccaggactttagtctagttataggtctagaggcaaacaggggtgttaggggtggctcctgaggagaatcaacattatcttgcctggcaactgcctcacaggaggccatcactgttgcctcaggcagcgtggggtttatctccttagacaaaggtggaaaggctgatgggtcggggcggggatgttgccactactggggatggggaagctgttaagctgtttcttctggcaaaaaagattcatcagagtttataaactcagtgtccccagcttcatcaggctcctcccacatgtccccattccaagttgcagggtcccattctttttcaatcaatgccctcactttaacagcagacacctggcgaggctgtgcatgcatctttcattgcaggtcagccactcgcatgataagagcttgtgtctgtttttccacaatttcagctcttcctctacaggagataagactctcactcagggcaatcttagcagatttgaggctcagtatctgcttctgaagctgggagatggaatccctgagttcataattttctttcatcactttgtccactaaacttaggagcaaccaaccagcttcattatgttccttggttctccacatatgatcaaagatattatgtatagagtcactaaacttgcctcatgagcgatgaatcaggagtttcaaatgcgtttatttttcataactctctaaacagttcatgccaaggactatcagtgttctccatactattagaagtggagtccttagcatttttggatctaatcgttaaccagccaaccccagaaaccccaaaaccaatgaaagaactccatctttaatattctcttcctctagaaccactcctggtaccaaaatctgtagtagttagggttctctagagggacagaactaacggaatacatatgtataatggagagtttattaagcattaactcacacgatcacaaggtcccacaataggccatctgaaggctgaggagcaaggagagccagtccgagtcccaaaactgaagaacttggagtccgatgttcaagggcaggaagcatccagcacaggagaaagatgtaggctgggaggctaggccagtctctcctatcacatttttctgcctgcttatagtctagccgtgctggcagctgattagattgtgcccacccagattaagggtgggtctgcctttcccagcccactgactcaaatgtgactctcttttggcaacaccctcacagacacacccaggatcaatactttgtatccttcaatccaatcaagttgacactattaaccatcacaggacctgtccccgtctccactgcaggaagttaggacccatccctgtctccacccaggaagttaggacctgtctctgtttctatcacaggaagttgggatctggccctgtggacccagatgggttactgagcttggaacacgagggcttagtgacaaggaactgggaactgacctcaatggctgagtagcgatatggctccctcactcactctgtgaccttgggaagtgggaaggccacattctctctgagcctcagtgtcctcatgtgaaaaatatcaccgaagccactgtcatggggtggtggcagtgatcacactagagagtgcatggtgaggaagagctgagcacttggtaaacggcagcagctctgattgctagtggcagagatagtcatttcatgggtcacctccgagacacaaccaagagccctgcgtagccctggccactgtctgggcaagggcctgggaagggcagggtgtgcctggggagtgcccctggggtggggctctgccagtgagcaggggacgcacctcactccgggcacagcctttggcccccggccacccagcgcccgagatggtgttggaagaggctagtgcctgaatcagcagcctggaggtccacggcgcctcccgcaggtgagtgaggtgtgcccttcgtgttggctgaatcggccagaggggcggcgggaggccccgcctgccagccccgcatccccgcgctctgccgtttctccgcttgctggaccggccctaaccctcttcttgtctctctgcccacttttcttgcagccgctgtgagcgcttgccttgccatgagaatcgggagtgctccaagctgcctctgagaataacctactaccacctctctttccccaccaacatccaagcgcccgcggtggttttccgcatgggcccctccagtgctgtccccggggacagcatgcagctggccatcaccggcggcaatgaggagggctttttcaccacccggaaggtgagcccccacagtggggtggtggccctcaccaagcctgtccccgagcccagggacttgctcctgaccgtcaagatggatctctctcgccacggcaccgtcagctcctttgtggccaagcttttcatctttgtgtctgcagagctctgagcactcgcttcgcgtcgcggggtctccctcctgttgctttcctaaccctgccctccggggcgttaataaagtcttagcaagcgtcccacacagtgagcctcgcgtgccttggttttatttggcatggttgggagtctgtgccgcttgttacccgggggtgagctgggcactggccaccgcctggtacccccgagggctgactgaggagcgctccccactagagggtgtgtgctcgggggtccctgttcacagagcccactgtctgtgccgacagggaggccaggccgggtacatcatttcacatgtgttaacttgtcttcatttgtgttgaacccaaagaataaaggtggtggtggagaagggccctcagattgctgagcacagtcccctctcgttttacagatgtggaaactgaggcccagagagaaggggaagggttggccagggtcgtctggcctgctgtggccatgccaggtcaaggaagcgggtctgctggcccctgcctggttctttgctgtatccccggaggtgagcatttcactgagacaagaaagctctctcctgagattcaagcctcctcttctgtttgtcttgatcagaagcccaaatctgtggtgcagaaacacgggatgcggttgcggctcctaggatgcagctcttgcctcagtgaagtcgttttgcccccactgaggatcctggccctgtgccggggggaggcaaaggaccacacaatacatgtgatactcacgggatccttcataggccttacaccagtcctgccaggcaggtggtcatcctcatgaagactcagagagggcaagtgatttgcccaagatcacacagctggtatccgagccctggtttactgactccacagatctggctgttgcgttctgccagaatacctccactgagggccttaaccccctgcctccctccatctcctccaccatggtccagccaagccagtcatctgtccccctctgctgctcccagcgtccattcacctcccctacagctcattctttgcttagcagctggagtgatcttttagcctctgcctaaaaccgttcctggcttccttaccatttgggttaaggcctccagatcctcaagatgtctgaaggccgtgcctaatttagtccttgcatgcaatttccagcctggcctcaacttgttctatccttgcccacttcccttgagccacgctgcaagctctgctgcctccggcccttggtacgtgctttgcacccttggcctgaatgttgcttaaactccagctcatgtgcctgcctcagagaggccttccctgccacccctggcttctgttttctctgtccgtccttctcatgacccctttccttcatggtgcttgtaacaggctgcggttcctgttgactcgcgtttcacatttgtcttccgcaccttccagaaggctctgtgaaggcagggaccaggtctatctcattcagtgcggtgttcccagctccttgcaagacatctcgcgtgcagaaggtgctctgtcaatgtctgttcagggaacagatgactctgccagccctggcttatgtcactagcatttctgtggctgtgacactgtgctgacactgtttccaggcagaaatccaagaagggaaggcagaacaccccagcgggatcaagtaaagaggactgcagggttcttccatggaagcaggggttggaggatacccaccttgatgcctagtgaggaagatggacctggacagacagtcagctccacaccttgcgctgagcagctgtgattgtgccacgggagcatgagcccttttccccacggcccttgccactgtctcctggccctctctctgatcatgccaggtttgcaccagcctcgagtctcccatgttgtagtacattctccaagatgcagcccaggagcctctctgaaggaccagtctggttacgatggtctgagcttccttagaaccttccatggttgtcttttcccagcagatgaagcatagcctccttggaatggcatgggaggcctggcctgatctggcctctgcccaccctttgagctgcacctgccccaccccagctcatccatgtgcttgtaccctggccccacggggaggcttgcccttccctgaatctgccttcttgtggctttagcatgtgccatgctgtccccctgcagactgccattctccttgcagacttggctcagaagtcacctcctcagtgcagttagcctgagctcccctggccccaggtgcctccatcagagcatttaccccattgtgttgtggctgttccttaacgtccccactagccaggctctttgagggcagggattgtgtctggttaatttctgtattctctgcaactttgcaatgtttggcttgaagaaggagctcagtaaacatctgaataaacatgcaggttgatggatggatggacagaccaatggatggatggatggatggatggatagcatttttaaggcttagttcaaatatcgtctcctcagccaggtgtggtggctcacgcctgtaatcccagcactttgggaggccgaagcaggcagatcagctgaggtcgggagtttgagaccagcctggccaacatggagaaaccccgtctctaccaaaaatacaaaaattagctgggtatggtggcaggcacctgtaatcccagctactcaggaggctgaggcaggagagtcgcttgagcccaggaggcagagattgcagtgagctgagatcggagtatggcacaccagcctgggcaagaagagtgagactctgtctcaaaaaaataagtaaaaattgtctcctctgtttagccagcaagccacagcaggggttcttgtcctattcaggcatccatttgtcaggggcgggattactcaggctggaaggaacacctgtgccttcatgtgcatagcaatgtgaagaggtgggggaaacctctcaggggctttggaggctacccagtgaccttccacagcttgccagaagctcctctgcaacattcccaccaagggactcttctttgcttgtggaactccctgcctcctgaggggtcccgttgcattttgggatcccatcgacgtttgcgtgtgtgcctgagtgcactgtgggagtgacagctgagtgacctgagtgctcacccctgtcccgcagctccttggggctccttagccatgttctcggctcatgctgctgacagaggacaccatgcaggaaaagcaaaataagagcaggaggttgaatttccttcttgccatttactagttctgtgaccctggatacatcgtcagcctttcagagcctcaaggcccaccttatggttgattttgaagatggcctgaaatagtccagcaggcagcgcctgatacagagtaaacactccataggtgtgagtgtgggtttcttcattcattggaaggtaactgggtgttcgtgtggcttttcattgaaatggggatgaagattcagagagtttggagggatccaaggtcatatgtggagctgacatcacttttgattcagaacctgtgctttcctggttgtgtcactagtaaatcaagctcccaaggagaaaagacagcaataagggtgatttttattgtaatgataataataacaactccaacagctaacacatagagtgctgaccatgagacaggcgctgttccaagcatgtaattcgtttactcttcacagcagcctagggaagcaagcagtgctaatatccccattccacagtgaggacagggaggcacagaaaggtgaaggaacttgcccaaagttccacagctggtttccagtggcactgggattcagacgcaggcagcctgggctgggatctgtgctctgatcccctgtcctccactgcagcaaatacgggggagaggcagcatccctgggatgaatgagactgttgctccagccccatctcacagagcccgctctgccattcccaaactcaaaacaggatatcttattagctaaaggaggaggcagtgtggtaaggaggaaagggctatgaggctggaatgaaataagatatgcaaaatgggccaggtgcggtggctcatgcctgtaatcccagcactttgggaggccaaggcaggcagaccactgaaggtcgggagttcaagaccagcctggccaacatgatgaaaccccgtctttaccaaaaatacaacaattagctggtcgtggtggtacacacctgtaatctcagctgctcaggaggctgaggcaggagaactgcttgaacctggaatacagagattccagtgagccaagattgtgccaccacactccagcctgggcgatagagtgagactttgtctcagaaaaaagatatgcaaaacgtgtagcgtagagactggaaaggcagatgcattatttctgaagctctctagatcccaaccaaaaaacacccagacaactagataggaaaaaaaatgtttccatggaaaacatttacaaacgaaacaaggtatggttgtctgcagttcaggcccacctgcatgactttggcatctgtgcaggaaaaaacagtggcagaaccccaaaataatcaacaggtatccccagaaagtgtactaggtgctttgggggaacagcagctgaaactgggaggcgttttcctcactccaggggccagagtgtgcacagagccagtgggagggaggaaggggctggcgcaggcttgctcttgggagcttttgaaacttagccaccacagctctccctaaggtcagagtctcacacgagggagagactgctggaaatggaacagaaattgtgtagaaaagagaccatagagactgtgggaagagaaggtccgggtaaatgtggaagaatgtcaggaggtgagctctgcaaagtcaggaagataactgtgaatgatactctttctcaaattccaggaaaactagtttcctttaaggatgatcaacccaaaagcatcaaggtcaaattccatggatgagtttctataacaaagtaccatagactgggtggcttaaaataatagaaatgtattacttcatggttctggaggccagaagtccaaaatcaaggtgtcagcagggctgcacttcctctgaaacctctaggggaatgcctcttctgtaggggagtgctctttctgtaggggagtgctccttctgtaggggagtgctccttctgtaggggagtgctccttctgtaggggaatgcctcttctgtaggggagtgctccttctgtaggggaatgcctcttctgtaggggaatgctccttctgtagggcatgctccttctgtaggagaatgctcctgtaggggaatgctccttctgtaagggaatgctcctcctgtaagggaatgcctcttctgtgggagaatgctccttctgtaggggaatgcctcttctgtaggggaatgctccttctgtaggggagtgctccttctgtaggagaatgctcctgtaggggacttctgtaggggagtgctccttctgtaagggaatgctcctcctgtaagggaatgcctcttctgtaggggaatgctcctcctgtaagggaatgcctcttctgtgggagaatgctccttctgtaggagcatgacttgtctcagcccctggtggtttgttggtgatcattggtgttccttggctcgcagctacatcgctgcaatctctgcctttgtcatcacatgatcttgtgtgtctttgtcgtcacatagccctcttcttataaggataacggtcatcttggatcagggcccaccctactccagtgtgacctcatcttaactgattacatctgcaatgaccgtagtttccagtgacgtcacattctgaggtactggggatggaactttgacatctttcttggaaggatgtaatgcaaaccatgacacccatagaaagtgttaggggctgaattgtgtccccccccaaattcatatgttgaattcctaatccctaatacctctaaagtccctatctccaaatgcagtcacattcaacgaggtaattaaggtaaaagtgagatcatatgaatgggccctaatccaatacagcaggagttcttataagaagggattagggaccaggtgtggtggctcacgcctgtaatcccagcactttgggaggccaaggtgggcagatcacaaggtcaagagttcgagaccagcctggtccacatggtgaaaccacacctctactaagaatacaaaaattagccgggtgtggtggcatgtgcctgtaatctcagcgacttgggaggctgaggcaggagaatcgcttgaacccaggaggcggaggttgcagtgagccgagatcatgccactgtactccagcctgggtgacagggcaagactctgtctcaaaaaagaagaagaagaagaagaagaagaagaagaagaagaagagattaggaaacagacatgcacagagggaagaccatgtgaggaggacacagggagaagtcagacttctacaagccaaagagagaggcctcagaaagaaccaaacctgccaacaccttgatcttggactttcagccttcagaaccatgagacaatccatttctcttggttaggccacccagtctgttgtatagcaaacaaatgcacagctattataagcaaaaaagagaataagagacagaatgatatccctctgggtaatgaaagcacaccagaaagacgtgcccagactaaatgaaaattctaatattctatcttgaaagaaaccaaaagtgttaagaaaataaacaaaacatagaagaaaaatggggccgggtgccctgtaatcccagcattttgggaggctgaggcaggtggatcacctgaggtcaggagttcgagaccaccctggccaacatggtgaaaccccatctctactaaaaatacaaaaattagccaggcatggtggcaggtgcctgtaatcccagctactcaggaggctgaggcaggagaatcacttgaaccagggaggcagaggttgcagtgagccaagattgtgccattgccctctggcctgggtgacagagcgagactctgtctcaaaaaaaaaaaaaaaaaaaagaaaagaaaagaaaagaaaaaaaaaagaaaaagaaaaaaagaaagaaagaaaggaaaatagaaaaatcgagtcagaattagaagaaaactgagaaatgaagtaatagaccaaagaaacaaaaagttaaaaatttcagatgtaaatactaaactagatggaacacaaaagtgaataaacagataaatagaagttgaaaagaacaacaagttttaaaaatcaagaaagaaataacaagagatgaaaggcttgaagaaaaagtgacaaatattcaaaatctgtaagaagatctgacatttagataataggactccctgcagaagaagccgaatacatgggggaaagtactatacatgatctcaagaaaactttccataaattaaaaaagagatttgaaattccacattgaaataacacatagcgtacctgagaatatcaacaagaacaaccaacaccaagacacataacacattcttgtgaaattattgtactttaaagaaaaggaggaaggccgggtgtggtggctcatacctgtaatcacagcactttaggggccaaggtggcagatcacaaggtcaggatttcaagaccagcttgaccaacatggtgaaaccccgtatctactaaaaatataaaaaattagcatggtggtgcacgtctgtaatctcagctgctcaggaggctgaggcaggagaatcgcttaaacttgggaggcggaggttgcagggagccgagatcatgccactgcattccagcctgggaaacaagagtctcaaaaaaaaaaaaaaaaaaaaaaaaagaaagaaagaaaaggagggaaaaacaaactatgaacatttaaacaaaaacagtaagtgatttataaaggaaaaaaaatgttctcatcagactctttgacagcaacactttatgctaaaagaaaataaataacatattaaggactctcaagaaaagttaagcccagaattttatacctagcaaaactgactttcatgtgcaaaaagcataaactattatgaccatgcaagcattaaacattcagttacttctaaaactacaactaaatgagtgttataaggaaaagagtatagtatgaattactggataggtcagacaatgtagacatagcacatttatttttaaactctgagccgaatagggagagcatatcaaaaattattttcaataattatgttagtcatggtaactttagaattgttatcctgaggctactgtgtaggtaatgtgggataatgatgggatactgcatgtccttgaggaccaggattctgatgtggaagaaagaatgtgcctttgtaatacagaagagattaattaaaaaaccatatggtccttcttttgaattggatatcagtatgaactcttggtgtatattagtttttaaatgttcactgaagaggcctagaaacaatgaccaaccccctagcactgagcctccctagtatccagactggtcttgataagccatttctcactaaaaaacaaaaacaggccaggcgcggtggctcacacctataatcccagcactatgggaggccaaggcaggcagatcacaatgtcaggagttcgagactagcctgaccaacatgatgaaaccccatctctactaaaaatacaaaaattagctggtcgtggtggtgcccgcctgtaatcccagctactcaggaggctgaggcaggagaatcacttgaacccgggaggtggaggttgcagtgagccgatatcgcaccacagcactccagcctgggtgacagagcgagactcatctcaaaaaatatataaaaataaaaataaatgaaaaacaaaaacagaaatacaaatccaagacttcttggagaaatggttgattccaggtcttgggcagtaaaagtgtaaaatgaggctggatcatctcgtcacatcagatagcaagaaagctgtgaaagacgacaagggctgggccaaaaggacccaggagccaacttcattttccctctggcaagagatgggaaaatttgagtttcaacaaaggataaaaattgcagaggatcaaacctcatcggagtggcttccatcatgggttcatactgatttttttttccccaaaaatcctttggagaatgatagcacactagttagcttattatcctgaaaattagaaaattcaaggaaacaaccaagtattgatctgctatttcctggtaattaaatcacaagagcacatgaagggaagcatctgtttacaggagtagtccagctaataaatggaagtgaagtggtagaaccagactatcggcattttgcaatccttgatgaatcagtgggcgtaggccttgagcatcagtagatgctgtcctcacagagacagccagtcactgtgtggctctcactgaagacacactaccacctaccatcttgccaaagggaccgggcctgcatgggatcaggcctctggatctggctgccaatgtccaagaaatccagtggacagaggaccatgctgaactgcaccgtgaggatgcaatcagcaaagtccagcctgtaggaaacacaacagctcaaattcttcaggttctttaatagataagttgtatggaaaataaaggaggccgggcacgttggctcacgcctgtaatcccaacactttgggaggccaaggtgggtgggtcacctgaggtcaggagttcaagaccagcccgaccaacatggtgaagccccatctctactaaatacaaaaaattagccaggcatgatggtgcatgcctgtaatcccagctacttgggaggctgaggcaggagaattgcttgaacccaggaggcggaggttgcagtgagctgagattgcgccattgtactccagcctgggtgacgagcaaaactccgtctcaaataaataaataaataaataaatagaaaagaaaataaaggaacagagaagaaacctgtagcttaaaatggacttaaaaggcagagcaaaaacttgttgatggacaagtctgaatgattgtgtctagagacgcacactgatgtgagaaaactatgaagaaacccaagtaggccgggctcggtggctcaggcctgtaatcccagcactttgggaggctgaggtgggcggatcacaaggtcagaagttcaagaccagcctgaccaacatggtaaaaccctgtctctactaaaaaaaaatacaaaaaaaattagccgggcatggtggcatgcgcctgtaatcccagctactcaggaggctgaggcaggagaatcgcttgaacctgggaggcggaggttgcagtgagctgagactgtgccactgtactccagtctgggtgacagagcgagactctgtctcaaaaaaaaaaaaaaaaaaaaacccaagtagagcactgccgtgggactcaggctaggggtcactgttgggttgcaggaggggttgagttctgtctggcagttgcggggcgtttggtggctggccaagttctctttcttgacctgggtggtgattataaaggcgtttgccttgtaataactcgttaaactatactttcattttgtgtaattttgtatccgtgttttattttatgatcaagaggttgtaaaaatctgtctagcacagtacctggaacccagacctctgagagactgtagcctcttctgcctccccgtcacctggtgatgtggaattgactgccctgtgctgggcaccgagcttggcgctttctatctgctccttcgtttattaccctgctgcccagcctcactgtgggctctgagaaggcgggaccatgtgtcccttgttcactttgctgtccctagcagccggcgcctggcactcaaaacatatttgttgggcaagtgaacctgtgactctattttgccattgtagctattgatgctcaattcgtgcagttgacaaatgtccaagctgtgcttatccgccagggcacatggaagctggagggtgttgctggcatttaggtcccggtccagtttgcaggaagggccatgaagcctccccacagagcagccaggctgcagagaccactgtcgttctctgatggagctgtctctgggacagatgcccctgccctggccacctgctcctcctccctagacctcggcccctgtgggagctgctgtcccagcttccccgtcagcctcgtgtgctgtggttcccctcaggctccagcaggagaagacagacacggtccgctgcatcaagtcctgccgccccaacgatgtcacatgcgtgttcgaccccgtgcacaccatctcccacaccgtcatctcgctgcctaccttccgcgagttcacccgccctgaaggtgagtgggatgggtgtgggggtcccagggccccctagggcctccctcggcttcagctgagggcttggcctacaggagttgttccttgtaagatgtggcccaggctttgaaatgcagaactttcttttttttttttttttttttttgagacggagtctcgctctgtcgcccgggctggagtgcagtggtgccatctcggctcactgcaagctccacctcccgggttcacgccattctcctgcctcagccttccgagtagctgggactacaggcgcccgccaccacgcctggctaatctttttgtatttttagtaaagacggggtttcaccgtgttcgccaggatggtctcaatctcctgacctcatgatccacccgcctcagcctcccaaagtgctgggattacaggcgtgagccaccgcgcctggcaacttgacatgcagaactttctttgtgtctgtgtcccccccacacccacctggcacagcagcatttggcccattctcagctttccgttcaggtggtcttttcttatgggtaacggttgttctgcagagagccattaagcgctgattctgtgaccagcactggagaatcagggagggcctccgggaggaagtgatggctaggctgggtcctgagtggtgaggtatttgagtgaaagggggagaaggggaggagggtgcccagtggagcaggacatggccagaagggtctggaggtatgggggggcggtgtgggcgtttgagaaactgagccaaggttttctgctggagcgctagaggcttggcaagaggtgggctggaaggataaacaggaggctaaaactggagttgggccttcaacccccaggctttgggggaaccatcggaaggttgcagtggaggaggtttgcatatagaaacatcatcctgttgatccagggccaggtgaactggaggggccagacggggagcaggaagctcaggtgtaacccagtcagtgctcccacaccccagcctggctctctaggaagctcctggcatgcagtgtagtcatgttgtgtaacctgccatcactgcaccgtttctctggagcagggcctgggctgcgtgctcccaagcctggcagagggctatggatggagcattgtcctgttcacctcgcttcctggctgtgctgcccgtgtgcccggtccccaaccacccccgccctctagggagtccctatccctggcctgcggagaagcatgccatgatgagttcattcagcagccgtggacggagcccctctgtgtcaggctctagggacatggtgataagaaggggtcctcccaccctctcaggggaggcatgcaacggagccagccgcgaggacaccagtgtttacaccatgacacaaccatgcgggggggtggggggaggagaggctccctcagcacgtggttgcccaaggagccgtccccagtcccagtccccctaggtttgctcctcccgaaaaggaataacgctgaatcgtcacagggtggcacagacttgggtcagagaaaataactaactggtatttgccttttgcaaaatgatggggtttcaccaaaccacatacaaatccttcccaaatccccagtggctggttttgtggcctctccggccagccccgatctgagtgttggttatcgcagggagccgagtgccgttgggacacctgttagcatcttgggcccaggaaatccacaccctgaccttaagtgctgaaaggacctttagtgggtctccgccggcttccttcctcaccttacaggtgaggaaactgaggcccacagagaggactcccccaagacagcccagagctggggctgccctgcttcactgtctgatctgggagatggacacacaccccccagagaacccaggccaccgctcagggtggcccccctgacctgtggcactatagatgggagaggagcccacccctctggcctttctgctgtctccctctgtcccctcactcgctttcctcctctggtccccaccttcatgaatatgcacagtgactgatgacttctcaccagcccttcctctgattagctctgtgtccccgaggaagatccaaaatctctcctgacttcagtttcccctgctataaaacagggatgggctatgatataggaaggtccagacccctccaccctccccacacaggggatctctggcttcattgatgttgtctcatgaaagggccctgggttaggtcttcattccccaagggtgagttcctggggacgaggctgggactggggctggggccaggctgtgctgagcccttctccattctgtgcctctgcagagatcatcttcctccgggccatcacgccaccgcatcctgccagccaggctaacatcatcttcgacatcacggaagggaacctgcgggactcttttgacatcatcaagcgttacatggacggcatgaccgtgggtgagtggctgggaatatcagctctatccaggcacccctccccctccaccccgaaaccctctctggcccagcccaactcccatctgagtcccctccccaaattcaagcccacccaaccttcagggcccagcgccgaggccaccacagctcccaatcggtctcggccggaggaacagccagagtgggggatcctgcctgggatctgaccctagctgtgccacccactctctgggtgacccctctgggtctcggtctccctgcctataacatgggtgggttccagagagcgctgcgcctcacaaccatgaatttcaaatgataccacccaagtaaagtgcttgtcctgagggctggcacagtcccgcggtcggtgggagctaaggggattgttattcttggggtgcaatgggagggatagcaaagtaggaatcagagggcctgagctctggtctctcagccttggaactagctggattcgccatgtggccttgagcagtagtcgtcccctccctacgcatcagttggtaagaggaccaaggccactctgtgtgcacagcccatctgaatggggagctcactgctctttctccctggagatccggtgtttggggagcgtgaagggaggctggggcatgaggggactgtggaagtcctgttggtgggtgcaggctggggaagatgtttacaggcgggggcagggccctccctggctaggaacgggctttaatgacaacctactcgtgtgaaaaaatatccaggcccactccattccgcacgcttgtttctgtcattcacagcccctctcctgaactgtcacattttaaaagatttacagtcatgggaaatgaaaacggtggcatctgccattttggactcggatttatactctgaacactttcaaagcagctgagcaacggacggacagtccctgacctcccctgggcctcagtttccccattgtgaactgggaggagtgggcttcctagtcccttaggcgctggagtccgggaggtcctaaccagaacccacgagcgtgcagtgcgcacagagcagagcgttttggagcctggcctccaggtggcgctgttggaccttggacgctcagtctttgcgcctcaaacccgacggttgttaaaactggcagctggagaaagggaatcgttattcccgtcttgccaaagagccatttatagcacctttacaagcttttaaatgggtttgcatgttgtaaacatgactgagtcactggggggctccccaccccagcctcctcctgcgctagctggcagcaggaataattagttaattacaattaatggtgcattagccctcgcgtgattccaaggggaaggcgcatggtttggttgtcggcagttgtgaaacttgctgcttgcccttgagtcactccccactctgggcctcagtttcccccattgtgaaatgagagtttagatgaagacagccttgagggtccttcaggcccctgtgcaggagggcaggcagggagggggttgggtcagggctttgtcctgtcccactgggtgggtggggtatgcaccctgacactggcccacagccgccccccgccccaaaggggccagccctgtgcttgatgctgggcctgcagttgtggctgggacatggccctcaggtgatttctagatcttggaacatgggagtttggaatcctaggaccttctagttcactcactcattctttccgtttctgaacccttcttgagcctctacctgtgcctgaccctgggctaagccttgcagatacagagatggataaatgccacatagcccctgaggactttgcatctcagcagcagggagaagccaccccgtatcagatcatcaaaatatgatgccgaaataggcatgcacagagacaggccttgatggcctgtggaggctctcttaggggaagtctcctggcaggttttacgtctttagttcccacctacatccttcctggggtgacccaagccaagaggttgggcagctgctgggcctagaaccagcacccaccagcgcctttctctggctgcatctgctccagacagaaccaacctgggagtgtctgtttctcagcttcccatccactggggcagaaaatcctggcatgtcagagcctggaggctcctagagaccatcccttccttcttccgtaggaggggaaactgaggcccggaagggcgagggggcttgccagtcttcttacagtgaatcagggacacagtgggcaatggaaaggagtcccagggtatgagagatgatcacaggtgccgtcccggcagcgggcttctgggaacggaatgtggatgaggccacaaggacccagcggcttcccccggcacagttggtcacgggtgccctggtctttggaattctgggctggggctgcgtgggggagggccccagcctggcccttggaattgtcgtgcctgtagccctgtgtgctggggaggcccctgcctcttccacgcctcggtctgtgtgcaggatgccccacctggctgggctcctggagttgacctggtgcccatgtcatctcaggtggaagactgagaccagggaggcaagccctgcgtgttgggacctaggctgcattgctggctggctcctgtctctgtccccactgcgctgatcttatttctctgtctgagatctcctccttgggcttccatatccctacttccttctccctcctcttctgcccagaataacttccatacatcctgggagcttcctggtccctaggggcagccatcccggcacacggctcctggcctgtccacctggtaatagatggttccaccgttggactcgagcccagcctgaagcagccctgaaaacgtggggttgaacccttgccggctccttaccgttgctgggcaccttcacccccgcattccccagtcctcacagacactgccagcgacgggtcatgattgtctcccttgggcaaaggagggagctgagttaaatgaccgcctgagactgtgcaactgaaaaactgcagggcctgggatgttttccgacttgtttttagcagtgcagttctgatttcaagcagtgacttaggcagaaacccttcatggtggtggagaggaagaaagcggcttccagggctgctgctcctggtggggagcgtgggaggctcttgagcctcctgggcagccccgtgcagctctgtgctgcctgcagcacacggcagggaacgccgcctactcacggtgcttgctgaacacctgtctgctctaggccatgccctgtgtggacactgggcaccggatcaggagggcttcctggaggaggtgaggcccgagctgagtgtccttgcatgtgagggagtgacacttagtgagcacctgtgatgaccaggagccagggtttcatcatcgccaggaccctgtgacacggtgggattatctcctctaacaaaggagagagcgagagccagagagggcaagagatttgcccgaggccactcagagctggggccagagcgggcctggagcccggtcttccccagacaccacacccgcccagagccggagcccagggttgactgctgctgtggtgggctaagttgctgtgagtttggatgtcccagaaaaacaatcagcgcacaggccccggggctcgccgtgttcagtcctcccagagtaacagaagaagagggagaaatgccccgagtccactaagaacctgcaagggccgggtcgtcctctaatgtagccttgaaagacccgttcttagcggggatcgaggagcccgcagcagggcccgcgccgtcgtctttgtaaagcccccttgcattcctctttaaccggctgtcaaagaaaaatgaagaatgcgttttcgccctgtgcaaaaatgctccattaatgcccgagggattctcaggccactacaaagctttccttatctggctctggattcattctcagctctgcagcctgtaatccggggtgctctgggaagagatctttcaggtagtatatcctgagtgatgactaatgggggagccctggctgcagcaggggcgggctgtgtatcatcagcgtgcggaagagagagacagaaaggcaactcgaggccacccgggctccccgggcccctgggctatggctgctgtctgagcctcagacttcccctccagcctccagatcaccacttccttttaactctcaggccagccacatctgtgtctgtctggctccctccactcagcctcaagacccagcatgtgtgtgaccacttccaagaagcctcccctgactgctccagggtcatggctgtgtgataggagggcctggcctgcaaaaacgccctccctatttctccagggagggaaatctgtgtgctatgaggcttggttgtggccacatttctgttaaaaccctgccaatgccaacaggagctacagagcctgcaggtgaagtaattctttggcctacggacgaattttgcatgtggacctcctgacccttgggcctcccgggttgcagggagctacggagttgtctttgtagttttttgcaggccagcccctcctgtcgcacgggcatgaccatggggcagtcaggggaggcttcctggaagaggtcacacacattctgggtcttgaggctgaggggtgagccagacaagtgggacacccaaactcacagccacgtctgtggctggcccatgaacagcgcgatgagaggcagggagccaggaagggagggcacagcctgcggtttggggctgctggagcatccagggtgcagggagggtcgaggggaggccgaaaggggctgcagggccaggccttggtggatgctgtcctggggaccacgggagccacgggaggtctgtgctgcccatggagcttccagatcccgctgctttatttaacccactgggcctcctgcagcttgaggttgcggttgaggttgtacccactcagcaggtaagaagactgaggccggaagagccaagtccccaggatctcccagccaggaagtgttcgaggatagggcttagacctgaactgcccagatccgggactccccatccccatggcctatgttaagccctgattattttttctggtctatactagctggtatctacactggctggcatctgtcagccgtggttgagtctgagtcccagccgtagaggataaatagtgaagcacctcctttcacacagtcacagtgctcccggccatgggatcttgggtcctgggccagcccctgatgaggaaagacctccctgtatgtccaggcagtcaaaagatgaagttcagatgtcaccatgctgcggaatggcgaggtcctggagggtctctctccggctctttacctgccgagggcccactcatccttggtcacacaggcgacccatcatgctgctccctgggacccccagacctgcctcctttccaggacccctcccagcctcaatgattccccagtgacagccacagccgcacctggtgcagatagatgctggggctggctgcaatttagggaggatctttctaggctggggcaggagcttcacggctgggaatgggctttaatgacaacctacgcatcttagaagacattcagacccactccactctgcacagttgtttctgggcaagccctctgatatgatttagtgcacgtgtggctgggtgtggagtgtgtgcgtgtgtgtgggtgcgtgtgagtggtgagtgcgtatgcacagggtttgatctctgagatgttttatactctctggcttggagaagggacagtcctgtagtatcaagaccagaccttgtgtccccagcccaaggctgccctgggcctagggacagtatttggagacttcgctggcagttttgcgttggaatcacctggtgcctccctgtacgtccacccaccctgtgcccagatccccttcgcaagcaccatatgctgttagatcctcgagcagccttgtgggacagccaccctggggctggtatcaccatttatgtaagaaaaaaaaggaagtgctggcccagggtcccacagccagcaagttggagctgcactgcccaagcaggtcctttagtcagctctctgttgtcccccaagcccctcagccccccaggcagctctaagggctcagctgctgcaggattccttagagaagctgaagggtttgggtcctcagctcctggccggggcaagtctggccaagcagcatggcagcgatgaagtccacatgatcgaagggtggatgcttaccttagacagctgctcaccttagacatggtcacctatattacatttaggaaggaaacgccctaattggagactctgcatctcattaatggaatcagatgaaacgatgtatgtgaaagctcccagcagtgcctggcacacagtgggtgcacaggatgtaaatactgatggaaacctaaatgttctgtaaatatcagttcttcctaatttcgccttgccgtctctcttgagagtggctataccttctaggcctgatcaggaaggaagctgggttttggtgtgccagtcaggtgagacgcagagaagacagcacaatcaacacaggaagtaacagaagcagctagttactcacaggtcctagagaggtggggagcaccccttgcagggccaatgggaaggggaagcgcctgcagcatgagagagagagagaatgagagagagagacagagagagacctgtgggaccaaagcctttactggggtccagggtgttatccaggcaggtttcccgtgaggaattctaactggggggcttggagcaggcaggagttccctgaggtcatgcggtggcggatgggggtcacttctgcataggcctgcactatcgatgtaggtgtgagggtctttgggttgtatccagctgtcccataaggcaggggcccccaggaggtggtggtataaggcagtcctctgggtcaaccgccttaaggaactgggaggaggtggagaactggaacccgcagcaagggtgactgagccctgctctggtgtgggagttaaacgcacattcagaatgcgtgccgaggcaacataggatgagaagccggcacaacacccaggcttttccatgaaagtgaacttgacagccgctttcccacattgtctgtgctgagtcgtgggagcctctgagttttgccagtgtgtcaacgcgctcctgcagcactctcacccccacttaaagggaactaccacagtttatgttttgaaatcgcattttaaattccatctgtgggtgtataaggattattacccaatttcaagtttaccgtttgaaaaatagcaatggcgtgagtggccccttttaggcaaagtgtgattgggtctgtgtggccgcggcaaactgctctgggcttgcggctttgttctctgtttccagctgtgtgactttaggcaaatttcataacctgtctgagcctcagctttcttctcagtaaaattgccataataatatttgccctgcagggtaatagggactgaggtgtgtgcctgttttaacataagagtggtctagtctggaggataaatgagccgctgggaggaagaagtttggaaatggagggctggtgggagcccggagccttcttaggggacaacaggccagatcaaggatgatgggacagggccaggaccgtccagcccaaagtggctccaactgcccaggacctacttaataggcagatctcgcggcctgggctggtgaggccggcctggccggaagcaagtcagcaagcaggcctctcaagtcctatcatccttgaattatcttattcattcaacaagaacatcctggggtacttttctatgccaggccctgcactgggtactgcagaacaaatctacatccaagctacgcatcctgcttttaagaagctccccaccagcatccatagcatcctgccagagttcccacagctgaaagtgcttgtggtttaggggttggtgtcatcccagttcatgtctgagagagagagagaagtggcgtgtggcagggctgctatgtacagttggatgtgttgtgcactgcaaaatctaggcagcaccatccaccggtgagtctatttgcagtacacaacctgctcaactgtatgcagcagccccggtacaagggcttgtgaatggagatatctacctagctgtacctctccccctggccaggcaaggcctcagtcaaggcttgagaccgtccattgtcccagccagcagggcccagatcacctcgttaaaattattacctcttaaggggttaaatgtgcgccgctgaccgcgtcctgcagcccatgtggagagtttggcccgggatcagtacacattacaaatgagattcagaaattccacctaaaaacaacagcgcggccgtccctgcccaacgatgagtgattgccctgtcctggctttcacggcaaatcccagggatgacgcgctttctcttttctgggagacacagccctgtcaccccgggggccacaccctggctggcagccaagttctttcccagggtgctgggcccggcctcctctgggctgggatcagctgcggcctgactccatcttgagctgggggtgtcaccgagggttccaggaggtggagggcatggggacgagggtgtctcagagactgggagatggaaggagaacacacaccttttctgctccctatgtcgtgaccccatggggcagagatgggctctgaggcatcagagcctgtgccctgtgtgacggcgcgtagccccccgaaacagctgctgttatccctccttgaggttatcagcccccaattccccagataccaaaactctcagaagtcacccccgtcacaaagctggtgaccctccctgcagcagctcctgggctcaggccagacccctcagaaggcttggtagcattaatggggtacagtctctgcttttgagcctacttcagtgagacacacagggggccccagggaccagtcccggaaacctccctgctcagtgggtggcccctggacagcctgggctggacctgcagtaacgtggacagcattcattcggagctcaaggcctcagccccaggagacgccctgtccatgtgagtgccgcactgcacacccgagattggttttccagcccaggacctggctaggaagggtcggcggggtacagcccgctcagcaccccctgccgtggccgcctctgcaggaggagacagcatggtggggagaggggactgtcttgccctgctgaacccccaggggtcggctacacccctctctacaggcctttttggtgtagcgcaggtgagacaatgcagccagagaggttgggagattacacagctccacatctgcggtgtcaccgtggacgggaccgtcatggtcccagcgggagggtggaaggaagccaaacttgagacgtctgccttgcacaaaggcagtggtgctcgtcaaggtttgggctggaagacttagcacctggcgggcatctgaaaatttccatctcccgtgcctgcttggtccccacggacacatgcctgagccatcagggactgcaaatcacaggggtgggaagacagggacgcacactgagcaggtgaaaggtggtggggggtaagcaggtgtttcggaaggagtagaggagggcccggaatggggccacgtaggaaagggtcacatccattcaccctggagtcagcccgagggcccaggcagggtggggtcctagtgatgcctgtcggtgggtgacatcaggccatccacagcaccgggagccagcagaaagggctgggccaggccatgtggacagggtctacggacagtacagggccagaggtccctattctgggaccttgacatgctgccgttctcgtgagcttctgggggactcctgcgaggcatgtgggctgcttctcagacctgcgggtaccccacctcccagatgttgtcaatgggatgtgaggttcacgagcacgtcacggagcctctcccctcgtcatgtacgtgcgcatcatggcaaaatgtgcctggccactggttcctgacgctggaaggcacgaacccactccccacacccacagccggcgttgctgtgactgcagtgtctgtgttctaagccccacttttcacatccatccccgctgcccggccagagagacgtcctcagcccagagccccacttttcacatccatccccgctgcccggccagagacacgtcctcagcccagagccccacttttcacatccatccccgctgcccggccagagacacgtcctcagcccagagccccacttttcacatccatccccgctgcccggccagagagacatcctcagcccagagcttcctatctccctcgcctgctcctaccctccagaataaaatgtgtacgaggtagggaatctgtgcttgtctgccagttgtggtcactgctgtatctcttagagtggggcttacccctgggggcccagcgctcagggatgcgtgggctccaggctggagagaagcacccagatctaccaactggccttccggctctgcagagccgcttgcatcttactccttcctcttccctccgctctgcttcagccactccagcccatgcctcagaccccaaatattccatggcctctctcctctcctggactgtagccgtgacattcacttccttctccttttggtgaactcctattcatccctccaagccgatgtcagctgtcacctcctcttggatgccgtccacacgctccacatgcagagtgtgcagctccttcttttgtgctccagtggccccagatgagccccttttgcaactctcctcatactcattctcccaacgagtaatgtgtgtatccctgggggcaggtcctgctctgaggaatgcagcagtgactaaggcagacatgaacgcctctctcatacactttttatcccagagggtaggagtacacgagaaacaagcataatatatacacggtcagatggtagtgagggctgtgcagagcaggggaggggagtgggaggcggggtgcagcatggcggtacagctttaaatctggtggtcagtgacatttgtcaaagactcaggagctgaggaagtgacccacacagagatctggaggaagagggctccaggcagagggaatggcagagtgctggagtggccatgcctggggaactccttctggaaagtctgtcgtgaaccagagcagataaatgcttgtgctggggggaggggtgtcgtgaaaagggaaacaccaggagttgtggcattgggagtttcttcgcttgactttcaattccaccaaacaattcctagacagaagagcctccaggggtttattcgtgcaaggctaccctctgtcaccctgtttgtccttgcttcttatacacacacagaacagatgcacccactggggtcaccccaacccagcccccagcagttgcccataactggccgcaggatcccacacacctgctgacttccagagtcaccaaggggttaaaaggggctgggaacagcctcttagtctccagagcctcccgcaggaatgatttgtgaccctcttaggctgctggtctgcaccttctgaaaagcctttaatatcaccgggcacattcataaattattcttttttaaaaatgaaatgttttagccaaacagcagtagaggcatgttgtgcaaaattagcaaaaaaaaaaaaaaaggaatgacgatgatatgaatcttttggcggcctctcctaaccgtctttaaatctgcgaaaggatctcagtgcccgccattacctggccagcaccgggaggatgtcaggtgcttccaggcggactctgctaggaacattccatctgtggccaaggctatcacagtcctcaaattaacagcaaaccccgcgtggcccttgtggtgtgccaggcactcttctgggcatatatatgtattttttatatataaaaatattttttatatatataaaaaatatataaaaatatttttatatatataaaaaatatgtaaaaatatattttttatatataacttgctcctcatagcaaccctgtagatcattattcccattttccagatgaggaaactgaggcacacaggagcttccaggctcaggtgacatgaattaagaatgcacacatcatgctgggactctgtggggttcctgctgtcatgactttccccagcgaccttggggagggcagagttctactctttgaggcttgacccggtcctgaaatctcagttgtcacttctgcatcctgacaacatggagcacggtccatagcgtaggtgtatcgtaaatgttcagtccatggcagcgcagacagtcatctgcagattcgcgagcctctgggatgatggcctggaaaagggacattgaggacgtggccttgctccagcctgggggggctctgtgccatggccctgcagcagggggcccctttctgccctgaattggctcattcatggcgcctctcaggagtaaaggagaagaaagtgatggttctccaccaacttcacctgtcccctcctgctgaactccagcagcggctcccatggctccaggagagagaaggggcatgactggcctgccctctcatcagcctctcccctagccctccctcctttactctcatctgctcaggaaaactgagagcaccaagctgcctcatgtctccaccctccccgcagagcaccctccccgcagagcaccctcccatcgcccttttcttgttgggcacctcgttcttcaaagtcagttcaaggttaacccgttggggaagcttccatgacaccagttcccggtttggggtgtgtatttctccgaagctctcccaaaggagatttgcttacctttatcagcctctgctgccccaatcccctgtgcctgctctcccagtggctgagagccccatgaagagccagaccagggccaggtgatgttggtaaccccagcacccagcactgcagccacccacagcaagtgctctgtgcttgtcagatagagaagagagggctctgctctgacctgcaggcctggggctcaggaccccctctctgcactcaagggctgcccgccaggccagcctctcttcccccccatccctccagaccttcattgcatctgtagaaagaggcagagtagccttcactccggaaggcagagggcaggacttggcccctctggtgtgcccacgtctttgagtgaagttggcaagacttgaactcgtcctgcccttcgtggccccctcaccttgggggattgcaaggggttcagtgtggctggggcagtgtgctgagagctgggctggacggggccgtgggcctcagcaagatgcgtctcacctgctgtgagcccgggtgggggtagggtgagaagagccccctgcagagccacagtgggcccccacggttggatttacctcctggctctgagcacagtgggaagaggcatgggaggggtgaaaaggaaggtggtacatgtgttcaggtagatgcgacgaggccggaactgaggccaggtggggttgtggggagagaagggaggagagtctggagacctttaggaatagaatccattggcctcagtgatggtttaacctgagggatgggagtaaggggcctatcgagggcgactccaagttcctggcttgggggtacctgcctggagagtgaggggtaggggaggaagggaagtgggtttaagggaggagggtaggtcagtgtttggcgtgcttggatttgaattgtccatctgggaggggcgtctggagaaattggagtggactccgagtttgggtcgggggcccaggaggaccccacccagcaggtaggtgggtggaggctgaggtcggctcaggagacacacggagggaggggacatgatttcttatccctctagtctcagtcacaagttcacttctcctaaaaggaggtgcctcagacagcagatccttccagaactctcccagaccttgtcttcctttggcaaggccacagagcttggtggaaggggcagtggcccagggtctgggctccagttctggtttactgcttgctggccgtgtgattgtcagcaactcacgtaaccacacagagccaaattttctccccggtgagcccccactgcctgcgtttgcgatgagaggagagacagtcgatgtgagtgagctctgtgatgacgaagcactgcagaaatgttagttcccacgccacaggtgaaggctgaagggctttagtccaaagctgacatttcccttcatatttttccccaaggggaaaggtgcaccctgaaacgaagagctgtctctttcgttcagctaccttcagctgtcccctccaaactgtctgatttagctcacgggagacctgcggaaggagcacatttataaccatcaagaaatacggatgatgagttttgctgagacatgttgactgacacttagtattttaaatatgcagcccagacacctgtcccccttgcttcccggcttttatggcgtttctcagccaagcagagaagaccaggtttcgggagctcagtcccttcaactgcaccaccagcttctgatgcgattctctctaattgctttctgctgtttttgccgtgtgtttatgactcagctaagggcagtacagtcgggaagtgtcctgcgcgccattttgcagacaggagggaggaagtgtcctgcgcgccattttgcagacaggaggaaggaagtgtcctgcacgccattttgcagacaggagggaggaagtgtcctgcgcgccattttgcagacaggagggaggaagtgtcctgcgcgccattttgcagacaggagggaggaagtgtcctgcgcgccattttgcagacaggagggaggaagtgtcctgcgcgccattttgcagacaggaggaaggagatgtagtgggatgggaagatctgggctctgaggtcagtccccgctggacggaaacctgcggccctgttagctccgtgatctggaaggtgctactagtagcgcctcatttttctccccaggagaaggagggcgaccgtgtctcatccctaactgcgatgggggctgaatgcggctgtgggcacatagggtctctctgtctccacccatgtctcctgctgtgtggcctctttccagcccatccacactctagttggtggctttgtgagtgctgacaatacttccatgtgcttttttgttttttcttttttgagacagagtctcgctcagtcacccaggctggagtgtggtggcgtgatctcggctcactgcaacctctgcctcccatgttcaggtgattctccctgcctcagcctcccgagtagctgggattataggcgcctgccaccatgcccagctaatttttgtatttttagtagagacagggtttcgacatgttggccaggctggtctcgaactcctgacctcagatgatccacccaccttggcctcccaaagtgctgggatgacaggcgtgagtcaccacgcccggccgcacatattctcaacgtttcctctttgccattggtctgtgctgctcgtcctcgcctgcaggaactgtggagcctcttggggtgaatttactgaggcctggtgatggtttgcttcttcccagttgcctgcggtgcttgtgatgggcaagcctgtttgggtctcctctgagctcctggcctctctgtttcagcaccttgtccacacagccctacacttcccttcctttctgctcatggctggccccacatggtggccacagttaatttccactggtatgagatattgtgcagtctcttgattcatcatctggtttgctaaaatgctctttgacagccctgcacactccattacacgttgtcagctagaatcacaagcctcacgttggaggctgcactttagaagggaagatgacgtgcccaaggtcacacagctggtcgatgcagagccacctaggaactcgaggctgtaactctaggtctctttataaaccagtgtctagagtcagagacatgagactcaggcagagagaccccccccaccccccgccactgactttcatcatttgaaacaatggagagacaatcaagtgcaacatcaaatagcaggagctgaaagatggcttcgagatggggccgagaatgtggaccacagagcccaagaggcagcgaaggtctccccactgcacccgagcacttcgtgttcaggatcctggatccccagcacatcagctgcaacttacagagcagagccaagacatgaaagtgaagcgcccgaggggacctacatttttcaacagggagaaaaaaagtgcttaattatatctttaagaggcacagacacgccaagggataccagcagcgtctgagacctgaagcagaaatgccagggatgaggatttggaagattaacacaattgaactcagcactgtggccttttttttctttctggggcttcggaaaggtaggaggcaaacaccctggcaggtaagacagacaagccaggtgtgatggaaatgcacctctttgtcctgccttttactgctggggtggtccttccaaatgaaactgctctcacccggagccttcagtggctcccctttccttcaggacaaagtgttgtcttcgttcctagattgtgaggcttcagggactgattttccttcttccttctctccttccttcactctcttttcttcttcttctgccttcatcttacgacgtgttcatggcagaaggcctgccatgggcctgccagggcctgggttggggatggtggggcagaaatgagctgacactgtccctgaacaaggaggccgactgtgagcgtcccctgcaatgagcaggtgcagtgttgcagtggaaagagaccaggtgccaggtgacatagggggtccagggaagacttctgtgaagacttctatgaagcattccagctggtcccagtgtctggcacatgagacatggcaaatcagagtctgtaggatcaagtggatggatggaaccaggcccctggtggcagctctcatgtttgcgatgctgcatgtgggcagcgagtgttccttgctacttcttcctccttcccttgcctccctgtgttagagaagttggtggtggttctgaaagaacagtggtgtagaattcgtgatggggaggcagccaggaaatgacccagcttcttggttctctgagactgacgaagtgaggtcctggggcagtccccaccagatgaggcacgtggctcagcctcatctgcctgcctctccccaagattgacaccgttcccagaaccggcctgaaacttcatatttttgggctttgcacttgtccttcctgcttccttggctcatatttattcctcaaaacccaatttaaagcttcctgtttaaagctcctctgtgcagagtagcctctaatggatgggtgggtggattcatgggtgggtagcatctaatggatgggtgggtggatccatgggtgggtgtgtgggtggatggacagatgggttgattggtgggtgaatggatggatggttggatccatgggtaggtgagtggatggattggtggatagatggatggatggatggatggatggatggatggatagatggatgggtgagtggatagatggatggatggatgagcagatggttgggttgatgggtgggtgaatggatggatggttggatccatgggtaggtgagttgatggattgctgagtgggtgggtggatggatggatggacggatggatggatagatggattggtgagtggatggttgggttgatggatggttatgaagctatgaagaaaagtggtatcagaatcttgattctgcaggcatttatttggcatctattatgtgccaggaactgaggaccagctgaactgttaaggtcctctttcatgaagtcctccctagccactggcctgggttcagtcgaggtgagggcaaggaggtggaagtcatgcttgaactagcctggagatggaggaaacctgttccccaaaccagagcccaggaaaatgtggctaggctggaggagtgtgggcaggtccgctgacagggcatggcctgggaaagggggtcctgggttgagtggggttgtgcacagactgggagatgcagtgtggacttcaggtcagaggggagggatagagaagcggatttggaaggtcaggaaggggtgcacattccttgagcgcctgctgtgtgcagccgtacagtctgttgttcaaccctcgcagcatccctacttgttctaccttaataacttttcttgttaaatgcaaagaacctgagaaaatccaggccccgaatctgaccatcagtgattcagcctagcgcctcccttccccttcacagcacccttttccctagtgtggtccttcctttctagttgctcgtctcaccacgcagctgtttacaatcagcttggagctctggtcttcagccattgtagagaccaaacctcgtgaagtactctggtgcaatgtatttagggacaatcattttctatatgttcagggctttcctctctcataaatcagtccaagagaaatacttaacacctgctgtatgtttctaagaattcagccacgctttggctgggagtcagatcactttaaatattagaatgctttttgatagccagtggtcatttctcagtggaaagaaaaaggatgacatcgagtttgatttgtttctgattttgaaggttgctggggttttttttgttttatttttggttttgttttttgagacagagtcttgctctgtcgcccaggctagagtgcaatggcgcgatctcagctcactacaacctccgcctcctggattcaagtgattctcctgcctcagcctcctgagtagctgggactgcaggcgtgtcccaccacgctcggctaattttttgtatttttagtagagacggggtttcaccgtgttagccaggatggtcttgatctcctgaccttgtgatccgcccgcctcggcctcccaaagtgccgggatcacaggcgtgagccactacgcccggccaaaggttgctgtttttaatccctgttcatagaagaggaaattgagactcaggaaggtcaaataatccatctgggggtcctaccacggagccaggtcagttcgtatcctgcaggtctcaaagggcctacttagaacgtctgtggcaggtccctgtcccacatggagctcactgcatgagcactttcttctttctttctctgtccccagactgacccctgaggacagaccttcagtttctctacattcttatttagccagtgccaggcacacgtagcatgcgcagaccctctgtgcattggaactgttgataatattaatggtcccacatgcaccaggagtgtgtatttaaatatagacatttaagataaatatataaatatatcaacataagaatatgataattatatatacatatatcaacataagaatatgattactatatacatatatcaacataataatataattatatacatatatcaacataatataattatgtacatatagcaacataatatgataattatatatttatcatgtttatattttatatataaattttagagtaaatgtaaacattttatatgaacaaatatggatatttatatataattatatttacatataaatacacttatgtgtaaatataattatataataattatataaatttatatgtaaatttataaaatacactttaaactatttaaaatacagttatataaatttgacatactttataacatatatttttaatatattgttttatatgtataatagttatatatcatatatgaaactatataatatacagaaatataataataacagaaatagatctctttttttttgggacaggatcttgctctgtcacccaggctagaatgcagtggcacaatcttggctcattgcaaccttgaccttcccgggctcaaacaattctgccacctcagcctcctgagtagctgggactataagcacacaccaccatgcctggctaatttttgtattttttgtagagacagggttttgccacgttgcccacgctggtctcgaactcatgggcttgtgatctgcccgcctaagcctcccaaagtgctgggattacaagcgtgagccactgcacccagctgaaacaaagacatatctgactgttgcttgtggaggtgcctgccattcctccctacagtgattcacaggctcacccagcctctccttctccttcaagccccaaacctctgaatgccaggaagggtggtaagaagtgtctctgcgcctagtaccagtaaagttggcaggtcactgtggctagcgggggcaccattgttggcctcgggcctggggagagaaaaatatgacatacagggggcccacgggggtacgttaggttcagccctgtaagcccacactgaccctggtgggcagacccagcccagggaggggcaggcaggagtgaccccgtcatcaggttctgctggcgagcccagggtggtgacaggcgcacgtcttttgccgggagctgaagacgttcatgggctttcaagcaggacaaagcttcaatgtcatcaccaggtagcaggcagagcaagggtgctgacagcctgcagaagcctgtgcttatctctccatcggagctaaagcccatgtttgcttagggaacagcctgaaattccaccccagctgctgggcctttcacttttgaaacataagcccagagagcgaaaggggggaacgttgtgcccagattctctttctgagcgtgaacttgatgttcctgaccaggaaccagccactcgtaccgaaggccttcctgacccctcagttctcccctgagcctttgctgtgtcctgggcaccaagaggtggagataggctgtcaccgtgcacgtttcctaagcctgcagaggaactgttcacagaatccagcctggaatcagccgtttgtggcaaacagtcagtagctatttctcaacttgtggttgtgaagctgcaggctccatattcgctcttcacagagcatccaagcaggtgtctcagtgccagctcacaccgttcacactgctcacaccagctctggagagctgcttgtacacatctctccacaagtccactttcagtgttgccacgtggtaccggaaatttgccatagaaattggccgatggtacgaccagagagccacctgttagatagttaccccacatccccaccctcaacaccaccttagacaaatcctactgtcagaacatgtggaacggagaagggaccttggcggttcattcataaatgtcagcacccataggtctgtgcctgtttggccgcagacactggggagcagcctgtagccttggcttgtgcagcttcctctgcaggaggggtgcctcttccaagaaacctgtcctgactccccagccctccccacctccattctcgcccccgctggacaatgcacaccctccatcagagcgtggtgcatacctttcatcctagatctcccaccagctttgaaaccagcatcctgttcatgatgtctggaaccctgggaactgtcccagcacctgtttagcacatgtgtgcatgcgaaggggatctgctgagtgctctgctctggtgggaaggccgctctgcacagctggagctgatgccttggcagatgctgggcatctgaatcgtgcagtgcaggagcacaggggcatggcaccgtttgttgctggggaacctaggcctcaaaagggcctcagcctctccgcagtgcagtgaggactgtcccatactctcactgcgtacagagtatgggagagtctctgtgaggctttgggtgccctgcagagggaaggcagtgccagctgggcctggtcgggggccatggagatggcgggcccaggctggggaggacttgtggcacccactcccttacccgctaacccggatcccctggaatctgcagaatgcctggggttgctcctcttctaccctgccgtggctgagctttgtctgtgccctgtcctctggccacggtctttgcctgatccctaccctggtacaggcagagctccctgcaacccccagctgtttccccagaactgacaccagtctccctgcaccacccatcctccttttgactgccctggggacgccactgctgctctgatcctctgtcactccagccacctcttgcttccctgttatcacaaacactgaacagtgagctcaggtgtcagcctccacagaggcatgcacagcaaggggtccggaggcatgccccatggagaactgggggtgctctgcttgcaggaggatccagggcccattgcagtcctcagatgttctgggggagaggatacgcctgcttcatttcttctcaggggtcagaactgggcacagggggttggaaggagggagaaagatgtctatcaggtacccactgcatgccaggccctcttctaggctcccttaaaacctttcaggtaggccagtcacggtcgctcatgcctgtaatcccagcactttgggaggccaaagcgggtggatcacctgaggtcaggagtttgagactagcctgatcaacatggagaaaccccgtctctactaaaaatataaaatgagccaggcatggtggcacatgcctgtaatcccagctactcgggaggctgaggcaggagaatggcttgaacccgggaggtggacgttgcaatgagccgagatcacgccattgcactccagcctgggcaacaagagtgaaactccgtcgcaaaaacaaaagacaaacaaaaaacacctgtcaggtaaatggtggtagagcagaaaacctgggctcagaagctggcattgatcccagagccatccagtttcaaagcccacacccacaactttcctccaggttgggcagtgcatgatggaaaggctgtcccagcaagtagtgagttcactttcaccagtccctggaggcaggagcagagcctgagctgaccacttggaaggagatgttattcaggggactcgagcatctggcgtaggatgggactccatgaggtctatgcctccttctagctctgaaactcctcaagggaaaccatttcccagatctctacgttgctgcagtcccttctaacttccagcacaccttctgctctctccgcaggtgtcgtgcgccaggtgcggcccatcgtgggcccatttcatgccgtcctgaagctggagatgaactatgtggtcgggggcgtggtctcccaccgaaatgttgtcaacgtccacatcttcgtctctgagtactggttctgagggctggtctgccgcacagccgcaggtgcacctccaggccaaatcattgctgccagtgactgtggtctgtacttgtttataccctcagacttttttaatgttaggtatttgtagcattaggccaacatgtattaagctgagccagatgaataagtccatctgatgtattttcggtgtttaaaaaatgagcccagttgctcaactgtttggttgaaaaccttgctcattttttaatgcgaaggctaagtgtcaccccctttctctgcctctggctgggccttgctaagggccaaggaaagaaagacattttttagggggcagccagtccaaatgccaaaagaagaccagttcttgccctgattgtatgaaatttgacattttggcactttttttttttttttggccaatcagattttctatgttctaaggacatggctgctgtagaatagcacagacgtggatgataaattatccccagaagcagcatgacagaatgcctcggggagcacttggaagggaaattgcagttctgttgaaatagaggaaaatcccttggtaaagacacagcctgttaggctcgtgtgggcctccagtatgttcaccaggggaatggctgggatttctcggcactctgcatcatccatcttttcttataggtgggaaaataaacaactttgtgatcctcctg

SEQ ID NO: 35981 - DNA, 13940 bp, Homo sapiens
gtggagcagcgcgcgcaagcgaggccaggggaaggtgggcgcaggtgaggggccgaggtgtgcgcaggtgagtggccaaggtgtgcgcaggtgaggccaggggaaggtgtgcgcagtggggggcgcttgcccaggtgagcaggtgcccactcacagggcgagggtggggtcaggggtagggggcgtgcgcgcaggtggggagagggtccagctcacaggcgaggggccgctggggctccggggaggcggggcggaggcgtggatagtccccctcccccacgagccggcgtctgagggatgctctgtccccgcgctgtctggagcttccccgggcgaaggctgcctggctccggggtcggctcctggccccatgccgcgctccgcggcggctctttctcctgccccacctgttgttcgcctccctctttgtcagtgctgagccaggcacagcagctttgcgatgggactggcttgtccgccgtcctccctgacatgcggctgttgaagccctgagcactggaccttctgcctcttgcttgactcctactgtgggccttgagcttctgccctctcctgaaatgtcagctgcctgcggtcttattcatttttgtgttccttgcaggactttagccggttgagaaggatcaagcaggcatttggagcacaggtgtctagaaacttttaaggggccggttcaagaaggaaaagttcccttctgctgtgaaactatttggcaagaggctggaggtaagtgtatctcagtgccctggatcgtgggcgcaggctatggcttcacagcgttgaaagtacagacagactggtccaccagctctcgagtgccaacgactgtctgtgcctcttatgagtaaaatacaacataccagggcacctcccctttgtctgttcccagccgtctattgggaaggatgttacttagatgtttattgcacaactcaatgcttgtggctaaagagctgactcctgggtgaatgaactctgtaataagctaaaagtacttctttggtcttgttttaatcccttttgacaacattctcccagtggctttttcacactttagttctgaggttacacatcccctgacccttttgcaatttcccagtgttttacataattgataatgttggtaccaggcattgtccccttgtagcttatccatggcttggggcaagacgaatgccaccccattctacttagccttcctgtaaggcaagtgtgcatgtgggtggtctggattaacaccagtcagtgtgggaactagggatcggagggagtgggggcactgagctggtaagttttggctgggaagaaactaagcttgtatcttaccttgatgagagcctgggggagaggaactgtctaaagcaagccagcttgtccaggtggctgtgatcttgagatcagactcactagcgtgtcagcttttctcagaagtagttttctttcatccactttgattttacagatataaggagagtgactggcactcgccaggctctgtattcagtatttggggccggagagagacacggtctcttcctatcaagaactcttcgtcttgttttgtgcatcataggaactgcataaactaacttgtgtaaattgaatgaagtgcgggtactgaagttctcacactgcataaggaaaatgtctttcatcgttgaaattttttaaatgtgtgtgaatttttattaaagtaattcatgcacacatttttttaaaaatcagtgttaaaaggcttcagaagaaatactctctaccacatcccacatccgacagtcttgcttgccagcagcaaacacttttcattctttcagctacttttgtgttgttgtttgtacctacttgtttctaagtaatttccttttagtacccctaactttgcaaattcccttctgtgcatacaatagtcaataaatagtcagagtatacattgttatgacaaaattaccattattcactgttgagccaagtaaggtcctataataatggcttggtttctttttttccttccttatatgactttttatttttcctggagttaacagttgccttcctttttttttttttttttttttcatttggtaaggtttctatgcatctctcattcatttttttctggatgctctaaccgagctgtcacatatatcaataattttcctacacattcagatgcaacaaaattcatcattttcatttcctctctttcctagccattcatcttgtaccaatgtggactggtttctggttagtcctgctgcatagctgtcctcttgggacttgcccctgcccttttgtggacatggcttcagcagctctcttgggtctccagtttcctggatcctatgttgttgtccttgagtaatagttcacataggagtagaattctaggttgcaaaaagttttcctcaaaattttgaagtttttcatcattgtcttctagaatccagcttgctgttgagaaatctaagcctactgtgatttttactcctgttttttctctaaaagctttcaagagcatcttttaaaaaatctcagatattttaaagcttcacagttatgaacttgttctggaagtggggatgtcactgcttcccccaaattataaccatgtagagcagctgtgggtacctagagacattctgtgttctcttccccttttttttgaagggtgattattgatggtcctacatgggccactgttctaggccctggtagtagaacaatgaagaggacacacaattcctgcccttgggaagcttacattctagtgaggggagacagacaatacacacacacaaatgaatacttctaggcgatggggagagttactaagaaaataaagtacccagtggagggccttggcagggaagctggggagcagctgcttcagattggctgagagggaagatctccccaggaggggacattttacatgagccctgaacaaggacacctgcaaacgtgctctaagcagaggaagtcagtgccacagacaatttaaactgtgttcaaggatgagtgaagacccctgtgttcctggagccaaaggagaataggggagagtggtgtgtaggagggaggcaggagccagcttgtgctgtaagagggggggcattctgccatgtttggagaatgaactgagactagcaagagcagccatagcaaggtcacgtgggaggtgattgcagggtccaaggaagagagtctaagacaagatgatctcttccctgcctggaatctgctgtcaggaacaaggtaccgggaagatgtgcacaggaggccagccctgccaggcccaggagcagtggtggatgcaacagggaaaggtggtgtctgttatttgagggataatgtaagcaaggttctctttcttgcagggcccaatggctgcaaaatcgcaacccaacattcccaaagccaagagtctagatggcgtcaccaatgacagaaccgcatctcaagggcagtggggccgtgcctggtaaggatcttgcctgttctcccagctagaaagtaaagtgtggtctcagagctttccagcctttggaattgtatggacccaaaggaatgaaggacctttttaaaaaagatttttttttttttgtcaagactaatgaaaggtaaacagttttccactttataaagtaaggaattataaaaagaaactagaaatcatggtcagtcaacaacttagaaaaaaagataaaggcttaaagggcagctggggccttcccaccatctgggggtatgacctattgtcacagctcccatttcgccatagaaccatggggacttcgtgcagggtgagtatcctctccgacctggaactggggaaaccactggccttggtggttgtgaaagacctacctccgctcatattctgagctctgggccttccatgggggccacagatagtgccaccagttaatcaactacagtagagcaggcatgttgagtggcttccctggccgcaaggagggcccgtgctaggagctaatgccttctgtcatggggtactggtgggtttgagcaacagttctcccacacagagcctcttagggtcctggtggggcccagggcagatgggccccagtgtgactgcctgcatccgtcctcgcagggaggtggactggttttcactggcgagcgtcatcttcctactgctgttcgcccccttcatcgtctactacttcatcatggcttgtgaccagtacagctgcgccctgactggccctgtggtggacatcgtcaccggacatgctcggctctcggacatctgggccaagactccacctataacgaggaaagccgcccagctctataccttgtgggtcaccttccaggtcagcagcccctgccctggggttgggacacagcaggtggggagcgtgccctcctgctggggtagtccttccatttgtctgggacatggatcctggctcaggttgacatctgggttcccgggacccagcagggcattccctggactctgacatgttcagattcatcctcagctgtaaggcaggaggcacctgtcacatcagcgtttgatacaccttcacggcatgcctgcatgcagttgctgggcacgcccagctctgcagggacaagctgaggataggagcaaaaccccgtgggagggcagtgctgtcctgaggaagccccattgtcagcaggagtcacgccttgcaccaggtctggaaaggagcatctcagtccccaaagggactctctcagtcatgagatgccactcagagaagcgagggccatgtttccccacaggcagtcgaggcaggtccaggacgtcctcagctccatggtgtccccactggcctcccagtccagagggagttccaggaaggggttgttgtaaacctggtgcacacatgggtggtgctgattgcctgaacccaggaaaaggtttccagggaaacggtgctagaaagagacaggcctgggttttccttcctgggcgggaggaaggctcagatcatgattagctgtttctccccagggtccaagcttctgggctccagaatacttctcagttcagatctcttggtccctttgagtgaaaaatgacaggggcagtgtgaatcacaaatagccacaaagcaggaacccccacctgtccatcagtagatgaatggacccacagaacagaacactgtgcccactgtgggacactatttggcagcggaagggaatgaagctctgatgccagtaggcggatgacccttgaagacactgctgagcgagagaagccagtcacagaggctgcatactgtgtggttccctttatatgcaatacccagtacaggcaaatccacagaggcagaaagctcagtggcagccaggggcggcagggacagggaattcagagtgaccggagattggaacaacattttcttctgtggtgatgaaaagttctggaattagcagtgataggtgtacaaccaaccatgtaaatgcgctaaatgccgctgaattgtgcactttaaaagggtgaattttagccgggtgtggtggtgcacacctgtaatcccagctacttgggaggctgaggtggaaggatcacttgagctcaggaggacaacgctgcggtgagctatgattgcaccactacactccagcctgggtggtagaacaagacctcatctcaaagatagatttatatatatatataaaaagttgaattttatgggattctccattttaaaaaggtgactgggagggacctgtgcgctctcctgaggggcgaatggagccctgggggagaacgccttggcaccttccctggttgatgagtttattgtctcagaacccccttcaaaacccacagcccagcagtttgagcttccaggagccataagtgcttcaggaagaaaaagactatgattgtgattctcatgttcctgctatgcgtccccctttgcaggtgccctccaggcggggggtgatcaggctgcttgtgtgtttcaggtgcttctgtacacgtctctccctgacttctgccataagtttctacccggctacgtaggaggcatccaggagggggccgtgactcctgcaggtagcctcctcccttccaccctccccaggctcccgttctcatccctttctctcaggggccagtcctccccagcgctgctttgtccctaagacttgtcacaggatagaaatccattttgcttggatttttcacagcaccaggcctcaaaaccattgagggcagctggggccatcccacacccaggttagaaatcactttcctgggtaaggagggaatggatggcccagctccttcccagccccatagcaggggatgcactcggcccatgaagcttcctgcagagaccaccatgcagagaccaccattcctcggggctgtccgtgggagaccttgtctgttcattccttgccatcattgagaacccacgaggagcctggctttgtgcctctcacgtgggtgcagactggaaccgcatcccaactctgcccccagaagctccctgttttgaggggtggatgggctgaggtgctccccaacaattacagagggggccaggcataccacaggggcatcctcacttgcttctgcccctcagccctgacctccctatcagactgcacacctgtcactcagcctatggccagttaacgagatgcagaaccaaaggatggactcagcctcccctccctcttcctaggagcaggtagttccttggccaagggtataggggcctcagagatggttcctggggccccagatgagggtccgcagcagcagaggcccagaaagtgaccagggcccccgccaggcatgcttcagcccagccaagctcctcactgcgggttgggaaagcgccttcatttctgaatccttcatctgcaggggttgtgaacaagtatcagatcaatggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactggtatgttcttagcagcgggtccagcctgatgtagaaagtgcaaacttcacccctggcctttcttgctgcctggggcaggtggttgtaaagccctgagcactgagaatccgtggaagaggaggagggggatggaacttgcttcaccctggggaacatcctttctgaatgtttggtggcttctccagccttggcaagaatgcagctgaagatggccaggtcagctgtggtggccaagtcattgcctttagggctggcgtgggggtaaggaagccaggaaaaacttctggcttggggcacaggcagcccattgcctctttctttggataagctggtgaggcccaaaacaaccttagtgaagagtcttattgtccctgtggctttaattaacagcttcccaggagagccctgctggcttgtacccattcccatggctggacagtggtgagccactcatctctgtccactcatccattcacctgcccatctccccacccacccatccacccccctacccattcatctacctactcacccatcatccacctacccattgccccatcccattcacccacccaccaatgcatcatccatccacctatccatcacccacatccacccacccatcatccatccatctaccctcccatcacccattcatccatctgcccatccacctacccacccacctacacatctagccacacacccatccacctgcccatctccccatccttccacctacccacccacccatccatcatccatctcatccacctgcccatccaccctccaccccgtctgtctacccacccgtcatctatttgtccatccacctatccacctacccacccacctacacatctagccacccacccatccacctgcccgtcatccatccatttacccatccatccactctatcagggcctgtaatggcatgtgccgaggggaaggaatgcatcatctcatccaggtcaacctcctgcctgagcaatgtccgcagctcctgaccggcctcccttaccctctcaggccctcctagcctgctccctctggcttcctgggtgacacttctgaacacacctgatccctgccaccctgcaccccagctcaaccctgcctatcatatatccatccacctgctcctctccccatcccattcatccatccttccacccactcaccctgttatctatccatccatccatcataaaccaatgtttggggggttctcttgtggacagttgtaggcagtgggacttacagttcagtttgggggatccaaaaaaccccagtgtggtttacacctaggctcttgggaaatgtttctggaggatgacactttgtagcttgtgtgttatcagataacgaggctggccttcaatggctcctggaaatcatcctcgctaccttataatcatgtagactttgtgtgttttgcttctttctacttaccctacctgagggaactggacatgaaaataggattttctagttaacacagaaattgttgtgtgtcctcagccagctagacctagtcagggtctccacaggggttatctcggctgatgctctggccctccggggattgggggattcaggtaactggtcaaagaacttgtcctgcacatgctggaagccgggcccagggtgcgtttgtcattctctacgttggcgtgatttataatgtcactcacccatgagggcccacgtgccctgcgtcggcttcaaaccgtgtgcttgggccccagaacgtaatctcagtgcaatcaagccagttcttcagctcacctgtgccatgcgtcaagggcatctggagaagggtagagagaaacccaggtaccagcccagggccggtctcccacccttcccgggtgcagagcaggtgcccctgggcttctgcctaaggaagtctctgctgagcagcagctgaatgcaaagcaaagtgaatgagggcgccaggaaccagccgacaagcattccagccgtgggggtcccagcggctcatggccagcttctgcctgcgccgtctcacgttaccctttaggaccctgggccagtgctgggctctcgctaagtaaggtggcttcatcttgtgagatatgctcatccactaaatgtatcttttatttatatttttaagcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggtgcctgtcatggctggagagggtgaaacgccgatgccggcaggctctgggggaacccgcaagccagagcgtattcccatgaccttaatctactgcttgtaaaagagagtcagctgccctccccaggtgtcaccaggaagcagccggcgagcacttggtgaaggaagccatccttgggtgcctgtctctgccagccctgggaggggaggaggcaggttctacgcagccaggcgtggtccaggaaggtctcccttggggattacacctgggtagaatctgggggtgtgtgggagttaacctggtagagtggaggcaagagtgcatgctccaggaaccccctgtagggagagagggtggcaagtctgggacactcagaaacatcccgcatcctgaccagagagcgttcaggagctcagagccaggtgaggctggaggcctcatggaagtcttcctctttatcttaaaagcagcaagacccagaaagtgtgtgctgagctggggtgcagggtggcagcgatcaggtgcattcggaagcgtcacccagggagccagcgggagctggctaggagaacccgagagggtgagggaggcctgtcaggagctgtggacgttgctcgggcaggaggttgacctggatgggatgaatgtatcccttccccttggcacgcgccattgcaagccctgagaacctgggctgggagagatgccagggccatgggctcggggtggttctgaggacaaggaagcccttagccctgcccatgacccaggcaggaacagccccagccgcagggaaggaacagccccagcattgaggaagttgctgagcagctcccgagcaccccctgctgcatctgcgtggagtgtgatttccccgaggtccatgggggccccaggagggccgggggtggtcagcggctgcttctgtcttgcaggccatctacgtgattgacttcttctggaacgaaacctggtacctgaagaccattgacatctgccatgaccacttcgggtggtacctgggctggggcgactgtgtctggctgccttatctttacacgctgcaggtgaggaggtgggcagagctggcccagcggggcatttggcagacacatgctaagctttctccttgcagaagcgtctgtccttgggggcaccaaagctgccccctgtttctaggaagaagggaaggcctcgtgtattagccagctcagccagcttgggccagcagccagggaggtggccttgagtatgtccctaacatctgcaaagtagggcagatgccggctcagggctggatggggcagtggaggtggaggtgggtcagtgcgggcactggcaggaggggtcctcttcattcctgcctcctaggatgtgctgggcactggggcagggctgccctgggagttccaggacagtaggggatagcaagtggccttgtcattggcatcaagccccccactcccctcccagctcaacgagagcagccctgctctgatttggggagagtgctgggctcccaggtaaggtggctgcttgaccagatgccacctgcccatttcaagagcaacgagccccctggggacagaaataactcaccccagggcacttgcttagcagaacggtggggtggcctgccccaagaggctgtgcccaagtggagagaaccaacgtggagaggctgtcacctattcaggatgtgacaggcccggcatcacctgtgacagccagtcctgtgggatggaggtgcgggtgtcctggaaaaccaggattcccacagcagagggggccagtaccaggtggagggtgcagagccccagctggccccatgctcacaccaggtccttggagccccccgcatggcccacccggccccatttctccacctggctggctgcaggtctgctggttccctggttttataaactccattttccaaggatgtgaaaacgtagcaataggtcccactatataatagctcttacttgctttagcctctgtgtgtgtctcgagatgtacattttttatactatatattaggtttctcccaagaagcagaatcaatagaggggtggagggtatacgtgtaagaaagagatgtatttttcaactcatgtgattgaagagtgacaagtccaagatcttcagggcagcctggagccccagggaagagttgatgctgtgcttaaatagaaggtcactttttttttttttttgagacggagtctcgctctgtcacacaggctagagtgcagtggtgtgatcttggctcactgcaacctccacctcctgggttcaagtgattctcctgcctcagcctcccgagtagctgggattacaggtgcatgccaccacgcccagctaatttttgtacttttagtagagatggggtttcaccatgttagtcaggctggtctcaaactcctgatctcgtgatccgcccgccttggcctcccaaagtgctgggattacaggtgtgagccactgtgcatggccagaaggccactttttagcagattccctcttctttggggaaggtgggtcttctgtctcttaaagctgtcaactgattggatgaggcccacccccattgtgaagggtcatccactctgcctggttgactgattaacatatgaacctcatctgaaaaatgcctttacaactagtgtttgaccaaatatctgggaacaatggcctggccaagtggacacgttaaattgaccatcacaatattaaattcagattatatttttaatactgttacatatttgatgtttatgctatatgtcatatatatagggggtatatatacacacacacatacacacacagacaggtagaaggcaggtagagttactcatttaatgaccacaacagccctcaaggttggtgcttttattcacagaagagaacacggaggcaaggcgtgtgtcagaggcagagctggggtttgaccccaggccgctgggcccccgagcccacactcctgtcctctccctgggcaaagcaccgcttgaccccttccccctcgccccccagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgatgggcagaggcaccacagcaagctgctggtgtcgggcttctggggcgtggcccgccacttcaactacgtcggcgacctgatgggcagcctggcctactgcctggcctgtggcggcggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcaccggctgtggcctttcaggtgtaggcaggtgggctctgcttcccgattccctgtgagcgcccaccctctcgaaagaattttctgcttgccctatgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttc

SEQ ID NO: 35982 - DNA, 13940 bp, Homo sapiens; identical to SEQ ID NO: 35981

SEQ ID NO: 35983 - DNA, 10199 bp, Homo sapiens
cggctatccgcgcgggagtgcgccacgcggggccggagcgcctattagccgccaggacctcggagcgccccgaccacccctgagcccctctggcttcggagccccccagcaccccttcccgggtcccctcgcccaccctaatccactctccctccctttcccggattccctcgctcaccccatcctctctcccgccccttcctggattccctcacccgtctcgatcccctctccgccctttcccagagacccagagcccctgaccccccgcgccctccccggagccccccgcgcgtgccgcggccatggcggccgtgcgcggggcgcccctgctcagctgcctcctggcgttgctggccctgtgccctggagggcgcccgcagacggtgctgaccgacgacgagatcgaggagttcctcgagggcttcctgtcagagctagaacctgagccccgggaggacgacgtggaggccccgccgcctcccgagcccaccccgcgggtccgaaaagcccaggcggggggcaagccagggaagcggccagggacggccgcagaaggtaagagcccagggcagggcgggggtgtggggggctggcatctcaggtgggaacagggggattcggtagggtctggccactccccagtctgctaggggaggaatggctggcttactaatgcgcacgcgagcccagatgcctggagggaccctgtgctaggccgaggtcagcgctggcgtggaggcacatccagcacccgggcggcagggccgcttttgggggccggtggctctagggttggtgctgtggttgtacgggtcgcttatccccattcctccagtacgcgacaggtactaggcttgagccacaggggactgtgctgtgtcaccccctgccatactaatgggaccactctccctgttggtggcacagcttcacgtcgtccctccctcctgcctttgccctcctactccaggaggtctcacgtaggtgagagagtttcaggtggtggtgagcacagggcttcaggtggtggtgagcaatgggtggtcctacattagtacaggaaattagatgaggtgatgcatcactgaagcatttaacccacggcctcttgcataatcagttgtcagtaaatcttagctgttttcatcgtggccctctggaaggtggcagagggtcttgtgatccctgtctcccaggagattccaaggcaccatccaacattcctgatgtcagcagcccctcccctgccaccccagctctagatctttcctggctgcttcccacaccctgggctgcctgtgcccctcctgcctctggctctccttccaggcttgctctcctggctctggggcaccgctctagcagccctgcgtcccctggctgtctgcatttggtagctttcctgtgtttctgccaaacttccctcatgctccccacctctcatcaggttctcaacagcacttgcagctcctgcttagggtcctgggaggattcccatggggaatcctcacaaccagtccctgctccctctcccagactctgaaatgagtgtgcagccacaagctccctacctgtcttttctgtcctctgtgtgatccctgaaccccccaggactccctatccttccaatcaattccaaaccccttacttctcgaaaggagaccacttcctcttctttgggcttcaatactcaaccaagtgtcccttttctttgaagcttttcttgccccgtaggagaccaggggaaggtcttgggcccatgtcccttcctttgtatggcagttggcagggatgaccagatgctcctccaggcctggatggctcagtcacctctctgccccttctgtgcccagaacagaatagtggaggagtggatagtaaggaacccctattgaggttttggcaggtggggggatgagggcctccccctgggaactgggaaccctacgctcagtctttagagaggttgagattggtggtcacagccccagacttgcagacagaaaatctgggtccggatcccagtttgccacttgggcaaatgacttaacctctcagtttgctgatccgcactgggaactgacaagagtccctgtgcccaggttctgggcatctagagaggggcctcatgggggcacagagctggctctgttcatttgacacgagtctgcatcttggacagtgcctccggaaaagaccaaagacaaagggaagaaaggcaagaaagacaaaggccccaaggtgcccaaggagtccttggaggggtcccccaggccgcccaagaaggggaaggagaagccacccaaggccaccaagaagcccaaggagaagccacctaaggccaccaagaagcccaaggagaagccacccaaggccaccaagaagcccaaagagaagccacccaaggccaccaagaagcccccgtcagggaagaggccccccattctggctccctcagaaaccctggagtggccactgcccccaccccccagccctggccccgaggagctaccccaggagggaggtttgtgccgggctcctctggggtgatggggctctgactgcctgctcgggtggaggcagggagtgggaggcaggtttctggggccctgcttcctatagaccttcagctccccactggatgggaacctcacttttgctataaatttcacaatttgattggtgggctccctcagtgctgtagcctcttttgggtagggagagggcttggcagccttttgggtgggacctctgtccctcaggcccctgcccagatgtccctgggctctgagcccatggagttccctcctgccttctcccgctggggacagctttgtggtagggcctccagcagcacagtaggttccccagaaggtgggcccagctctctggccccatgagatgccagcaggatgctgaaggccagaggagctcaggcctccttggagtgagctcggcctcaggagggtgtccacaggctctgtgtgggctctatgggtggctggtggcctgaggctcccaaggtggtcagagcaggcctcccgcccacctgcttctggaactcctgtgttgcaggggcgcccctctcaaataactggcagaatccaggagaggagacccatgtggaggcacgggagcaccagcctggtgagtggccgtcatccgcctggccttggggccagctgccctggctggttggactgagggcttccccagagtaggcctgggtggggttgtcaggcagctaccagcgctttcccctcagagccggaggaggagaccgagcaacccacactggactacaatgaccagatcgagagggaggactatgaggactgtgagtagggtcctgccagccccacctgggtcggacccctggcctgggggatgtgccaatgggcccatcccagccttgggccccactctgagccagcctccccctcagttgagtacattcggcgccagaagcaacccaggccacccccaagcagaaggaggaggcccgagcgggtctggccagagccccctgaggagaaggccccggccccagccccggaggagaggattggtaggatggggggcaggagaggaggtgccatggccacggcgctctggccccctcctaacctccccgcctccccagagcctcctgtgaagcctctgctgcccccgctgccccctgactatggtgatggttacgtgatccccaactacgatgacagtgagtacccagcaccccagagtctgagggacataggcaggtgggggtcggggctggggtgtggtcaggagccagctggggcaactcacccaccttgcaaccccacctgtgcccgtggttacctcgctgtccctgctgtccctgcgtgcccaccccagccactgccctgtctcctctgccctcaggctggtctttccttggccgcttccctggttcctgcttggctgtgacccccacaggggtgtccctaggcacacactctgccctgtcacccatgtgggttccagccctcccagtcctgtgctctaactggcttcccgctggctcgtggccactgccccactctcttcagggagcccgagggcttttgcctccctgttgctcatgcccctgcgtccctggagccctcaggttccctttcctcctgggtggcagcccgtgcatcgccatttccctgcccccaggtccccatcagtgcctccaatgtctccccatctcaccccccagcccgcaaccccaggcacaggtgccagttgtccctccaggcctttcccatgccctgggcctcgagtcctttccccaggccagatgctcctggaaggccgggctggtgacttcagcagggtcttgctcagctgcccctgagctcgggctgctcctgactcctgcaagaccctctcccaactcagctgtcccccatctcccgtcctcctcccctctggcgcggtcctgtcctgctgagctcctgtggacccaggagctgaggccccgcagcagggtcagggcagcctcagctggctctccctccccatagtggactattactttgggcctcctccgccccagaagcccgatgctgagcgccagacagacgaagagaaggaggagctgagtgagtgggaccaaggacttcccacaccaggcctgccctgaaggccacctggggcctgcctgatccaccccacatggtcctcaaagcccagagccaggctgactggcccctcctaccttgcaccttccagagaaacccaaaaaggaggacagcagccccaaggaggagaccgacaagtgggcagtggagaagggcaaggaccacaaaggtgtgtggctggggcttggggcctgggtccctgtggggcagcatctggactcctgattgcctcccgggcccttggtgccatgtcctcccttcattgtccctagagccccgaaagggcgaggagttggaggaggagtggacgcctacggagaaagtcagtaagtggggggcacaagggggtgagggtgggggccacaggatgggggtgctgggacaagtgactggcccaatgtcacaaacaggacccaggtccccggaaccctttcctactcagattcttgggacccagaagggaggggccccgggagcccaggatagcctcgcttggctgccccagccctggaccccaggctggcctgcttcaggagggtggcagctccccagggcccctagtggctgggcgtggtagggggaggacctggggccttggtggggagtgaggacctcaggtaccttcacaggtatccctgcagggccattgtgcagacggtccccatctggatgacatctgtggctgcgccctgggggagctctacctgtgatttcacgtgtgtcccctgagagctgggcatggtcagcccgttctccagatggggcagctgaggcccagggaggggaagcacaggctgggattggaaacagctcctggcctggctttgagtcgattccaggtgggctggtgcagggcaccagggagccaccagctgaccagagctgccctctgactgtgcccccgatgtgccgggagtgggctctgggctccttggttctgggtttggtggagggaaggatggagctagtgagccaccattctggggtacgcgtcctcagagtgtccccccattgggatggagtcacaccgtattgaggacaaccagatccgagcctcctccatgctgcgccacggcctgggggcacagcgcggccggctcaacatgcaggtgggcattgggatgggcccatctcccaactgggataagggactcctccgcccatgctcagcctcccctgccccctggacagaccggtgccactgaggacgactactatgatggtgcgtggtgtgccgaggacgatgccaggacccagtggatagaggtggacaccaggaggactacccggttcacaggcgtcatcacccagggcagagactccagcatccagtgcgtggccaggctcatggatagttggcagaggggagtggctacataggcatggctctgtgtcccattaaggagattccagtgggcccttctttggcccagccaaagaaggccaaaaagatcagtgagggactcaccctgcccatccccactcctcagcctggtcagtcagcccctgtgtcctgatagcacatgagtttagggacagatcacctgcccatggctatgtgacgggcataggacccaggctcaacacctgggccgtgcagcaccaccctgctagctcttaaattcttggggctcggaagagggaggctcaggccacctgagggcctgggagggggaagacccttgctctgaccactgtccactccacagtgacgattttgtgaccaccttcttcgtgggcttcagcaatgacagccagacatgggtgatgtacaccaacggctatgaggaaatggtgggcaccatgcccaggctcttggctctgctcccattgtctgggcgaggggtgggctctcagaggggctggcagtactgctctgaggcctgcctctccccagacctttcatgggaacgtggacaaggacacacccgtgctgagtgagctcccagagccggtggtggctcgtttcatccgcatctacccactcacctggaatggcagcctgtgcatgcgcctggaggtgctggggtgctctgtggcccgtgagtgtggagggctggcaggggctctgagtggaggtggggtgctagggtgggccagccggcacccagctaaagacaaccccgcctcccttgcagctgtctacagctactacgcacagaatgaggtggtggccaccgatgacctggatttccggcaccacagctacaaggacatgcgccaggttgggagcatatatcctggggctgggggtgggacctgtctgtggctgacgggagtgtgtgcctggtgcttctgtcactgggcccagtccctactggttccagggatgctggctgtccctcaccttaggaaggaggccagtacctgggggctgcgtgaaggggtcatgcccgtccctcgccatagagcaggccctggaagtggaaggggcatggtcagcgggggacggattgcatgattgattccacgtcctccccctctgccccagctcatgaaggtggtgaacgaggagtgccccaccatcacccgcacttacagcctgggcaagagctcacgaggcctcaagatctatgccatggagatctcagacaaccctggggagcatgaactgggtgagggtctgtgggggccagcagctggcctctgctgctgatgtgcagagctcactgcctcccgcctgttccggagcctctctggggattctggcttgtcttacagggccctaggagccccagctgtcccccagaccctcgggtatgaggtgggtctgggtccttcctcagctgccctgggcctcgggagactgagtgctcactgaggctcccgcccttgcaggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatggtgggttgaagggtgaggctggccagggtccaggcagctgggggttgtgggggtgtgggtagccgatgcctaccctgctggctccccacagggctcagagtttgggaactgggcgctgggactgtggactgaggagggctttgacatctttgaagatttcccggatctcaactctgtgctctggggagctgaggagaggaaatgggtcccctaccgggtccccaacaataacttgcccatccctgaacgctacctttcgccagatgccacggtgaggctacagcctggctgaaagggcaggagggagcagctggaccctggggtcctggtgttctgggcttgggggtggggctgacggtgcctgaactccagacgctgaggctctgggggttgggggacaggggatcgtgcgagtactggtgtgaagcttcatggagggtgatcgggctaggttggggatagtggccggagctgcagccctggcctcacacgtgctggccactccaggtatccacggaggtccgggccatcattgcctggatggagaagaaccccttcgtgctgggagcaaatctgaacggcggcgagcggctagtatcctacccctacgatatggcccgcacgcctacccaggagcagctgctggccgcagccatggcagcagcccggggggaggatgaggacgaggtctccgaggcccaggagactccagaccacgccatcttccggtggcttgccatctccttcgcctccgcacacctcaccttgaccgagccctaccgcggaggctgccaagcccaggactacaccggcggcatgggcatcgtcaacggggccaagtggaacccccggaccgggagtgagtcagcctgggaggggctgtgggcggggcctggtccggagaggggctgactttgggtctgtatctgtccccggccagctatcaatgacttcagttacctgcataccaactgcctggagctctccttctacctgggctgtgacaagttccctcatgagagtgagctgccccgcgagtgggagaacaacaaggaggcgctgctcaccttcatggagcaggtggggtggctagggcaatgcctggggagaggaggctgcacaggctcctggatgggcgggagggagcagcggaccacattggaccttcctgaggaccagcagccctcacctgcttccctaggtgcaccgcggcattaagggggtggtgacggacgagcaaggcatccccattgccaacgccaccatctctgtgagtggcattaatcacggcgtgaagacaggtacctagtgtgcacacctttaccccatctttctgagggaggacccgccagagagggtgggggcttgaggaactcagcgagcaggtagagtctggggagcctgggggcgaaattcagagagggagggcggtgctgggggcgggaactcagagggggagggcggggctgggggcaggactgagtgggagggtgggggcctgggaggggcgctctggggcagccggatcgttctccctccgcagccagtggtggtgattactggcgaatcttgaacccgggtgagtaccgcgtgacagcccacgcggagggctacaccccgagcgccaagacctgcaatgttgactatgacatcggggccactcagtgcaacttcatcctggctcgctccaactggaagcgcatccgggagatcatggccatgaacgggaaccggcctatcccacacatagacccatcgcgccctatgaccccccaacagcgacgcctgcagcagcgacgcctacaacaccgcctgcggcttcgggcacagatgcggctgcggcgcctcaacgccaccaccaccctaggcccccacactgtgcctcccacgctgccccctgcccctgccaccaccctgagcactaccatagagccctggggcctcataccgccaaccaccgctggctgggaggagtcggagactgagacctacacagaggtggtgacagagtttgggaccgaggtggagcccgagtttgggaccaaggtggagcccgagtttgagacccagttggagcctgagtttgagacccagctggaacccgagtttgaggaagaggaggaggaggagaaagaggaggagatagccactggccaggcattccccttcacaacagtagagacctacacagtgaactttggggacttctgagatcagcgtcctaccaagaccccagcccaactcaagctacagcagcagcacttcccaagcctgctgaccacagtcacatcacccatcagcacatggaaggcccctggtatggacactgaaaggaagggctggtcctgcccctttgagggggtgcaaacatgactgggacctaagagccagaggctgtgtagaggctcctgctccacctgccagtctcgtaagagatggggttgctgcagtgttggagtaggggcagagggagggagccaaggtcactccaataaaacaagctcatggc

SEQ ID NO: 35984 - DNA, 10962 bp, Homo sapiens
gccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaaggtgtggccatgggggcggggtccggaggggcggggcgaagaaattggggggttcccggaagggggaggctgggaggggccggggagtgactgggcgggcccggaggtgatcccaggctgcggaggctggggacccggtcgcggcggggcgggtccggagagaactcgagagtgcagagatgagggccgggtccagcgaaaaatccgacggtccagagggcgggggcaagaggcgaggggctggattgcggccccgtgcgtcctgactggggggtcttttggaggaaaagggacgtggcgatggtcattgatgcaaggggcggggcctccgtggcctccttcttctcaccctgcctcctcctcacagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtgaggactctctatctgggacactcccccaccccacctttcatttggttattcaacagacacttgctgggctttgccctcagtcatacccgagataggtcctgccttcgtggagcctccagtgcagcctgacgagagacagacccatcattagacagggacagcctagagtggtctgggctgggatcaggaaatcccaggggactggagccaccaagaagaggtgcctgactccacctgggagaatcagagagggcttcctggaggaagggatgtctgagctgagggatgaggaaagggtgacttaagagaaagaggtggaaaggagggagcagggtgtacagaggcctagaatgtgaggtaggtcacagtgagcgaccaggctggacagcttgggagaaaccagaacacaggatctctttgtgcatccactcagtacatcctttctgtctttttttgagacagagtctcactctgtcacccaacctggaatggagtgcagtggcactatcgggctcactgcagccttcacctcctgggttcaagtgatccttgtgccccagcctcccgagtagctgggattacaggtgcccacccagctaatttttgtatttttagtagagatgggtttttgccatgttggccaggctggtctggaactcctgacctcaagtgatcagctcaccttggcctactaaagtgctgggattacaggcgtgagccaccaagcccagcccctttctgtccttattccctcccgacctcactcagtctgtagcagccacattgctccttgcacagtccaggtgagctcggcctctggatcctgggcctgaatggttcttttgtcatatgcctgcgtgcctcacccttccttcctgtcttaatttaaagtgtcagtattctagtgaagtcttcaccggcctcagtgttaacgtttacctcattcctttccccttctttgctttattttagatttttgtgtttacaagtaattctcctctgacacactctggatttctctcatctggtttatttactctctgtctccctggattcgagtgccctgagggtggaaattttgatcactataattcactactgtgtccccagtacttggaatagtgcctgggacagggaggatagtccgtgaatcgttttttgttttgttttgttcgagacagagttttgcccttgttccccaggccggaatgcagtggtgtgatctcagctcactgcaacctctgtctcctgggttcaagctattctcctgcctcagcctcccaagtagctgggattacaggtgtgcaccaccacgcctggctaattttgtaattttgtattttaagtagagttggggtttcaccatgttggccaggctggtcttgaactcctgacctcaagtgatctgcccacctcagcctcgcaaagtgctgggattacaggcatgagccaccacgcccagccctgtgaatcattgttgaatgatgaattgaatccataaagtaagaccacaaggataatgtaattatccccattttgcagaagagaaaatttagcttcagggtggagtttatttatttattttttattttttttgagacagagtcttgctctgtctcccaggctggcgtgcagtggcatgatctcggctcactgcaacctccgcctccccggttcaagcgattctcctgcctcagcctcccgagtaggtgggattacagatgcccgccactacaccagggtaatttttgtatttttagtagagacggggtttcaccatgttagtcagactggtctcgaactcctgacctcaggtaatccgcccacctcggcctcccaaagtgctgggattacaggcatgagccaccgcacccggcccagaatctactttcttaaggatgaactgtcagtagcattttggccccagtctacatgactctagagagaactgcttcttttttctctcgttgattaactgttcattccccatctgtgttgtgccaggggtttcattatgactgcatctgagaagttctagtgtatgaggcagatgttggctaaatggccagaggactgaatgtgaagggtcaggggagacaagggttgtgtaggagatcatgaagctgggagaccctatcctggggtacctgatgcatcagtgacgtctgggaggacatcctggaggtggtgctgctggagcagagacgagaagaataaaaagaattggtcgggcatggtggttcacgcctgtaatcccagtgccttgggaggctgaggtggacagatcacttaaggtcaggagttcgagacggtgaaaccccgtctctcctaaaaatacagaaattagctgggcgtggtggcagatgcctgtaatcctagctactcaggaggctgaggcaggaggatcacttgaacccaggagctggaagttgcagtgagctgagatcacaccactgcactccagtttggatgatagagtgagatcctatctttaaaaaaaaaaaaaaaaaaaaggttaactgaagatggggaaggggtgccctaggagtggggcacaacccagcaaacactccaaggtgggagggagcgcggtggggattaagacaggccacttctgtggccaaacactgtggaagctggggaggaccctgacctggctcaggtgttcacaggccccctctggctgtgtgtggggaacaggtggtggaggacaggaagagtagggagaccaggaaggggctgctgtgagagtcctgatgaggggacgaggtctggagctgtgggtcaggcctctgctgggtgcacaggactgagcctttgggccaccctgggcagctgaagctaaggggtgcgggtgttcataggcacctcataggcagtggcatctttgagcaggtttcataacaggcggttcaggtacacacagacctcccaggccactcaaggaaggtgttccagagtggagccactggggaatttttacattttctaaaattctttttctctttataaatatcacccatattcattgtttaaaataacagaacttcaaatttgtgaaaattctcaacagaaattctcagtgacgcttcatccggaggtaaaggccattcctattttgccatgttagcccagtggcttaggccagacacctcagggtgttccttgggcccgctctctccctcacccccacatccactctcatcaaatcctctcggctccacctacaaaaacttccctgaccctggtccagcctccatccttcccccaacctcgccatcccggcagcttcctccctggcctccccgctccccatctcagccagagggagcctgggaccacctgagtcaggccagggccctcctagctcagagccctgccctggtggcacttcgctccagataaaaaccaaagtctaggccaggtgcggtggatcgtgcctgtaatcccacccagtacattgggaggctgaggtgggaagatcacttgaggtcaggagttctagaccagcctgaccagcatggcaaaatgtcgtctctacttaaaaatacaaaaattagccgggtgtggtggtgtgtgcctatagtttcagctgcccgggaggctgaggcaggagaatcacttgaatttgcagtgaggcagaggtttccgtgagctgagatcacaccaccacactccagcctgggtgacagagcgagactccgtcaaaaaaaaaaaaaaaacccaaagtctccagcagtcccttgtgtcttccactctccctctggctcgctccaccccacccgcaccacccactctagagcgtgaaggacatttctacctctggccgtctgcacctgccgttcttgctcatctttccagccttggctgaaacatcccctcttttgggaagcctaccctcccatgctccttaagcctcttccctgtcatatttttctccatagccatcctccagtgtttcataggtacctgttcctttgtttgtggttggccttctccctgcacaatgagcacagcctgagggcagagtgcgtctgtgtttacactgagtccccagcatgaggcccagctgggcccctgggagctcggaaaccaatgaatgaatgaatagtgggggcagaacaggaagagatgctctggggcctgaggttggggccagcttaggagagtcccagaggcccatcgaggagatgcgctgtgcacagggctgtgggcaaggcctgagctctgccggttggactctgtgactttggggcccttggcgatgttgatgccagcaagcggggaacttctggggacagaggcagcctctgggagcttggatgggggtgaggaaggggaggtggccagtgtacgtagctacttctcccttccgctgggctcaggagagaagagaaggctgcagtacaggcgagggagggagatgcgtttttcccagatggagacactgaagtccctgcacccagcacccaggcctccctggccagaccctgatccccacggagcccctcccctcacacaggtcattgaccacagtggcgcccgccttggtgagtatgaggacgtgtcccgggtggagaagtacacgatctcacaagaagcctacgaccagaggcaaggtacgggcaggtgggcgtcgaggggtgcgtgggggccagagggagtatgtgcaggtatgagggcgggcaggttagacagggcccctgcagggaggccagtggtgtagacggggggccgagagcttgggaggatataggggtgaggctgggagtggggacagacggaggcctggggtgggaatgagggccgggaggtgtcaggggtatgggcagtcagacgtggtcgggggagggctgggaaagtggagggagttgaggggtaggtgtgggggctgggtgttgtcagggtcagatgggggcatggggcggtcggacggggtgtggagggcaggacaggtggaatgcgagtggacagggtggcggtcagtgagggcgcctgggacggatcgagtgttgggggagaccgggggcctcagggccggaggagggcggaggaggaaggcggatgatgaaggcagatgtgcgctgaaggggtgagagaccatgggtcctgtagtgaggggtgcaggcggcaccccttccatttacgattgtggagttggggggcctaggagtcctgggagaggctaaggctgtggtgggagacctggggcttgggtgacagccctttgtcacctggaagagagagttcctccgtgaacgtgggcccctcgtgggtggagcgtcatcctgttaggcccggccgacaccccaactgaccccagccccctctgcccacagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtgcgtggctcgcgggcccggtcccgggctccagggctccaaggccgggaggaaatgttgggggcacagtggagcctcggagaccacgctctgcctaggggcgcggggttgggggggactcgaaacgatctcagtccctggaggtgacggaaccatctgccgacactgacggcccagagtgtttgtggagggaagtgggaggcgcaggcggagtgatctgtccagcgagggaggaagcagaagccagaggcacgcggcctgtgcgcttcgaagcgtggggcagtgtcagtcgcggtggggaaacgggcggcgtgaccaaggcaggagtgagggaacacagggggctgtgtgagcccagaggaagcacctggaggctgggagcatctgaaggaaaggaggcagcagccaggtgaaaagggaggaagagttcccgccagaaggagtagcgggtgcaggtgagcagagcgcaggaggtccacctggggaaggggagcgggaggagaggggagaagtgtagtcaggggcatgggcagggcggcgtcacagtggagagcagtgtggatttttttaaaaagaacaggctaggcatgatggctcacgcctgtaaactcagcactttgggagaacaaggtgggaggcttgcttgagccccggagttggaggttacagtgagctatgattgtgtcattgcaccctagcctgggcagcagagaaagacccagtctcaaaaaaaaggctgggtgcagtggctcacacctgtaatcccagcactttgggaggctgagacaggaggatcacttgaacccaggaatttgagaccagcctgggcaacataatgagaccctgtctctacaaaaaaaaaaaaaaaaaaatcccacaaaacttttgtcagttgtggtggtgagcacctataggtgccccagctacttgggaggctgaggtgggaggatggcttgagcccgggagttgaggctgcagtgagctatgatcgcaccactgcactgcagcctgggtgacagagggagaccctgtctccaaaaaaaaaaaaaaaaaaagatacacggggtacatatatgtattgttacatgggtgtgttgcctgctagtgggtggggaccgggcttctagtgtacccatgacccaaattgtgaacatcgtacccaacagataatttttcaaccctcaccaccctcctgtttctggcatccccactgtctggtatttccgtctttatgcctgtgtgtacccatcccccagtcgtcttcagccactaatttacgtctgtctctaatttgccgattctggatgtttcataggaataggatcatgcagtctgtggccttttgtaactggcgccttccactgagcagaatgctttcaagtttcatccgtggcatgcctgtgtcagtgccacactgttgccaaatagtcctgcattgagcgcctagaccacagtgtatccagtcaccagttagtggacattagggtcatttccactttttggctattatgaataatgctgctatgaaccttcttcttttttttttttttttttttctaatttgagacagcatctggctattgcccaggctggaatgcagtggcacaatctcggccatttcagccttaacctcttgggctcaagccatcctcccacctcggcctcctgagtagctgggaatacaggtactcatcaccacccccggctaaagttttgtggttttttttgtaggatgggatttcgccatgtggcccaggctggtctcaaactcttcccgctcaagtgatcgtcctgcttcagcctcccaaagtgctgggattacaggtgtgagccaccatgctaggcctgaacattcttttataaatttctgtgtggctgggcatggtggctcatgcctgtaattccagcactttgggaggccaaggtgggcagatcacctgagatcaggaattttgagaccagcctggccaacatggtgaaaccccatctctactaaaaattcaaaaattaactgggcgtggtggcgggtgcctgtgatcgcagctacccggaaggctgaggcaggagaatcgcttgagcctgggaggcggaggttgcagtgagccaagatcacaccactgcactccagcctgggcaaccatgcaagactccatctcaaaaaataaaaaatacatttttatgtggacatttgttttcatttctctgtgcctaggagtggaatccctgggccacatggtaacactgtgcttgacttttttgaggacctgccacactgcttcccacagccgctgcagcagttttcattcccgccagcagtgcagaagggtcccattttgtcctcatcctcaccagcactttagtctgtcttttgcttacagtcatccactgggtgtgaagtggaacatcatcatggttttgatttgcacttctttggcagctaatgatgttgagcatctttgcatggccatttgtgtatcttctttggagaaatgtctattcagatcctttgccttttgttttttgacacacagtctcactccgtcacccaggctggagtgcagtggtgctctcagctcactgcatcctctgcctcccgggttcaagcaattctcatgcctcagcctcccgagtagctgggattataggtgagcgctacaacacctggctaatttctgtatttttagtagagacagggttttgccatgttggccaggctggtctcaaactcctggcctcaagtgatccacctgagctggtggatctcccaaagtgctaggattacaaacatgagccactgcgcccatcggtatgtcggggtttggttttgttttttttcttttgagacgtaatctcgctttgtgcccaggctggaatacagtggcatgatctcagctcgctcgttccaacctccgcctcccgggttcaaacggttctcctgcctcagcctcccgagtagctggaactacaggcgcccgccaccacacccggctaattttttgtatttttagtagagacggggcttcaccgtgttagccaggatggtctcgatctcctgacctcgtgatccaccctcctcagcctactaaagtgctgggattacaggcgtgagccaccgcacccggccagtatgtcatcttttgagaagtgtgtgttcatgtcctttggccatgatcgtggctcactgcagcctcaacttcctgttgcccactttgtaatgggattttttttttgcaaagtgggtgttctttgagttccttgtatattcttctgctcagtttttcattgggatgctgtcttttgtcgctgagttgtgtattagtttgctaacaaagtaccactcactgagcaacttaaagttatttctcacagtaatggaggctagaagttcaagatcaagctgtcagcaggttggatttattctgaagcctctctctctggcaaggcagtagtgccatcccccttaggtttttacaaagccctcactggctggtgtcttcacccagtgaatgggggacaggggtggaagcagggacaccagtgaagtggctaccatattagtcccggcaggagctggaggtggtcctagtggtagcaatagaggtagcaagaaatggttttcaccaagacaggcttctactcaatgggtaggcatggatccagggtgatcctgaaatttcatggggatttcttctatgtccagaagcttcacagggatttctcttctgttggcaggtctcacagatttcaagcctggctactggattggtgtccgctatgatgagccactggggaaaaatgatggcaggtaacaagaattcccactcaggtgtctgtgtgtgcatttgtgtgtaagtccatgcgtgctgcttgctgagctgcccatgccagcttctagagtggagccatgtgagggtcctctgaccacacccacccctatcctttcctgcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccagaaagt

SEQ ID NO: 35985 - DNA, 53052 bp, Homo sapiens
atggacagccagaagctggctggtgaggataaagattcagaaccggcaggtgagtaggacaaattgtttgtttgcttttagatttcattggcaaccttacatttctggtcctggcacaaggacatgagctaagtctatgtagcagataagtaatggaacaactttgttctttgggacaacagttgaaatatcatcactctgatccactcaggttttggataatctcatgcgtctggtgagtggactttgtgttaaatagggatgatggctgacacatgctgtttgtctgtttattcagctgatggacctgcagcttctgaggacccaagtgccactgagtcagacctgcccaacccacatgtgggagaggtctctgtccttagttctgggagtcccaggcttcaggagactcctcaggactgcaggtagcttgtttgagggcacatgaggatttgagagtctagggctttcaaggaagagaatttaggaaaatgagtgttggggaagcatgggcatgccagatcatggggttgctgggggcctggcgtggtactgatgcttgtgtgtccacagtgggggtccggtgcggcgttgtgctctctgtaactgcggggagcccagtctacacgggcagcgggagctacggcgctttgagttgccatttgattggccccggtgtccagtggtgtcccctggggggagcccagggcccaatgaggcagtgctgcccagtgaggacctatcacagattggtttccctgagggccttacacctgcccacctaggagaacctggaggtgagtgaggagaatggggcaggaaatgggataagggctgggtagtcctgagccagcaatcctctttttgttaattctttcctttctctttacctcttcccacctgtaaagggtcctgctgggctcaccattggtgtgctgcatggtcggcaggcgtatgggggcaggagggcccagaactatgtggtgtggacaaggccatcttctcagggatctcacaggtggggctgggccaggggattgcataggtgaagggcagggctggtgggcttctgagagtcaggttggaatgagaaggaccatgggtatactggggcagagctagtgcctgaactgtttgtctggggagagctggctgacactgaggctcttttttcaccctggcagcgctgctcccactgcaccaggctcggtgcctccatcccttgccgctcacctggatgtccacggctttaccacttcccctgcgcgactgccagcggttccttcctatccatgaaaacactgcagctgctatgcccagagcacagtgagggggctgcatatctgggtgagaagtcctgatctttggtcatagggcaaatgagagaccaaatgtgccttggatttttgtactctacagagcactgatcaaagtatagcattatttactgttggtctgccccactaaaataggtgtgaactttgtgagcaccagggttttgcctgtctcatttatcattttgtctccagtgcctagaacagtagctggcagacgttgggcaggcactcagtaactttgttgtttgttcattctgtgcccatggagtgcctgttttgtgtacagcaatgtgctgaggcttacaaggaatccatagctgacctgtggtgtctctaccccctgcagaggaggctcgctgtgcagtgtgtgaggggccaggggagttgtgtgacctgttcttctgtaccagctgtgggcatcactatcacggggcctgcctggacactgctctgactgcccgcaaacgtgctggctggcagtgccctgaatgcaaagtgtgccaagcctgcaggtaggaatggaagggcaggaggaaagtcttaggcacaacacaggttagggttgaaaatgagggcagtcggagaaggcctgttaacatgaaaacaacaaaaaagaaaggaaatgagggcagagaggacactgtaatgttccatgtgcacctgcaggaaacctgggaatgactctaagatgttggtttgtgagacgtgtgacaaaggataccatactttctgcctaaaaccacccatggaggaactgcctgctcactcttggaagtgcaaggtgagtgtaccctgattctgccctattgtccctaactgtgtctgctacagcattctctgtcttgacaagttgtgtactttcgtttagtctttgctgtctgaccaatgcctgttttgcccactcccttcccttaggcgtgccgggtgtgccgggcctgtggggcgggctcagcagaactgaatcccaactcggagtggtttgagaactactctctctgtcaccgctgtcacaaagcccagggaggtcagactatccgctccgttgctgagcagcataccccggtgtgtagcaggtaagtggtggggactgactgagattgggctggcaggttggaagaactgacattggcaggggccttgttaaattgagtggactttgagaggagagccctaaggtgggcagtgccatccacagcattcgtgcctccccccagtgtgctctctaggatttgttagctggtgagagccacagtgcctgctcccctgtaccctctgcagattttcacccccagagcctggcgatacccccactgacgagcccgatgctctgtacgttgcatgccaagggcagccaaagggtgggcacgtgacctctatgcaacccaaggaaccagggcccctgcaatgtgaagccaaaccactaggtgagtagggtttgagggtccctgaaattcatccccttttattctatggcaagagacagtttgtgcattgccccagaccccacactttctgtggagtagatctgagctagataggagcatcgtgttgttgtgtctgcagggaaagcaggggtccaacttgagccccagttggaggcccccctaaacgaggagatgccactgctgcccccacctgaggagtcacccctgtccccaccacctgaggaatcacccacgtccccaccacctgaggcatcacgcctgtcaccaccacctgaggaattgcccgcatccccacttcctgaggcattgcacctgtcccggccgctggaggaatcgcccctctctccgccgcctgaggagtctcctctgtctcccccacctgaatcatcacctttttctccactggaggagtcgcccttgtctccaccggaagagtcacccccatctcctgcacttgagacgcctctatccccaccacctgaagcatcgcccctgtccccaccatttgaagaatctcctttgtccccgccacctgaggaattgcccacttccccgccacctgaagcatctcgcctgtctccaccacctgaggagtcacccatgtcccctccacctgaagagtcacccatgtctccaccaccggaggcatctcgtctgttcccaccatttgaagagtctcctctgtcccctccacctgaggagtctcccctttccccaccacctgaggcatcacgcctgtccccaccacctgaggactcgcctatgtccccaccacctgaagaatcacctatgtcccccccacctgaggtatcgcgcctatcccccctgcctgtggtgtcacgcctgtctccaccgcctgaggaatctcccttgtccccaccgcctgaggagtctcccacgtcccctccacctgaggcttcacgcctctccccaccacctgaggactcccccacatccccaccacctgaggactcacctgcttccccaccaccggaggactcgctcatgtccctgccgctggaggagtcacccctgttgccactacctgaggagccgcaactctgcccccggtccgaggggccgcacctgtcaccccggcctgaggagccgcacctgtccccccggcctgaggagccacacctatctccgcaggctgaggagccacacctgtccccccagcctgaggagccatgcctatgcgctgtgcctgaggagccacacttgtccccccaggctgagggaccacatctgtcccctcagcctgaggaattgcacctgtccccccagactgaggagccgcacctgtctcctgtgcctgaggagccatgcttgtccccccaacctgaggaatcacacctgtccccccagtctgaggagccatgcctgtccccccggcctgaggaatcgcatctgtcccctgagcttgagaagccacccctgtcccctcggcctgaaaagccccctgaggagccaggccaatgccctgcacctgaggagctgcccttgttccctccccctggggaaccatccttatctcccttgcttggagagccagccctgtctgagcctggggaaccacctctgtcccctctgcccgaggagctgccgttgtccccatctggggagccatccttgtcgcctcagctgatgccaccaggtaaggggatgttagtactctgttattctggaacagctgtaactcttcatggcacatctaatctaagagcccttcttttttctctttccttccagatccccttcctcctccactctcacccatcatcacagctgcggccccaccggccctgtctcctttgggggagttagagtacccctttggtgccaaaggggacagtgaccctgagtcaccgttggctgcccccatcctggagacacccatcagccctccaccagaagctaactgcactgaccctgagcctgtcccccctatgatccttcccccatctccaggctccccagtggggccggcttctcccatcctgatggagccccttcctcctcagtgttcgccactccttcagcattccctggttccccaaaactcccctccttcccagtgctctcctcctgccctaccactgtccgttccctccccgttgagtcccatagggaaggtagtgggggtctcagatgaggctgagctgcacgagatggagactgagaaagtttcagaacctgaatgcccagccttggaacccagtgccaccagtcctctcccttccccaatgggggacctttcctgccccgcccccagccctgccccagccctggatgacttctctggcctaggggaagacacagcccctctggatgggattgatgctccgggttcacagccagagcctggacagacccctggcagtttggctagtgaacttaaaggctcccctgtgctcctggaccccgaggagctggcccctgtgacccctatggaggtctaccccgaatgcaagcagacagcagggcagggctcaccatgtgaagaacaggaagagccacgtgcaccggtggcccccacaccacccactctcatcaaatccgacatcgttaacgagatctctaatctgagccagggtgatgccagtgccagttttcctggctcagagcccctcctgggctctccagacccggaggggggtggctccctgtccatggagttgggggtctctacggatgttagtccagcccgagatgagggctccctacggctctgtactgactcactgccagagactgatgactcactattgtgcgatgctgggacagctatcagcggaggcaaagctgagggggagaaggggcggcggcgcagctccccagcccgttcccgcatcaaacaggtgaggggctatctagctgcgggatgtgattagagttagcccactgtcagaggtacagtcctgtgtcactgatactttcccaccttgctttgtgaatcctagacttggagatcctttattccagttattaaggagaaaatactaatacgtagaagggacaagtaacttgcccagattcatggttactcagtaatagaattgggaccagaaacttggttctttcaagccattgttttttctccttgcccatctcaaccactcttgggaggggaagaatgggtttgggctagagctatgcgcttgttgatatctgggagtttggccttttcccttgccctgagtgggactcctgggcttattacctgtcttactctgtccgtttgtcacttcttctgttcaagtgtgtaaacccaacacactagcccttgacatgctcctgtcattgtccccttctttcactcagggtcgcagcagcagtttcccaggaagacgccggcctcgtggaggagcccatggaggacgtggtagaggacgggcccggctaaagtcaactgcttcttccattgagactctggtagtaaggagatgcctcctattcctcccatcccccaaccatgctttagcaccctctgagtcctgccagtcccttgcatgcttgcctacctgcctgctcgtctagggcctgtctggctatgtctgaattcctgtccacttggcccgcaggtttttctgaaatctctgctatcagactgaggctcaatttgggagctggggtgttctgtctgttattcctggcttttggccttcatcttaaccaagggttcacactttcttcccccaacaccaaagaggaaagtagcttggtgggggcagatttatctgcctcactttccataactctctgcccatcaggttgctgacattgatagctctcccagtaaggaggaggaggaagaagatgatgacaccatgcagaataccgtggttctcttctccaacacagacaaatttgtcctaatgcaggtaccatacagtgagacctggcacactgaacattgtgtatgtgtgtgtttggtgagaggatagatgggaaaactggacctactttggggatacccagctaatgagaaaacagaccatgaattctaatcatgttattcattggtttgtccatccatcacatttctcttgagtatctcttctgagcttggcactaagctaggagctagagaaatagcagtgaaaaagtctttgccttattgaactttatagcttagggaacttacatgtgtcctcacttgaataatcttgaagctgatagaattttgtcacatatgtgattctcacctgaccagtctttactccatcttatcttcctttaatttcttcttaacttcacccatgtcaggctttataaattcaagtgacctgattaggtgagtaaggcatcctaggaaggagcagggtcccttggtagcttacagcatcctaacgctgtgggatggggttcctgactctggtcgcaaatcagtgttgtagcgtcatagtagactggatctgagtgggatggggagatctagttggacatttgggtttctctgtgtttccccaggacatgtgtgtggtatgtggcagctttggccggggggcagagggccacctccttgcctgttcgcagtgctctcagtgctatcacccttactgtgtcaacagcaaggtgagttcagggcccaagaggtgtaggctggggaatagggtcagttatttcttaccctagttccttgtcctggccataccacctcttaaagcggccatcggtcatggttgttcattagtcaccagtggttatcaaacttttcttggggaaaagtactttggaactcaacggtggacttgatagtttctttgtggtaggccctgacttgctggtataattcagtccatcgtaaaaaataacaacatggctgggcatggtggctcccacctgtaatcccagcactttgggaggcctaggtgggtggatcacctgagattaggagttcaggaccatcgtggtcaacatggtgaaaccccgtctcttctaaaaaataacaaaaattagctgagtgtggtagcgcgtgcctgtaatctcagcaactcgggaggctgaggcaggagaattgcttgaacccaggaggcggaggttgcagtgagccgagatcacgccactgtactccactccagcctgggcaacagagtgagatccgtctcaaaaaaaaaaaaaaaaaaaaaaaaaggaaaaactgggggacctaattcggtccacagtctctttttaggggcttggctagtggaaagattgctattctattcacaatgaggcagtggctagtgcagctcttctctgatcagcagagatcattgggagcctaagtttagagtcactgttttggggacaagggtgctctgcctaagtctctgtgtgctcaaatggaggcctagtctctgcattgggctgcctccagcctcacccttagaagttccacctcctaggctgggcacggtggcgcacacctgtaatcccagcactttacttcgggagggtgaggcgggtggatcacctaaggtcaggagttggtgaccagcctgactaacatggtgaaactctgactctactaaatacaaaaaaattagccaggtgtggtggcaggtgcctgtaatctcagctacttgggaggctgagacaagagaatcacttgtacctgagaggcagaggttgcagtgagccgagatcgcgccattgcactccagcctggggaacaagagcaaaactccatctccaaaaaaaaataaaaagaagttctacctcttttccacctcacaccctgagaagttcccatcttctgccccagatcaccaaggtgatgctgctcaagggctggcgttgtgtggagtgtattgtgtgtgaggtgtgtggccaggcctccgacccctcacgcctgctgctctgtgatgactgtgatattagctaccacacatactgcctggaccccccactgctcaccgtccccaagggcggctggaagtgcaagtggtaaggagactgggatcttcagtggagccctggggccttgagatgttaaagtggatatgatgttgagtatgtgacagaggctgggtttaggaggccaggctggtggcttgggtttccggtgaggggacttctgggtacttcgggtaggttgggtgctaaagctctgttttcctgctcctatcaggtgtgtgtcctgtatgcagtgtggggctgcttcccctggcttccactgtgaatggcagaatagttacacacactgtgggccctgtgccagcctggtgacctgccctatctgtcatgctccttacgtagaagaggacctactaatccagtgccgccactgtgaacggtgagaacatccctttctcctcactttggccctgttgccagcctcgcattgcctgagcttatttcctccagtctctgttctccaggtggatgcatgcaggctgtgagagcctcttcacagaggacgatgtggagcaggcagccgatgaaggctttgactgtgtctcctgccagccctacgtggtaaagcctgtgggtgagtaccagctgctgggtagggggaggagtcagagcaggggtaccttgctttgggacaggacctcagccacctccgtttgtccttctctccatagcgcctgttgcacctccagagctggtgcccatgaaggtgaaagagccaggtgagtcacagaaattttgaatgccaaagccagaccagacgtcggacatcatctagtctagctccaaccccctagcttcatctccttattttaagaggaggaaactcagacccagagaagttaagtggcctgcccaaggtcacctagtaagttagtggcaaagttatgcctagaaccaaggtctccagcttcccgggcaatgttcctttcatcaggcaccatggtctcttcactgctaggatttcgtcttcagatctcttttttttttttttttttgagatggagtcttgctctgttgcccaggctggagtgcagtggcacaagcttggcacattgcaagctttgcctcccgggttcacgccattctcctgcctcagcctcctgagtagctgggactacaggtgcccgccaccacgcccggctaattttttgtattttttagtagagatggggtttcaccgtgttagccaggatggtctcgatctccggacctcgtgatctgccagcctcggcctcccaaagggctgggattacaagcatgagcaccgcgcccggctgagaacataactctttttcctaagtgaaaggggccagggacatctccatcgtgatatggcactgctgctggcatctaggacactgtgtgctggcattcagcaagtaggggccctcatagccccagacagcaagagaatctatttagtgaacctagggttaatcatgagcaaaggcaggcttctgagttacagttcctctctgaatctccctgggtcactgacagagaactcgggcctcagccagtgccccttggtggcctgttctcctcagcatttagaccctaagctggacttttgtcactgcctttgtctcagctaaggacataggttgaaacttgcagttctggtttccctggggcttccatccagggatcacatactctttcctcttatgcagagccccagtactttcgcttcgaaggtgtgtggctgacagaaactggcatggccttgctgcgtaacctgaccatgtcaccactgcacaagcggcgccaacggcgaggacggcttggcctcccaggcgaggcaggattggagggttctgagccctcagatgcccttggccctgatgacaagaaggatggggacctggacaccgatgagctgctcaagggtgaaggttagcttggggaatcttagggagcggcagagtagggggagcgtgactctgggagtgggatgttgggtgggggctacattgccactcagttacccttaagcactgctgtctcgtctaagtggctctgaggcaaggtattcagctctctcagtggcaggatgacaaggttaaaagggcctatagttctgatttgcctccatctcttctgtcaccatacgcaggtggtgtggagcacatggagtgcgaaattaaactggagggccccgtcagccctgatgtggagcctggcaaagaggagaccgaggaaagcaaaaaacgcaagcgtaaaccatatcggcctggtgaggtcctgggatggggttgtggggtggtggggtggtgcggggcagctcaataggtcccccagcggcttctcatccacaactctgcctcctcataggcattggtggtttcatggtgcgacagcggaaatcccacacacgcacgaaaaaggggcctgctgcacaggcggaggtgttgagtggggatgggcagcccgacgagggtgagacgggtgagggcaccagtggggcctgggagaaggtggggcaatgctagagagacccagggggtggactcattgaaagggccaagagggtggtagacccagctggtgttgtgggagagagtaggcacaaagtgtcaccctgcaagttgggagcagcatgctctcaacccgagtctgacacttccgttctgtccacagtgatacctgctgacctgcctgcagagggcgccgtggagcagagcttagctgaaggggatgagaagaagaagcaacagcggcgagggcgcaagaagagcaaactggaggacatgttccctgcttacttgcaggtgggtctcaggctccaagcagtgagggaggtgtctgtgccctgcagggcatgaagaaaactgtttctccttgactgccccacaggaagccttctttgggaaggagctgctggacctgagccgtaaggccctttttgcagttggggtgggccggccaagctttggactagggaccccaaaagccaagggagatggaggctcagaaaggaaggaactccccacatcgcagaaaggttagttatgtgggagtgagtggtgtgagagaatccaactttcttctggcttaggagctggcaagttatttgatgggaaatggactggcctccaggagtcaagggtggggtcaagggtcctggcctgtagggctgtgggactggagacctgttctgggcatcagatgtaggacatctctgattggaggggggactcttgctcataggagatgatggtccagatattgcagatgaagaatcccgtggcctcgagggcaaagccgatacaccaggtgagggctgccggggttactgtgtcctgtcttggccttgcttgcctctgtccctctgctgtgcccctgagcattgtcagtgttggaggctggaaactgtcccatggccctctgtggttcagagtggccatgacccatcctggccttgacccatgggtttctcctggcatttacaggacctgaggatgggggcgtgaaggcatccccagtgcccagtgaccctgagaagccaggcaccccaggtgaagggatgcttagctctgacttagacaggatttccacagaaggtgaggctgtgacccgtacctctttgtgtataagggttttctatgggagaaggaggaggtcctatctttgggactgtgatctgtacagcttctctggtggggagtcctggactgttcctggccatgatcatttgtagacctgtggtgtcacctgaacttcccagtcttcctcaacagtgtccttcattcccccacagaactgcccaagatggaatccaaggacctgcagcagctcttcaaggatgttctgggctctgaacgagaacagcatctgggttgtggaacccctggcctagaaggcagccgtacgccactgcagaggccctttcttcaaggtaatacaggtgggagtggtctgaagactgacataaccaagcttgcctccaggatgggccagttgctcttttctctgatcctgtccgtcttgtaggtggactccctttgggcaatctgccctccagcagcccaatggactcctacccaggcctctgccagtccccgttcctggattctaggttggtgtctctgcgtaacctttgtgggcagtcctcgttgtcctttccctccatctgagttcatgctttgcctccctcggactcctgcagcacttcccctgctcctccccattcccttgttagtgaccctcctcttttggggcagggcagtggcctggggctctaggcagtttgtctggggtgggacttggcatccctgcgccctgtgactctctgcccctgcgccccagggagcgcgggggcttctttagcccggaacccggtgagcccgacagcccctggacgggctcaggtggcaccacgccctccacccccacaacccccaccacggagggtgagggcgacggactctcctataaccagcggagtcttcagcgctgggagaaggatgaggagttgggccagctgtccaccatctcacctgtgctctatgccaacattaattttcctaatctcaagcaagactacccaggtacctgtgggatgagggcaagggagacagcctggcaacatggcaggtggaggagtcgcctgccaagtcttctctgactcactctctctgccctccagactggtcaagccgttgcaaacaaatcatgaagctctggagaaaggttccagcagctgacaaagccccctacctggtgaggcagaaaggagcatggattagcgtgggaactgagagggagggagggatctttgggtaatttacctcagttctttccgctccccactcctaaagcagctgggccagaagggatctgcttctgggtagggagtgtgaaaacactacagtatgggggcggggcatgagaccaagcactaggccctaaggctgtgtcccatatccctcagcaaaaggccaaagataaccgggcagctcaccgcatcaacaaggtgcagaaggtgagtggggctgggctggggtgtagcagtcctctagtgggtggcctctcttgagggtggagggccatggggcctgcctgcagcagcctgactgccctatgcctggtctccccctgtagcaggctgagagccagatcaacaagcagaccaaggtgggcgacatagcccgtaagactgaccgaccggccctacatctccgcattcccccgcagccaggggcactgggcagcccgccccccgctgctgcccccaccattttcattggcagccccactacccccgccggcttgtctacctctgcggacgggttcctgaagccgccggcgggctcggtgcctggccctgactcgcctggtgagctcttcctcaagctcccaccccaggtgcccgcccaagtgccttcgcaggacccctttggactggcccctgcctatcccctggagccccgcttccccacggcaccgcccacctatcccccctatcctagtcctacgggggcccctgcgcagcccccgatgctgggcgcctcatctcgtcctggggctggccagccaggggaattccacactaccccacctggcacccccagacaccagccctccacacctgacccattcctcaaaccccgctgcccctcgctggataacttggctgtgcctgagagccctggggtagggggaggcaaagcttccgagcccctgctctcgcccccaccttttggggagtcccggaaggccctagaggtgaagaaggaagagcttggggcatcctctcctagctatgggcccccaaacctgggctttgttgactcaccctcctcaggcacccacctgggtggcctggagttaaagacacctgatgtcttcaaagcccccctgacccctcgggcatctcaggtagagccccagagcccgggcttgggcctaaggccccaggagccaccccctgcccaggctttggcaccttctcctccaagtcacccagacatctttcgccctggctcctacactgacccatatgctcagcccccattgactcctcggccccaacctccgccccctgagagctgctgtgctctgccccctcgctcactgccctccgaccctttctcccgagtgcctgccagtcctcagtcccagtccagctcccagtctccactgacaccccggcctctgtctgctgaagctttttgcccatcacccgttacccctcgcttccagtcccctgacccttattctcgcccaccctcacgccctcagtcccgtgacccatttgccccattgcataagccaccccgaccccagccccctgaagttgcctttaaggctgggtctctagcccacacttcgctgggggctggggggttcccagcagccctgcccgcggggccagcaggtgagctccatgccaaggtcccaagtgggcagccccccaattttgtccggtcccctgggacgggtgcatttgtgggcaccccctctcccatgcgtttcactttccctcaggcagtaggggagccttccctaaagccccctgtccctcagcctggtctcccgccaccccatgggatcaacagccattttgggcccggccccaccttgggcaagcctcaaagcacaaactacacagtagccacagggaacttccacccatcgggcagccccctggggcccagcagcgggtccacaggggagagctatgggctgtccccactacgccctccgtcggttctgccaccacctgcacccgacggatccctcccctacctgtcccatggagcctcacagcgatcaggcatcacctctcctgtcgaaaagcgagaagacccagggactggaatgggtagctctttggcgacagctgaactcccaggtacccaggacccaggcatgtccggccttagccaaacagagctggagaagcaacggcaggtaagttgacaccctggagctaagccccctatatcgctcctgtctctggggcagccctatgattggagtagaatgggcttattcctcttctcttttttttgcatagcgccagcgactacgagagctgctgattcggcagcagatccagcgcaacaccctgcggcaggagaaggaaacagctgcagcagctgcaggagcagtggggcctccaggcagctggggtgctgagcccagcagccctgcctttgagcagctgagtcgaggccagaccccctttgctgggacacaggtaggtagagtggcaagggatagtggggccaggatattgaaggttgctccaccttcatctaccttgtctcttctaggacaagagcagccttgtggggttgcccccaagcaagctgagtggccccatcctggggccagggtccttccctagcgatgaccgactctcccggccacctccaccagccacgccttcctctatggatgtgaacagccggtgaggctccaggaggttccctgggggtaaaccaagggggatggattttatcactgttggaagctcttgtgattttcctgtatcactaatccttttccagtatcactttctcttcttcctcattccttttctccctcactgcattaattctatccttcctcactgccctaagcccatgttcttgctccttttcatctgatttcatcctactgactactgtatattcttccaggcaactggtaggaggctcccaagctttctatcagcgagcaccctatcctgggtccctgcccttacagcagcaacagcaacaactgtggcagcaacaacaggcaacagcagcaacctccatgcgatttgccatgtcagctcgctttccatcaactcctggacctgaacttggccgccaagccctaggttccccgttggcgggaatttccacccgtctgccaggccctggtgagccagtgcctggtccagctggtcctgcccagttcattgagctgcggcacaatgtacagaaaggactgggacctgggggcactccgtttcctggtcagggcccacctcagagaccccgtttttaccctgtaagtgaggacccccaccgactggctcctgaagggcttcggggcctggcggtatcaggtcttcccccacagaaaccctcagccccaccggcccctgaattgaacaacagtcttcatccaacaccccacaccaagggtcctaccctgccaactggtttggagctggtcaaccggcccccgtcgagcactgagcttggccgccccaatcctctggccctggaagctgggaagttgccctgtgaggatcccgagctggatgacgattttgatgcccacaaggccctagaggatgatgaagagcttgctcacctgggtctgggtgtggatgtggccaagggtgatgatgaacttggcaccttagaaaacctggagaccaatgacccccacttggatgacctgctcaatggagacgagtttgacctgctggcatatactgatcctgagctggacactggggacaagaaggatatcttcaatgagcacctgaggctggtagaatcggctaatgagaaggctgaacgggaggccctgctgcggggggtggagccaggacccttgggccctgaggagcgccctccccctgctgctgatgcctctgaaccccgcctggcatctgtgctccctgaggtgaagcccaaggtggaggagggtggacgccacccttctccttgccaattcaccattgctacccccaaggtagagcccgcacctgctgccaattcccttggcctggggctaaagccaggacagagcatgatgggcagccgggatacccggatgggcacagggccattttctagcagtgggcacacagctgagaaggcctcctttggggccacgggaggaccaccagctcacctgctgacccccagcccactgagtggcccaggaggatcctccctgctggaaaagtttgagctcgagagtggggctttgaccttgcctggtggacctgcagcatctggggatgagctagacaagatggagagctcactggtagccagcgagttacccctgctcattgaggacctgttggagcatgagaagaaggagctgcagaagaagcagcagctttcagcacagttgcagcctgcccagcagcagcagcaacagcagcagcagcattccctactgtctgcaccaggccctgcccaggccatgtctttgccacatgagggctcttctcccagtttggctgggtcccaacagcagctttccctgggtcttgcaggtgcccgacagccaggtttgccccagccactgatgcccacccagccaccagctcatgccctccagcaacgcctggctccatccatggctatggtgtccaatcaagggcatatgctaagtgggcagcatggagggcaggcaggcttggtaccccagcagagctcacagccagtgctatcacagaagcccatgggcaccatgccaccttccatgtgcatgaagccgcagcaattggcaatgcagcagcagctggcaaacagcttcttcccagatacaggtaacctcagctggtaacatagccaagttactcagggtgattattgttatccctaaatgggcactgaggctagagacctcagataatccctacttaagatgggacacaaagaactttggctaaatatcatactagtggtagaggcagaaacactgtagcttttaagaagagagagaacagttcctggcatatagtaggcatgtagcagatgtttgaataaatggaatgaatgtatgaatgaagcctaattagcagagcctttgtagctgtagtgaagttgaaagcttaagacttgaagagaagtggtgcaaaaaaaagcagttgaggccaggcacaatggctcatgcctgtaatcccagcactttgggagaccaaggcaggtggatcacttaagatcaggagttcaagaccagcctggccaagatgatgaaaccccatctctactaaacatacaaaaattagctgggtgtgagccgggcgcggtggtgcatccctgtaatcccagctactcgggaggctgaggcaggagagttgattgaacccatgaggcagaggttgtggtgagccgagatcgcctcattgcactccagcctgggcaacaagagcgaaactccatctcaaaaaaaaaaaaaaaaaaaaaaaaaaattagctgggtgtggtggtgcacgcctgtagttccagctactcgagaggctgaggcaggagaattgcttgaacccaggaggtggaggttgcagttagctgagatcacgccattgcacttcaggctgggcaacagagcgagactctgtcttaaaaaaaaaaaaaaaagcgattgggataggtgaaaaagttcattgaggctgcaatggtgggaaaacctatgggatgtttcaagaacagtgagtgaattggttaggctggagtaaactgtttcgagtgaagtaagtgacataattttggtgagataagatgggggccagattgaaaaagacctcaaattataatagcatttattgagtaattactatttgccaaggagtttactgagcactttatactttttgtccaatttaatcattatagcagactcattaaataggtattgttattatctttgattacagaagaggaaacagaagtggaggttaagtaacttgtccaagattacacagcagctagcagagctagatctgaagtctggtcggtactcctcttaactgtttactgcctcaggattccaggagagggagtttgggttagtccttaagaaagtgggagctctggccaggtgctgtggctcacgcctttaatcccagcactttgggaggctgaggcgggtggatcacctgaggtcaggagttccagaccagcctggccaacatggtgaaacctcgtttctactaaaaatacaaaaattagctgggcttggtggtgggcacctgtaatcacagctactcggcaggctgaggcaggagaatcgcttgaacccaggaagcagaggttgcagtgagcctaaattgcaccattgcactccagcctgggtgacaagagcaagactctgtctttaaaaaagaaaagaaaagaaaaaaagaaagtggatgctcagttaagttttctgagcagtggagaaatatacaaagtgtgggattttaggatgatgtaagtttttggtggttggttgtttcttcttttttgcccagcattctagacagacaggagagtggactacaggtgatgcccaaaacagctctggaatctagggctttgcaacagtgccagcatcttgggtgcttgggctgtgctagttggactaagaacattacctttgaagaatgctttccgagtcataaagtgtacttatattcttgtcacatttgatcctcttaacacctctgtgaggtagacggagtagggatcatcatctgtatcaaataaaagggtaaactgaggtgaaataacacaggttgactcaacaaatatttacggagcccctttttgtagcacggtgcaagtaaaaacaggcccacatgtcctgtgaatagagctgattcacccaggccgactggctcctaattcagtggtctttctgccttgccgtgccattgttctgcctggcgtggttgaagtcaggatgttgaagggaatcgcagatattcactggagcattggccccatagcccagctcacttggttctcccctctccagacctggacaaatttgctgcagaagatatcattgatcccattgcaaaggccaagatggtggctttgaaaggcatcaagaaagtgatggctcagggcagcattggggtggcacctggtatgaacaggtaagactcagggctggaatggggttggcccttttctttcccagtcacaccccttcttggctcccctccctacttgtcccacgtctctttgctttccaactttcttattgccaacacttatcttctgtgctttggtggactccagacagcaagtgtctctgctagcccagaggctctcggggggacctagcagtgatctgcagaaccatgtggcagctgggagtggccaggtaagtggtcaggtgggagtaggaacttgtgtcttatgccactgggccacccttcttagggcctagcagggaacaatgaccctttagcagcctctctcattgcaggagcggagtgctggtgatccctcccagcctcgtcccaacccgcccacttttgctcagggagtgatcagtgagtatggggcgtgggaggaaggtgcaggggagtggtttgggtcatatggaggaagagggattgggattacccttttgcaggtcctgacacccagcttcttttcccagatgaagctgaccagcggcagtatgaggagtggctgttccatacccagcagctcctacagatgcagctgaaggtgctagaggagcagattggtgtacaccgcaagtcccggaaggctctgtgtgccaagcagcgcactgccaaaaaagctggccgtgagttcccagaagctgatgctgagaagctcaagctggttacagagcagcagagcaagatccagaaacaactggatcaggtgggggaaagcaaacttcagcctagcacccagaaggcagggaagagggttggcatggggggagcatgccccagcctgacctctccgaccctcccatgttaggtccggaaacagcagaaggagcacactaatctcatggcagaatatcggaacaagcagcagcaacaacagcagcagcagcagcaacaacagcaacagcactcagctgtgctggctctcagcccttcccagagtccccggctgctcaccaagctccctggtcagctgctccctggccatgggctgcagccaccacaggggcctccgggtgggcaagccggaggtcttcgcctgacccctgggggtatggcactacctggacagcctggtggccccttccttaatacagctctggcccaacagcagcaacagcaacattctggtggggctggatccctggctggcccttcagggggcttcttccctggcaaccttgctcttcgaagcctcggacctgattcaaggcttttacaggaaaggcagctgcagctgcagcagcaacgtatgcagctggcccagaaactgcagcagcagcagcagcagcaacagcagcagcagcaccttctaggacaggtggcaatccagcagcaacagcagcagggtcctggagtacagacaaaccaagctctgggtcccaagccccagggccttatgcctcccagcagccaccaaggcctcctggtccagcagctgtcccctcaaccaccccaggggccccagggcatgctgggccctgcccaggtggctgtgttgcagcagcagcaccctggagctttgggcccccagggccctcacagacaggtgcttatgacccagtcccgggtgctcagttccccccagctggcacagcagggtcagggccttatgggacacaggctggtcacagcccagcagcagcagcagcaacaacagcaccaacagcaagggtccatggcagggctgtcccatcttcagcagagtctgatgtcacacagtgggcagcccaaactgagcgctcagcccatgggctctttacagcagcttcagcagcagcagcagctgcaacagcaacagcaacttcagcagcagcagcagcagcagctacaacagcaacagcaacttcagcagcaacagcttcaacagcagcaacagcagcagcagcttcaacaacagcagcagcaacagcttcaacagcagcaacagcagctacaacagcaacagcaacaacaacagcagcagtttcaacagcagcagcaacagcagcagatgggccttttaaaccagagtcgaactttactgtctcctcagcaacaacagcagcagcaagtggcacttggccctggcatgccagcaaagcctcttcaacacttttctagccctggagccctgggtccaaccctcctcctgacgggcaaggaacaaaacaccgtagacccagccgtttcttcagaggccactgaggggccctctacacatcagggagggccgttagcaataggaactacccctgagtcaatggccactgaaccaggagaggtaaagccctcactctctggggactcacaactcctgcttgtccaaccccagccccagcctcagcccagctctctgcagctgcagccacctctgaggcttccaggacaacagcagcagcaagttagcctgctccacacagcaggtggaggaagccatgggcagctaggcagtggatcatcttctgaggcctcatctgtgccccacctgctggctcagccctctgtttccttaggggatcagcctgggtccatgacccagaaccttctgggcccccaacagcccatgctagagcggcccatgcaaaataatacagggccacaacctcccaaaccaggacctgtcctccagtctgggcagggtctgcctggggttggaatcatgcctacggtgggtcagcttcgagcacagctccaaggagtcctggccaaaaacccacagctgcggcacttaagtcctcagcagcagcagcagctacaggcactcctcatgcagcggcagctgcagcagagtcaggcagtacgccagaccccaccctaccaggagcctgggacccagacctctcccctccagggcctcctgggctgccaacctcaacttgggggcttccctggaccacagacaggccccctccaggagctaggggcagggcctcgacctcagggcccaccccggctccctgccccaccaggagccttatctacaggaccagtccttggccctgtccatcccacacctccaccatccagccctcaagagccaaagagaccttcacaattaccttcccccagctcccagcttcccactgaggcccagctccctcccacccatccagggacccccaaacctcaggggccaaccttggagccgcctcctgggagggtctcacctgctgctgcccagcttgcagataccttgtttagcaagggtctgggaccttgggatcccccagacaacctagcagaaacccagaagccagagcagagcagcctggtacctgggcatctggaccaggtgaatggacaggtggtgcctgaggcatcccaactcagcatcaagcaggaacctcgggaagagccatgtgccctgggagcccagtcagtgaagagggaggccaatggggagccaataggggcaccaggaaccagcaaccacctcctgctggcaggccctcgctcagaagctgggcatctgctcttgcagaagctactccgggcaaagaatgtgcaactcagcactgggcgggggtccgaggggctgcgagctgagatcaacgggcacattgacagcaagctggctgggctggagcagaaactacagggtacccccagcaacaaggaggtgagtactctgagtagagtggagcaggtagagtgggtcctagagccagcggggggcagaatgagtgagcctgggtcagacagaagagatgagggctctgaggaggagggtagcagccttcaatgggcttatttggcttaggatgcagcagcaaggaagcctttgacaccgaagcccaagcgggtacagaaggcaagcgacaggttggtgagctcccgaaagaagctgcggaaggaggacggggtcagggccagcgaggccttgctgaaacagctgaaacaggtgaccccccaggagacagtccccctggtcccatcccaggatagggggcaccctgtcccccagctgtgcaagacagcgatgcaaacgctgcaggttttgaactttgtcatcttgccccttgtaggagctgtccctgctgcccctaacggagcctgctatcaccgccaattttagcctctttgccccctttggcagtggctgcccagtcaatgggcagagccagctgaggggggcctttggaagtggggcgctgcccactggccctgactactattcccagctgcttaccaaggtcagaaaaatggcaatattttttgggaatagtgaagttcttgggaaggtgagggtgggaatagaaaacttgagggaattgctgacgtagagtggggccaggagattatatcagtctccctatgccatcttgcacacaacaccccaccccccacccctcagaataacctgagtaacccgccgacaccaccctcgtcgctgccccccaccccacccccatcggtgcagcagaagatggtgaatggcgtcaccccatctgaagagctgggggagcaccccaaggatgctgcctctgcccgggatagtgaaagggcactgaggggtaagtcaagagcagatgccacccctggtggagtttggtagctggagtccaaaccagttagtatgctgtacagtttagaaattagtgggttgcctgctgtcctgtgtgtttacataacagggcacctgaggtaggaagggccctttcaggactgatttcttgggggccagaatggacatttggagtctagagcaaatgcaataggagaggtgggtggcagggagcatctttatgaagctttgtatagaaggaacagtccagctttagtgagtgtggagctagactctgatctggatttgaattctggttcctgcattcattcaactgtgttactgtatccaagtaacttgattgacttgtgtgagcctcagtttcctcactgtaaaatggctattgtagtactcacttaatggagttattaaatgactaaacaaactccaaagagtatatctaaagccagctgccaccaggcctggtagcttatgcctgtaatcccaacattttgggaggccaagatggaaggattgcttgaggccaggagttcgagaccagcttgggcaatataacaagaccccatctctacgggaaaaaaaaaaaaaaaacaaaaaaaacaaaaaacaacagtgcctggcatgcaggacagactcaataaatataccttgtttgccccaaactggtaggtgggaggacagctaatcatgatagctgagatctcatgctaattaggcctaaaatattgggagaaggtaccatcagccctggccaccctcacctgacttttcttctccctacccacccctcagatacttcagaggtgaagagtctagacctgctggctgccttgcctacaccccctcacaatcagactgaggatgtcaggtaggggcggggccagaaatggggatgaggaacaagggtggggtacaggttgcctcatatttcctttggccaatggagatttcaagtaagacatctattcatctctagatttgggaggggagtctgcagggctgtagcaacaaatgtctacttttggtccccaggatggagagtgatgaggatagcgattctcctgacagcattgtgccagcttcatcccctgagagcatcttgggggaggaggcccctcgtttccctcatctgggctcaggccggtgggagcaagaggaccgggccctctcccctgtcatccccctcattcctcgggccagcatcccaggtatgtgctactctggatgtgggccaggcccagttcacctgggttgtccgaagctgggggagaggcggccaagtgttacacaaattcctctttctcattcagtcttcccagataccaaaccttatggggcccttggcctggaggtccctggaaagctgcctgtcacaacttgggaaaagggcaaaggaagtgaggtgtcagtcatgctcacagtctctgctgctgcagccaaggtgtgtcctaggggtacctcgaggctgaggggaacctgatcagagggcagtccctggaatttgtctggataaggaaaaatgtagtcgttcaagcacatgtactgagtacctattgtatgtgaaagcctgggctagaggctgtgagattcgggtaaatgaatcatggttcctgccctcacggggctcgtagtcccatggtaaagacagacaagtcaacaactaaggagcacctgtgtgtgtaatgacacaggtactacatgacagcattgccccagtcatgtttggtgggactctgtcagctgttttgaaaatattaacgggcttttgtggtcaaagaaagttggaaaacacagttaaaatgacaatatgggtttctttactacaagagtcctcaggtccttttaatttgctaacgtgtatcatgagcctccaagtcatggatagagcatgcatcatttcctaaacgtagttgatgtagttcccttttcgtggagctcccgtcagtgcccacagcagtttgggaaaggctgctgtgagggaagtgtatgaaaagagctgggtgacataggatagaactaccctggggagtgggttctaggtgtccttgtccccacccagctggtagtagagctcacctcagacacttggctgatatgtttcttccatcccttccctggccctggcagaacctgaatggcgtgatggtggcagtggcggagctgctgagcatgaagatccccaactcctatgaggtgctgttcccagagagccccgcccgggcaggcactgagccaaagaagggggaagctgagggtcctggtgagtgtggcagggaagccctttgggacttgaggggagtgattctggtgggaggctctgatccactcctttctgcaggtgggaaggaaaagggtctggaaggcaagagcccagacactggccctgattggctgaagcagtttgatgcagtgttgcctggctataccctgaagagccaactagacatcttgagcctcctgaaacaggtaggtctgggggagaaaaaggggtgggtgttagaaaaaaggggctgccggccaggcgcggtggctcacatctgtaatcccagtgctttgggaggcaaggcgagtgaatcactttaggccaggagtttgagaccagcctggccaacatggcgaaaccccgtctctactaaaaacaaaaacaaaacagtagccaggcgtgatggtgcgtgcctgtaatcccagctactcgaaaggctgaggcatgagaatcccttgaacccaggaggcagaggttgcagtgagccaagattgtgccactggatccagcctgggcaacagagcaagactgtgtctcaaaaaaaaaagaaaagaaaagaaaaaagaggctgtctagggcaaagaatgtggaggccttttgggagggtggcatatgggtgaggggaaggagggagctagttagatgaggagctggcactaatgatacagggcaccctcctacaggagagccccgccccagagccacccactcagcacagctatacctacaatgtctccaatctggatgtgcgacagctctcggccccacctcctgaagaaccctccccgcccccttcccccttggcaccttctcctgccagtccccctactgagcccttggttgaacttcccaccgaacccttggctgagccacccgtcccctcacctctgccactggcctcatcccctgaatcagcccgacccaagccccgtgcccggccccctgaagaaggtgaagattcccgtcctcctcgcctcaagaaatggaaaggagtgcgctggaagcggcttcggctgctgctgaccatccagaagggcagtgggcggcaggaggatgagcgggaagtggcagagtttatggagcagcttggcacagccttgcgacctgacaaggtaccgcgagacatgcgtcgctgctgtttctgtcatgaggagggtgacggggccactgatgggcctgcccgtctgctgaacctggacctggacctgtgggtgcacctcaactgtgccctttggtccacggaggtgtatgagacccagggcggggcactgatgaatgtggaggttgccctgcaccgaggactgctaaccaagtgctccctgtgccagcgaactggtgccaccagcagctgcaatcgcatgcgttgccccaatgtctaccattttgcttgtgccatccgtgccaagtgcatgttcttcaaggacaagaccatgctgtgtccaatgcataagatcaaggggccctgtgagcaagagctgagctcttttgctgtcttccggcgggtctacattgagcgggacgaggtgaagcaaatcgctagcatcattcagcggggagaacggctgcacatgttccgtgtggggggccttgtgttccacgccatcggacagctgctgcctcaccagatggctgactttcatagtgccactgccctctatcccgtgggctacgaggccacgcgcatctattggagcctccgcaccaacaatcgtcgctgctgctatcgctgttctattggtgagaacaacgggcggccggagtttgtaatcaaagtcatcgagcagggcctggaggacctggtcttcactgacgcctctccccagggtgagcagtgggcccttgaaatggataatatggaatgggaaaagtttctcccagggtcactgttacaatgtctataagaggacctgtagcttctatgtgaatgatcctccttcccccacctcaggcaggcagggggtctcttgaaaactcccagtgaaagtgtttgagcctctcttgtcaccctaaattcccttgtagttgaaaatattttgctggtctaatctcacatattctagttctgttgctatccccagtggaacaaaaggaaacagttctgagactatcatctgcctcacccaacctaatcctaaccaagttccttggggttgtttttccctggacgaaatcagaattattttgattttagttttagtgttaatgataaaataacagtaagagcaggtacctttttttgagtgtgtactgtgagccacaaactaagctaagtgatttgtgtagtttattttgttcatacaaccctatgaggtaagtattatactacgattatgcccagtttgttcataaagaaactgagtctcagatttcagtacagtcgtgcattgctaaatgacagggatacattctgagaaatgcattgttaggtgattttgtcattgtgtgaacttcatagagtgtactacacaaacctagatggcatagcatactacacacctaggctctgcggtataccccattgctcctaggctacaaatctgtacagcatgtaactgtactgaatactgtaggcagttgtaacatacggtaagtatgtgcatctagacatagaaaagatacagtaaaaatacagtacagtattataatcttaccagaccactgttgtatatatgattcctcattgaatgaaatgttgttaagctgcacgtgactgtatttggctcaaggtctcatgaccagtactagaacctgaacccaagtctttccaactccaaagcatgcctgctctttcactagggaccttccatggcctatgctgggtctcctgggccctgggtttgtatctcaaggctctgtgatgaccccttggggttggaaacctcctgcttcttaagagagagtgagactaggaggccaagagaggatctggaagaccaacacaacttcatgatagggaggcttgaaggcctcagaaaactgcagttctggattggggttagggactggaggtcagtgagcagaagttgcctctgaggactgctctcttccctgcttcttagccgtgtggaatcgcatcattgagcctgtggctgccatgagaaaagaggctgacatgctgcgactcttccctgagtatctgaagggcgaggagctctttgggctgacggtgcatgccgtgcttcgcatagctgaatcagtaaggaaggggctgggagctggggggcttggcgggcactgagaactttggcctaaccccaaaaaaactcaggctaaggtgagtatgaactgtgcccacagctgcccggggtggagagctgtcaaaactatttattccgctatgggcgccacccccttatggagctgccactcatgatcaaccccactggctgtgcccgatcagagcctaaaatcctcacacactacaaacggtgagcttgtgatgctggagccaagggatgtgggtgtgggtgttgacagggatcctctggtcccattatgaggatttaggatacagatcagagttcccgtggagaaaatggggaatcactcttagacttcctaattagagggcatgcaggtattagtagggtatccttttcctcctctcccaacctgctcagatgcacttgggatataggacagaattatcttgggcaccctggggaggtaatgggtaaactggtgaaattttatgaaatatataagggacttggtcacctctttcttctcctgttttacttctgggggagggcctgtgattctcccaaacctcagataccccatgggtgctagggtcaccttcccttccccatgagtgttggtgtcaaaaataaatagttagagatataatagaaaaataataaaaccttacatttgtatagcactttatactttttttttcaaagcgttttcacatccattatctcatttgatcctcacaacaaccttatgaggtaggtagggcaggtggtatgacccccattttacagctgagaaaactgagacccagaaagattaaatgactaggcaaaggtcacacagctgggaccagacccttacttcttcactgcaggtccttgttctttctgtgtaccagggaccttagtccctgggtagagggaggcagaatctgtggtagcagggctttctcgaaggtctttggtggctcctaggctgttgtagaatgtcagagactctccatccctagccagccttgtccttgatgccctgcaatggtggttttcaaactgtgagtgcctgtgttccaaaaagtcctggatcacttaaactgatgggttgaacttttccttcccatgcatatctcttccttccccaaattggattaaaccagaagagctccattgtcatctagtttatgtattggagttccagtcaacattttgttaaagaaaaaagcaaagatttctgctaaataaaaaaagaaccagaaacgtttgaaaaccactgctctgggatggcaagaatttggctggtgccctaaggtggtaaaaggcatcctgccaggcagccgtcattcccctgcactgagccatctgcacagagcccaatgttatgtcagagaaggggacagtccgaagaaaggataccacctttaggctgtgagttcacagccagttttaattcaaatctagcccagcgtggtaggcacagtccccattttcagggcttccagtatgtgcaggaggtaggattcagacattcaagcaaaccatcagcttaaattctaggcctgggctgcttgcggaaaacttcccagaggagcatggccttgagaatggtttggcaggagagtggtaggaagtgggagatgggagaacaggctcagtgtaggggaattggtgccccccatctccctccacaccccacccctcaccctgggctctctgtgccacccagggtgtcagaagggtccctgtagctagttgcttcctcaccagagctgagacccagttgcctctactcctttcccaaggctgcacttccagtgcttgccagcagcacacgcccctaactggtgtgttgcacatcccaggaggtggcagaggaggtgggtggtatgtacttggtctgagggagagctgtcttgtcatggattatatcacctcccaggccccataccctgaacagcaccagcatgtctaaggcatatcagagcaccttcacaggcgagaccaacaccccctacagcaagcagtttgtgcactccaagtcatctcagtaccggcggctgcgcaccgaatggaagaacaacgtgtacctggctcgctcccgtatccagggcctggggctctatgcagccaaggacctagaaaagcacacaatggttatcgagtacattggcaccatcattcggaacgaggtggccaaccggcgggagaaaatctacgaagagcaggtatgagctggcagaggggccattgtggtgcatagtctgcactcaaccaaggagcaagggcaggattggtcacaggagagcaggaggaaagctgtggtggggagaagggaaaggcaggagaaatgaagtacatgcaacaaaagcccccactgcctgagtctcctacctgatcccacagccaccactgccactctctgatactcttgtcccttcttctgcaacctctgcctttctagaatcgaggcatctacatgttccgaataaacaatgaacatgtgattgatgctacgttgaccggcggccctgccaggtgagagatgacgaggaaggagggatttagtggtccctgagagtggcactctgggggatagacgaacaaggaatcaaaattgtcccaagttagttgcctgacatccctgactctgtcccactgcccaggtacattaaccattcctgtgcccctaactgtgtggccgaagtcgtgacatttgacaaagaggacaaaatcatcatcatctccagccggcgaatccccaaaggagaggaggtgagaggaagtatcctgactgagtgacaaagcagctcctcctcctttcaccccttctctgccattccctaaatgtggattcctaggctgggcacctcagatcatatcttctctggcctcccctcttcctgtgggggactagcattgattctgccctcttctcttttcagctaacctatgactatcagtttgattttgaggacgatcagcacaagatcccctgccactgtggagcctggaattgtcggaaatggatgaactaagaagctttgaggctaccaggcaggggagtccccctacccacaacctcttccctgaaagggatgagggggaagagaggtagcagccagagccaggacccagggttggggctgccggctgacccggagcccctggagcaggaggctggggcagagggccctaggccaagcccaccctgggcaccagggacaatcctcttccccaccaccggccctcaggctggcatctctgcccccagctccaggaggggccagacagaagcagccattgggcatctcaggtttgagggggatatgggccgggaactacccagaagcatctgggaggcagcagggtgggggaagaggatgtgtggccgggcctcacagccctgctgctcccactgacctctccggcccaactcacggctgcaaagagacttgactaagcttgacaatcccaaaggccgggtcccacacctggccctgcctgccgggtcctgcccccaccctcacccccatccccctccctcttgatctgtctctgtttccctcttttcctctgtgtttctgtctctctatgggttgtgtttccttgttttccactctgacaaatgcaacatgaacgggaaagaggcgcccagctgcctaggagggcaagctgggcaagccgggcaaggagaccccgcacccacacctacctcatttaagtgttggattttttgctgttttgaaatgtgagaccctctccaagccccctactgccccaaccctctcccccacctcactgccctcttctgagtgggtggaaggggggtaggaggaggaagaaaaacaacaacaaaaaatccatctttgtttttaattatgggcatgggatggtggttgaggcaaatgatgatgaagattggggatgactggcccctagttgctctaggacttccttctccatctggacatgggggcaggagggagctaaacctaggaccaggatatctccctcctgttttcccaacctcatcatgagcctgtttgccctccagcccctggacgggttgggtggggggtagggtgagggctatccctgagtggcatgcccatacctagtgaggcagggtgtggcccggagctcccactttccctcagtcaccaaactgctgctggtctggtgggaaggggtggtgatgtgggggtgggggagcttagtgtcagcgcggggagggtggggggtatttatctatttatacatgggattgtacatagtcttgtggggcatgggggagccggctggaggtgagaaccctcccctctccccccaccccccggggagagcaaatgtaaaactactaatttttgtgctttatatattctatataaatatatctattttctttttacaaaaccagtttataaatggtaggggggtgtggggcggacacatggagctccccttgtgggggggccccctccattacccgacctaccgcccttttcctcaccccccaccccactccccaccccctggctgtgactgctgtaagatgggggtatagaggctgggcaattcccaccccctgttgtatagttggactatgttataacgcacaaaagagagctgaccccagggggagccagagggtgatgggttccttgcctccctttccttcccctttctgcccaagcttgtgctgcagttgaacctcttcctgggggtgggagtaggtaaggggtgggtgaggccccaaacccctctctggtagggaaccgtggggatgaagatgaagcttatatgcagttctcttctaggggctgtgggcaaagggcattttgtaattaatattttcaagaatcagatgtctggagtgtaggggtgggcttggtggtggtggacgggcgggcctgctggagggggagcttggtcgctgttgtgattttaggtttgtttttgttttgttttgaatttggggggttgtggattgttgggggtagggagattttttttttttaaagctgcttcctcaactgtttcaagctgcaaatgtttaagagaataacagcccccactcccacaggaaccgctgtaattaaatcagacagtaggaagactgggctgctgccctcaaagccacagcccttggatgttccttttccgagagcagaaggtctaggctacagggagggggagattggctcccgtgagtcaggctgtgtttggggcttgggccctgggattgggaaaaggggatggggcagactttgtaagcatatgctaggtatccgatagtcctgtagaatttagtgaagaaaccttatacagtttttaatttttatataaactataactcagacccaagctacaaggttggaattttggttggttttttttttaagtaccctgcctgtataattgcatcagaatcccccaccccaccccccgcccccgtgtttgtattttgggttggtttacactcgcacatactcagttttcagttttcccctttacagtcttctcccctcacctccaggaccctccccctttttaaaaaataaatcgctgacaagtgtgaatcccgtgaagactttattttgtgttgtgtgtatcctgtacagcaaggttggtccttcgtaacaacggatgaaatggttcccttttttaaagcgccctctctccctccaccctcagcgcccctgtccttggcatgttttgtatcagcgatcattctgaactgtacatatttatgttgcgagaggcaaagggcaagttttggattttgcttcttccaagtttgtttttaaacgacaaataaaaaaagaacattttaaatacaagcggctccgtcccatgaccctcgccgtcagccggatccgtgcggtccgcgaggacccgggggagggcggttaccgaggcccgccaccgccggaagggtgggttccttgccttccgccccagtctggcgactgccatgacgtgggcggaagtggcgtcgccgcaccggatgtggggcggggcctgccccaagagagtttcctaaagcgaggaaaccaagccgggcgcctcttgcaatggagacggtgaggagtgcaggagggcggtcgggggcgctgtggagcctaagacacccccccaacccttaggagaccgggagggccgggcaggggctggcgctggtgtctagcaaacaaaaagcagccgggtgtctgccctatcccgtgaccctgttcctccgcttcttcgttgggcgcatctcctggaactgggccgcgtccccgccgcctttccgtacgcggtacccttagcccaagcaggcagtgactcctggctccctccttggggcccacgtatgccgtggcaatctcgggcctcctttcctattggcacctcaagcccttttagaggtttgagagcgcagggttgtgagccggctttgctgggtgaggcacggggcgtccagagggatctccgcttgcaggtagctcctggacctcgatggtctttctgtgatccctgcaatccccggcaggaggacatctgaagatctttatactgcgtccagtgaagtcacattcccttaataagaccgagaattgaggtttgcttgaaagaggaaatcttgcagtgttagaggccgatgtgtccctggacaattttaggtcatggcccgctctgcgactctaagcaggggttttggcatagctcattcttggcgagcaggcattgaccaattgtggcagggccctgtcaccctcccacagatgctgcgggttgcctgctacatgtttgcacccaccctcactctcaggagtctttttctagcgctctgtaacccctcccatacacttccctctccacagtttttaaccatgtgtcttctttcaggcagagtaactctttccatcttggtttttatcatctgctactgtagttacgaaaggactgcaggttcactttgctttggattacatgcccagagtaattctttgccacaccgtttctctgctcacagagaggttgtttctttcaggttttcaaaaagaaaaccgaccaaagtactaaaatgattcgcagttggtctcccaggcaagggagccaattctgactaatcaggataatcttaaacaaaaataaggagtctaattccattaaatttaaaatgacatgtcatattctacttacttgtaaatgtattatggtttacaaagcatttttatatagattttctaatttagcctttacactttatgtactggattaggctctggggtagaagttaaaaagaggaaaaagaaaactcagccaggtgtggtggctcacgcctgtaatgccagtactttgggaggccaaggcaagtggattgcttgagctcaggagttcagcatcagcctgggcaacatgatgaaagcctgtctcgacagaaacaaaaatacaaaaattacccaggcgtggtggtggtggtgtgtgcctgtagtcccagctactcgggaggctcaggtgggaggatcgcttgatccaaagaggtggaggctggagtgagctgagatcatgccactgcactccagtctgagtgacacagtgagatcctgtctccaaaaaaaaagaaaagaaagaaaactcctgctttgaaaatgttcagcctaactggagtgatggtgagggcaagccagcaacagctgttatttaaaggtagactataataaatgctgtcatcaatatgaaaacagaggactgtgacagaatagctgagagaaaaattactttggacctaggagagggcactgcaaattgagagaacagtgtgagcaagggcactgaaattggggtatgtagagaactgggggtgagccagcggcatgatgttgctggctttggattttggtcacagtgggagaaaagactggaaaagcaggctaagatcaggttgaaggtattacacaccatgctaaatttgaactttgttttgtaataggggacccatggaagatttatgagcaagtcagtgaatgtcctttaggaatgttcatagcagctttctgtacatggactgagctacttcgaaaagtaaagtttcttgttaatggggatgaaagtcccttccaaatctgagatgctttggtgaacaaacttggtgaaagcatgaaagataaattgaagaacagatagatttgggccaaggaccccagtttaaacaacgttgcagaggtgagaggtaaaagcctaaattaaggctgtgatattggcaatgagagagatggatctgagacatttctaacataccagcttagctgataagtgttaagaagacagctgtgcaaaacaaaaaaacaagatgggaaccacagcgagaataataggattggagggacaaatgttttgtttcgtattcaagcatttgaggagtctctgtgacatctatggttgtcaaacaaataattggaaatgtagatcagaagtttggaagaaattgcgagtctatttgtcagatgtagactgtgtctctgtaatattttgtacttgcgtggtacagtggtactttctcaggtcccttatgttattaaaagtagaaaggaggccaggagcagtggctcttgcctgtaatcccagaattttgggaggccaaggtggccggatcgcttgagcccaggagctcaagactagcctggtcaacatagcgagaccccatctctacaaaaaaatacaaaaagtagctgggcctggtggtatgttcctgtagtcccagcagcccgggaggcagaagtcggagaagctggggaagttgaagatgcagtgatctgtgatcatgccgctgcactccagcctgaatgacagagtgacaccctgtctcaaaaaaaaaaaaaaaggtagaaaggagtagatgtaattacataatcccccctctgatatggtgaaacaggcagaaagttaaaagtcacggccaggctcggtggcgcatacctgtaatcccagcactttgggaggccgaggcgggtggatcacgaggtcaggagtttaagaccagcctggccaacatagtgaaaccccgtctctactaaaaatacaaaaaaaaacttagctgggcgtggtggcaggcatctgtagtcccagctacttgggaggctgaggcaggagaatcgcttgaaccccggaggcggagattacagtgagccaagatcgcatcactgcactccagcctgggagacacagcgagactctgcccacccgcccaaaaaaaaagtcacatatgcagttgtgtttgactctcttatgttggtatctgtatctctagttagctctatgtttctttcctccctctgtaacttagtcttgggcatatctgttcatatcagtgtgcatcattctttgagaattaaaaaacaaaacaactgtgaattatatgcaaaaccctgtgcttggtggtatgggagatacaaagtataagatagttctaggtttccaggaatttataatctgtttggatagataatgaacaaaataactgtagcacagtacagtatatatcatatgatgggtaaattctacagaagtagctgtttttgtgcctttgtgtagatctttgtgagactctgatatatcatgtgtctatctttatcacagccctctctcccacttataagtgatgaggctgttgttctgatagtcttgccaaaatggcaggccaagctgacagtcttatgcagtccagtgggaagagggagattatcccccttactccctgcactctcccctagcccattaagggagaaaagtttagggctgtcttaaacttccctggtttaggaagtttgtcagccaacctcccaggttgaagtttttaatgtcatgttactacagaagctatggggatgaagtatggttttattttggagatatcacccagagaaaatggagccaagactgttgatgctagcagatgaaaattgttgtgatcccttctgggttcctaaataacaatggcatttccaaatgttcccacttgagggagcacagaaatggttctaagttttgtctagtcaaagcactctctaatctcagactatcttgggaagggaaacttggaaaaccagcatcccctggctatagcagcctttgactcacaagggtgctgagtggactcaagttcccagtttcagtacattcgtgttccttatccacctctcagtcattcaggttttgactggctgacagtcagctactgggatcctccccagttgtggctctctctctgccatggagctagacaatggtggaaccagtgtctgtggttctagtgcctacaactatgcctagtgagtgtctgtgtttggggaagacaatgctgtctctctggcttccatgttttaataaagtagatctgtgagaatcttgtaggggttagccctaagctcagatctttagtcttagcttttaggacctagtgtttcattaggcagtatagtgtacaagaacatgagctttgcagataatgctcgttcagctcagaagtggatagaagcatttctggaaggcacaatattgtagcagtattggtttcttctcttctgtgattccagagaggtagaatttcatcagaatggagtaaatacattcaaaaattttataaaaatggccgggcgtggtggctcatgcctgtaatcccagcactttgtgaggctgaggcgggcagatcagttgaggtcaggagtttgagaccagcctggccaacatggtaaaaccccatctctgttataaatatgaaaattaggtgggtgtggtggtgcacgcctgtaattccagctctcaggaggctgaggcacgggaattgcttgaacccaggaggaggcagttgcagtgagccaagatcacgccactgcactccagcctgggcaacagagcaagactctgcctcaaaacaaaacaaacaaaaaaatttacaaaaatgaacactgccaagataaacccaaccaaactcttcatcagttataagaaattattttgttaggtatacgtagttttttaaaaatttgttttttcaagtatgttatttattaaaattttgatgtaaacaaaagcaaaccacaagctctggaaccagaagataggtgtttgaatgcctactccaccccttatcagccatgtgaccttgggcaagttgcttaatgtctcttgaccctcagagacaatctgtgaaaataaggctaataatagtatttacctcagggttgttatgaagattaaatgagatcatatttctgaagagccttataaggctgggtgcagtaactcgtgcctgtaatcgtagtgctttgagaggccaaggagggcaatcacttgagcccaggagttcaagaccagcctgggcaacatggcaaaactccatctctactaaaaatacaaaaattagctgggtatagtggcttgcacctgtagtcccagctactcaggaggctgaggtgagagaggatcacctgaccccgaggaggtcaaggctgaagtgagctgtgatcacaccactgcactgcagcctgggtgacagagcgagaccttgtctcaaaaacaaaaaaaaaagggtttggcgggggcagtggctttatagtgctttaaagaaagtcattatttgttcaccagcccttcccctaatgttgctaggctaaaatggatggaaccaggttaagctgaatctgttttcttatctctccaggtcatttcttcagatagctccccagctgtggaaaatgagcatcctcaaggtaagtttactgaagaaaggaaactgggcatgaaaacaatagcctgaccctaacaatgtcttcaacaatgcttttgaatctctcccctggaaaaatcaaagcagggccagataatgtgccaaaccacaaaaatcagtgacagtagtttggcaagatcacccaggaataaatcttgggcagagtggggatgattaatatcttcaattatcaaaccacttgagagaaacatctgaggtacaggcaaaacttccataggcaactctgggctggctaccatgttttagaagtcctgggtattttctgcatagtccagaaacagtgctaccaggattttatcacccagcaagctcactaaagccactgaatgtacaccaaaaattatgcaaagggcttggtgcagtggcttacacctgtaatcccagcactttgggaggccgaggcaggtggatcacttgagctcaggagtttgagaccagcctgaccaacctggtgaaaccctgtctctactaaaaatacaaaatcagccaggtgtggtggcgcatgcctgtaatcccagctacttgggaggctgaagcacaattgcctgaaccagggaggcagaaattgcagtgagccaagatcgtgccattgcactccagcctgggcaacaagagtgaaacttcgtctcagaaaaaaaaaaaaaagaaagaaaaaaattaggaaaaggctcttagaactaatctagtaatagaagcactaaacctctaaaatccagagcacagggaagacagttccaatgctggccagtgcctattttatgtttctgagtacatttgcattagcaccaaggcagaaactagaaactcaaattgcctacatggaccaagcagtgaagtgaactacatatgaaaagaaggcgacagctgggccgggcatggtgattcatgactgtattcccagcactttgggaggccaaggtgggtggatcacctaaggtcagaagttgaagaccagcctggccaacatcgtgaaatcttgtctctactaaaaataaaaaattagctgggcgtggagctgcatgcctgtaatcccagctactcgggaggctgaggcaggagaatttttagaacctgggaggcagaggttgcagtgagccgagactgtgccactacaccccagcctgggcgacagcacaagactctgtctcaaaaaactaaaggcagctgggtgtggtggctcacgcctgtaatcccaccacattgggaggccaaggcaggtggatcacctgaggtcacaagttacagaccagtctgatcaacatggtggaaccccatctctactaagtagaaaaaattagctgggcttgatggtgggcgcctataatcccagctgcttgggaggctgaggcaggagaatcacagaatcgcttgaacctgggaggcagattttgttgcagtgagccgagatcatgccattgtactccagcctgggcaacaaaagtgaaactccgtctcaaaaaaaaaaaaaggcgacaactatctaggtctggtcaactaagacctatttttgccagatcttcaagtctgggcacagtgtaacaccagcactttgagaggccaaggcaggaggatcacttgagctcaggagttcgaaaccagcctggataacttagtgagaccctgtctctacaaaaaattaaaaattttttgcactccagcctgggcagagagtgagatcctgtctcaattataaacaaacaaacactgagaaagccaaatccaatatgtttatgggcctgtggcctgaatgatagtatttaactatcaatgtagtgtatgtatcttcaactggtgtccaaagacatgttcttgggagtctgaattctcaagtttgaataacaatggtaggcttccagttaaagacggtagattggtagattgggctgcgcgtagtggctcatgcttgtaatcccagcactttgggaggctgaggcgggtggatcacttgagaacaagagtttgagaccagcctggccaacatggtgaaaccccgtctctactaaaaatataaaaattagccaggcatggtgacatgtgccgtaatcccagctacttgggaggctgaggcatgagaatcgcttgaactcaggaggaggaggttgcagtgagtggagatcgcaccactgcactccagcttgggtgacagagcaagactctgtctcaaaaaaaaaaaaaggtggtacattgaatatatattcccaaaaactcccctaaaaccaccataaaggaatttttttaaagaaaaagacacaaacacaccatagggaaaacaggagaggagataatagcaatgaatttttggaagctgaaaagcagacaaaagagtgatgaatgacttagacctgagaaaactgaattataactagcagtgaggaaagccaagaagcattgaaggtctaagaaacagtcagatcccaagacaccctaccccattgagtacagtgggcaactctgcctcccaactgtggcagagactggaaatctggcaagggactcgggcacagcttagggctgaagtactgcactgaaaacaggagcatgtagtgaactatactcgatgctgagcctccagccctttcccccttttcagtttccagagcgctggcagaagagccttcaccctccaagcatgaaattgaataatccttctctccagaatcctcttgaagggaagtcctaaaatatataagtattgaatgttccctatccaaatgactcactgtcagcaaggctcacttacacacttagagcttccactcagctttaaagcctccactcttaagttatggtttaagttctcctttaaactagggattaccaaacatctaaagaaaggatctgtgaaaaaaagtgatccaaactgccccccaccccactctggaatgtacctttgttttactctgaaggctgtatctccctggtaaaaaataaataaaaatgaaaaagcaaactgcctctcccaacctcatgtacacacagaagaaacaaacaggaaaaaagcaactggaaggaaaagatgagaagaaaactttaataacattaatataatcttagataaaggaacatatttctcaatacctgtgaaagtagtatatctttaaagaaaacaacagccgggcacggtggctcacgcctgtaatcccagcactttgggaggccgaggcaggcagatcacctgaggtcaggagtttgagaccagcctgcccaatatgatgaaaccctgtctgtactaaaaatacaaaaattagctgggcatggtggcatgtacctgtaatcccagatactcgggaggctgagacaggagaatcgcttgaacccaggaggtggaggttgctgtgagccgagattgcaccattgcactccagcctgggcaacaagagtgaaactctgtctcaaaaaaacaaaaacaacaacaacaaaaaaccttatttccaccatgaaacaagtataggatacaattttttaaagaaggaattttcagaaaacaaaaaggaactcttggaaattaaaaatatagtagcaaaaatttaaacccagctggaggtttcaaaaatcaacatgaggaaatttcccagaaaggagagttaaaaatcaacaaagtagaaaataggagagaaggtgcagtggctcatacctgtaatcccagcactttgggagactgaggcgggaggccaggagttcaagaccagctcagcaacacagcaagaccctgtctctacaaaaaaataaaaattagccaggcatagtggcatacacttgtagtcccagctactcaggaggctgagataggagaattgcttgagcccagaaggtcaaggctgcaggtgagccatgatctcgccattgtactccagcctgggtaacagaatgaaagcctgtctctttaaaaaaaaaaaaaaaaaaggagaggaaagattccaacaacccacaaaacaaacaaacatttaaaggatcagtctaggaggtccagtatctaaataggagtcatagaaaaagaaaaatggcaacacagagggaaggaaataattgaggaactaattcaagaacatttattggaacttgaggacattagttttcatattgaaaggacccatcgaatattcagcacaatggatgaaagtgacccacccaaagcacagtcatcctgagatttcagaacactggaaacagagatcctatgagttttcagagagaggaaaaaaaagtcacatacaaaaagtcagaattgccttggactctcaacaacaccagcagctagcaggcaatggagcaatgccttcaacattctgcaggaaaacacattccaagctttcctgcagattctctattcagccgaattataaatccaaggatgagggtagaataaagatatctacaggctgcaaggtctcaaaaacacatacctcccatgcaccctttctcaggaagctactggaagatgtgttccaccaaaataagggagtaatcaaaaaagataaaaacgcgatataggagcaccagtagaggacagacgtgaaaggggtacccaggatggtgatgaagaaagatcccaggatgacagcagtgcacaccagacaaaccagcccagatttgagcaggtcagaaggctccagggagatttctttgggtagtttaaattttgatagactgtctaatgcttttgaacctcttaaaaggagatttaaatagttggtgaagcatttgggggttggattagttataagaattatacatagaaaattaaacaaaaggacaagacattaactccaggtaaaacaaagttgtgaaggaagaaaaaaaaatcagagtttactatttggcttatctctgaataataaatattcagtcaaaatgatttaaatactggccgggtgcagtggctcattcctgtaatctcagcactttgggaggccaaagcgggcagatcacatgaggtcaggagttcgagatcagcctggccaatgtggtgaaaccctgtctctactaaaatacaaaatttagccgggcatggtggcgggcacctgtaaccccagctacttgcgaggctgaggcaggagaatcgcttgaacctggaaggctgaggttgtagtaacctgagatcgtgccactgcacttcagcctgggtgacagagcaagactccctctcaaaaaaaaaaaaaaaaaagattgaaatacggatataaccaacattatggtttagctcctggaataatgaggagaatgggaagtacgtgtttgtggtggagtcctagtaggagagagaactagaaattctcatcttctttggtagatagatgataaataatgccccaaaatgaaaaaaaaaatggaaactagcaatacaagcatgttatttaaggacatagaattaagtaccaaaataatcaactaaggtagatagatgttctcatctctggggaagggtagtacagggaggtgggttgcaaggagtgcaattttttcttaacaaaatttgtaaaactgttggactgatttaactgtgtgtctatataactttggttaaaaaaataaatattaaaaaccaaattgattaaagacttaagagcatgaagtttggaaacagatctgggtttgtttgagtctttcttgccacttattaatggtgtgaccttgagcagtttatttaactacacctattttctcatctgaaacatgaggacattacttacacatttgttgtaaggattaaattatgtaattttttttttttttttttgagacggagtctcactctgtcgcccaggctggagtgcagaggcacaatctcgtctcactgcaacctccacctcctgggttcaagcaattctcctgcctcagccccctgagtagctgggactacaggcacgtgccaccacgcctggctaatttttatatttttttagtagagacggggtttcgccatgttggccaggctggtctcaaacttctgacctcaggtgatccacccaccttggcctcccaaagtcctgggttacaggtgtgagccaccacgcccagccaatgtaatttatttatttatttatttatttttttgacacggagtttcactcttgttgcccaggctggagtgcaatgttgcgatctcggctcatcgcaacctctgcctcccgggttcaagcaattctcctgcctcagcctcccgagtagctgggattacaggcatgcgccaccatgcccggctaattttgtatttttaatagagacagggtttatccatgttggtcaggctggtcttgaactcccgacctcaggtgatcctcccaccttggcctcccaaagttctgggattacaggcatgagccaccacgcccagcctcaatgtaatatttttaagtgcacgtagtatagtatgtagcacattcaagctattattttgggagattacttccctagtttagagcaagcaattaaaatcacaggaatagaaaaaggtaaactagccaggatctcccatttgtctagagtaggtgggatgatttctgatttacagggtgatcccagaatggactatcagggtgttttgagccaggttgattgagcactgggctccaacttattgttaatgagaaatggcccaacttggaccatgactttcccatttgcaggtcttagaataattttttttttaattgagacaggggttcgctgtgttgcccaggctggcctcgagctcctgggttcaagtgatcctctgcctcaacttcctgagtagctgggattacaggtgcttgccaccatccccagcacagtcttggaagaattttaagaagcttacttcattgaaaaaagaggaaagtgaaaatgtgctaagtatatgaaagggaaagcttggattaaagatgagaaacatttttagactataacatgttaaagagagatactataggctttatgttttagtcaacttcttttacctatagggaccaatagataaagtcttaacctggagacaggggttggatgaaatggtttctaagaggtttatccaggttttgtggaaacaataggaacaagacagataaaataaggggtcttattaaaaaataatgctctaaatatttgagatactagaacactattttgttttctgtctcttttgattgggagtttttatgtggaaggaagctactaactatcccaccctatgcagagaccccagaatccaacaatagcgtgtatacttccttcatgaagtctcatcgctgctatgacctgattcccacaagctccaaattggttgtatttgatacgtccctgcaggtgggtgaaatcctcttttcccttccccctttggagcctgtggtttaatacctctcatcctatctcatcctaagggtaatatccttatccttctgtgaagttagtctcatgttttacccaacatgcccaaacactgttctttttttacagtcctgcccctgtggatttgcctttatgattattactgtcttggctacaggtgaagaaagctttttttgctttggtgactaacggtgtacgagctgcccctttatgggatagtaagaagcaaagttttgtgggtaagcaaaagtttctggaacacaatattattggcatcttgtgctgggcagggagacaagcttcaggcagtgctgagggctctgtcttgtcctctaggcatgctgaccatcactgatttcatcaatatcctgcaccgctactataaatcagccttggtaaggaaccttaacccaatgaccaaaatcactttccctgccctaaatccctcattctcatttctttttctccaagcaagccacgagggcttaaggaagcagagagatcaggtctcaaattctgttgcttctgctttcaggtacagatctatgagctagaagaacacaagatagaaacttggagaggtatgtagagaattggggttataaaaggataaagggatggcgggtttctgggaaacacttttccatggtggtattttgtgacccatcccttttcccttcagaggtgtatctccaggactcctttaaaccgcttgtctgcatttctcctaatgccaggtgagttccagttacccatctgtccaaaaagcggaagagattttgtcatcagcctagctaatgccctagacacccagggaaaggggaagaagagagaaaagacacacacacacacacacacacacacacacacacacacacacacacacagtctctctctctctctcattctcactctctctctctctctctttctctttaagtctggcctgtacactgccccccttccctaaccatcagttttccctgttgagcaatacactgtatggacctgtttaatcacccccagccccagcactgtggaacttattatctcccaccctctcacagcttgtttgatgctgtctcttcattaattcggaacaagatccacaggctgccagttattgacccagaatcaggcaatactttgtacatcctcacccacaagcgcattctgaagttcctcaaattgtttgtaagtgctcctcagcccagttcttttttctcttttttcattgattgattgattgattgattgaaaagagagacgaggtctcactgtgttgctcaggctagtgtcaaactcctgagctcaagtgatcctcccgcctcagcctcccaaagtgctaggattacaggtgtgagccactgcatccagccccacttcttatttatttattaatttattttgagacaagttcttactctgttgcccaggctggcgtgcagaggcgctatcatggctcactgcagcctccaacctcttggtctcaggtgacccccgacctcaacccccagaagagctgggactacacgtgtgtaccaccacacctggctaattttttggtattttttatagagatagggttttgccatgttgcccaggctggtctcgaactcctgggctcaagcaatatgtccccctcagcctcccaaagtgctgggattataggcataagccggcgcacccagcccttatttctaatatactgggttggagggggtatccaagggtggctttgggtgccttgaaagttaagctgatggttctttcctcagatcactgagttccccaagccagagttcatgtccaagtctctggaagagctacagattggcacctatgccaatattgctatggttcgcactaccacccccgtctatgtggctctggggatttttgtacagcatcgagtctcagccctgccagtggtggatgagaagggtgagagattgggcagaaggagagggagggaagatccaggcaagtcagggtggctctgggaagatctgctttcccctcagcttagccaggagggtgattctatgagtagggggagctttagatcccagatcctccttactgagctgcctctgtccccctagggcgtgtggtggacatctactccaagtttgatgttatcgtgagtgattgtggagggtctgggaggtagggaagtggtggggggggggcactgttaaatatggagagggagaagggagtctcttctgtgatctaagggtcttagaagcttccaggctttcaaatcctatttgaaaaggaattgaatgagttgggtgtggcttgtggctgacaattgccctgaatccctctgttgaggttggatgggttcagggtttggaggctggctctcttgcttccctgcaagctccttcctctgtctccccagaatctggcagcagaaaagacctacaacaacctagatgtatctgtgactaaagccttgcaacatcgatcacattactttgagggtgttctcaagtgctacctgcatgagactctggagaccatcatcaacaggctagtggaagcagaggtagggaggccagcaaccctaaaggagctgaggggagcagccttgagagtggggtttggcaaggagagtaggggcagaggggcttcccctgaggccagcactaaacattccctttctcccttgttgctctgtgccaggttcaccgacttgtagtggtggatgaaaatgatgtggtcaagggaattgtatcactgtctgacatcctgcaggccctggtgctcacaggtggagagaagaagccctgagctgggggaaggggtcatgcagcaccaggggatatgcccaactcactgcctgctggaagctctgtgggaatcagatgaaacttgagggaattgtgactctgttccctgttcagggtcccctgcccttctatctgggagctagggaaggtatgggggaggaaagagaatggatttatagctacccttaccctcacacatacacttgaaaaaactttcagcctagccagttctagcccctgtcctcttagatatatccccctttctgggtgaactataggctctgtgcctctcagacaaattctgatctctaagagatccccagacctcacttgcctctgcctccatcttggccctgattcaaccctaagataatagcacaacaaaattcttcataaagatatttttattcacctgttccgtgctatatggaggaggccaagtccatttagtgacatttcttcccataatgtgagtggggaggattgtggggaggaggggctttgggttcctgtgtttgtgcatatgaagggagatgggggttaggtggaggaggagagcagcgtggttagctaaggttattgctttttgtggcaaatctaattaaatgacaggaatctcttcacgat

SEQ ID NO: 35986 - DNA, 35576 bp, Homo sapiens
gagcaagatggcggcgcgagtgctgcgcgcccgcggagcggcctgggccggcggcctcctgcagcgggcggccccctgcagcctcctgcccaggctccggtgagcagcgccgcccttcccgggaggtgccggggaggggccgccgcgaggcggagggcgcgggtttcccggcgccggtctccgccccggccctgtccccagcgcgggtggctgcccggcctcggggcagtggggccggagctggggtggggccggagctggggcggggtcggggcgtcctcgggctcaaggtcacggaggggacgggccgctctgcggctccaccctcgcccgggaaggcccccgaggcttggcccggaggccacatcctccccgcggcgctggcccggcctgcagggccctgaccggcgcgacccgtggccagggacagggacagcgcgcgcctgaggccgcaggccccggacgccgtctgctgggtcctcgccggaggctgttccaagcctgagtggctgcgtctgccgaggacgttggtgaccctggtctctgaggtgccgggagtagggaataaaagagtaaagcattgtcccgggccagctctccgcggagcgtaggggaagttagagcttggaggaggtcaaatcacttaacgtcttggagttgaaatttaaagccggccgtggatctaaaagtacttagagttatcagcactaagttcaggcgtggggctcttgtttaaacttttttttttttctaacttcagtggattggacgtttggttgtccaaattcatcaccttgatatttgcatgtgctgttttccacattcaaacagcaaagcctatcctgacttacccagagttgctttctcgtattcattgctttgggtagtttaaattacctaaggaactgtgtgttaaactcgccatgggccagggaggtttcagtaacatggtttattattattattattgttgttgtttatttatttatatttttgagacggagttttgctctcgttgccccggctgaagtgcaacggcacgatcttgtctcactgcaacctccgcctcccgggttcaagtaattctcctgcctcatcctcccaagtagctgggattacaggcatgcaccaccacacccggctaatttttgtatttttagtagagacggggtttcaccatgttggtcaggctgatctcgaactcctgacctcaggtgatccacctgccgcggcctcccaaagtgcagggattacagtcgtgaatcaccaggcgcggcctgatctttttaaaaagatgagtctgacttgggagagggggcagaattaagggtagtggccagctgagtggaccctggcactgagagttgagagtttgcagagagctgttctgccaaaatgtgagtgcctaccacgtgccaggcactgttgactgttgagagacatcagtgaataaggcgtccaaggccatccggagcttaccagtaattcaggagggctggggaagaagaattcagagcagtttaggacctggtaaagtttgtgaaggctgtgtgctattcaagtggaaacgcaaacagacagttggcagtatgactcctcaaaggaggtgtctgggctacaggtaacatttaggagttgtcagtatataggaatgctaaatgttaatagacacatggatttcattatactgtttcgtatttgatttacgtttttcataataaagcctggacgcagtgactcacacttgtaatccctgcactttggaaggttgcggcaggaggattgcttgagcccaggagtttgagaccagcctgggcaacatagtggaactctgtccctaataataaataagtacataaataaaaatttgtataatgaaactttttttaaaccataggaagccgggtgcagtggctcaggctgtaatcccagcactttgggaggccgagctgggctgatcgcttgagctcaggagttcgagaccatcccaggcaacatgacaaaacacatctctacaaaaaatacaaaaattagcccggcatggtggcacacgcctgtagtcccagctacttggtaggctgaggtgggagtatggcttgaacctgggaggtggaggttgcagtgagccgagatcatgccactgcgttccagcctaggtgacagagccagaccctgtctccaaaataaaacaaacaaaaaaatataggaatgtgtgagattgcttgaggcgagagtgtggagagagaaggggctgcaaagcaagtcctgggatgtgcagcgtatataggctgaatgtaggagggggagctggcaagctcattgttatgtggcagtggccaggaggagggagggagtgccatccgctgccaaagtgttaggtaaaatgacagaagaaaacaggatttgctgaatcagtttcagcaagggagaagggcgtcctcccgggagcctcatccctgcctgtacattagccagcgtatttcacttagtgctgctcagcagcaagcttggaattcccagccgcttcctggacattgcataagtgtctcacaggtgcttaaaacactgctgtacccaggatttaactcctcttccttctgtgaagcctgcttttctttggttgttcttctccagtcatgaaacattttccatgtggtggcccaggccagacaccagatggtcttccccaagcccatccctctttttcccgccatctatcatttaccaaatctgtcagttctgcctctagtatgtcttgaatccaccctctccatcttcactgccctagctcaaccctcagcaatactcgtctggattcctacgaagagtgtgggctcgaacctgttagtgaaggggatgactaaagaatttttttttttccttggagatagtcttgccctgttgcccaggctggagtttaatggcatgaccacggctcactgcagccttgaccttccggacttaagggatcttcccacctcagcctcccaagtagctgggactacaggcccacaccaccatgcccagctattatttatttatttatttatttatttatttatttgagacagagtgtcactctgttgcccaggctggagttcagtggcgtgatctcggctccctgcaacctccacctcctgggttcaagcagttctcctgtctcagctacctgaacagctgggacttacaggcgtgcaccaccacgcctggataatttttgtatttttagtagagatggggtttctccatgttgcccaggctggtctcaaactcctggcctcaagtgatcctcccaccacggcctcccaaagtgctggcattacagggatgaatcaccacacccggctgctaatttttaatttttttgtagagaggggggtcttgctatgttccccaggctagtctcaaactcctggcctcaagcagtcctcccaccctccgcctcccaaagttctaggattataggtgtgagccattgtgcccagccacacgtctaaagaattctaagcggacattttcctagtagaaagatctctatgacacaaaccttgactggttcctaatccctcctccctgtctgcccccattcccctacccacaagagcaatgaaagacattttggggagaactggggatattttaatagggagtggatattagatatgatggaataattgtttttctcagatgtgatgatagcattgtagttctgtcattgtgttttggaggtacatgctgaaggatttacgggagaagtatcattatgtccaaactctactttcttttttttttttttttcctgagacagagtctcgctctgtcacccaggccggagtgcagtggggtgatctcggctcgctgcaacctctgcctcccgggttcaagtgattctcctgtctcagcctcccgattagctgggactacaggcgtgcgccaccacaaccagctaatttttttgtatttttaatagagatggggtttcaccatttggccaggatggtctcgatctcctgacctcgtgatctgcccgccttggcctgctttggtctcccaaagtggtgggattataggcgtgagccactgcccccagcccaaaactctactttcaaatggttcagtagaaattaaaaagcaaatatagggccgggtgtggtggttcacacctgtaatcctagcactgtaggaggccaaggctcacggatcacatgaggccagaagctcaagaccagcgtggacaacatgatgaaaccctgtctctactaaaactacaacatttagcagggtaactacaacatttagcagggtgtggtggtgcagggctgtagtcccagctatacaggtggctgaagcaaggtaattgctcgagcgcaggaggtggaggctgaagtgagccgagatcgcgccactgccctccagctgacatgagagaacaaggccctgtctgaaaaaaaaaagaaaaaaagaaattaaaaagcaaatatatatagagaaaaacttttaatggtaaaatgttcatttttaaaatctagatgcagggcagaaaagtcttgtcatgtttaaactcctctgggtttgaagtttctggaaatgaaaggtgtgggaacaggtctctggagcagcagtgtggaagacggggtactggggctggatggagtgtggtggtggggaggggagtcagggagctgctgctttaaggcaggagtcttcttggcatgggtctgtcaacctcttctctcccccgggtctgtgcttccaaatgctggtgctgtttgcacacttgtgtctttggccttcactggttctgcttagaatctcccttccatgggtatctacctgaccatctgctcctcttctttccagtcttccactcaacaggtacttcgttagagcaggcccccaggctgcccttacccatgccacaacagctacctacttccttgtgtcatcattgaagagcttgtctgtttgagttgtgatcgtgtttgtctgtctgccctcaccagcaaactgagctcccgtgaagtcagggccaggttcatctgtgcatcgtcagtggctgacaggtgtagtgcacagtctgtaaataacagtgatcatattgccgggcgcggtggctcacgcctgtaatcccagaactttgggaggccaaggtgggcgaatcacgaggtcaggagatcgagaccatcctggctaacatggtgaaaccctgtctctactaaaaatacaaaaaattagccgggcgtggtggtgggcgcctgtagtcccagctactcaggaggctgaggcaggagaatggcgtgaacccgggaggcggaacttgcagtgagccgagatcccaccactgcactccagcctgggcgacggagcgagactctgtctcaaaaaaaaaaaaaaaaaaaagatcatatgaatgaagcacggtgtgctcctgctgcctcatcctgtggtctcagcgttaagtcctttcccttcttcagtttcctcttccccgcctgatcagcactcacaagcttcttctgaatgcactcctttctcttcatccccactgccatcttaaccccagaccatctagtgagtatttattgagtgccttctgcatacctggtgctgctgggcatggcagccagggtgcccaggaagcatgttcctggcctttgttgctgcagccatataccacgctcctgccaggctgcttttgacacttagatttttttttttttttttgaaacggagtcttgcactcttgcccaggctggagagcagtggcgtgatcttggctcactgcaacgtccgcctcccaggttcaagtgattctcctgcctcagcctcccgagtagctgggactacaggcgtccaccaccacacctggccatttttttggtattttttagtagagacagggtttggccatgttgcccaggctggtcttgaattcctgaccccagatgatccgcccacctcggcctctcaaagtgctgggattacaggcatgaggcactgcgcttgtccgacacttatattttttttgaaaacttgacagcatctcaccctacacagaataaagtcgccctcgcctcgccctcacggtcctcccacatgctcttctgccttgctaaacagcttgccattccagacatatgccattcagtgtcatgactccatgtccctgtacatgttgttcccattgactggaattagcacctgccttctccacctgtcttgcttgccctccaaaacagagccagagtgcccctactggagtccctcctgcacctcccaggccaagctgatggtgggttcacttgagctcttgcagtgtatgtctaagtttacagcatctgtggccactctggctgtttactgataggtttttcctgtgagactgaataggcttggcatctggtttatctttgtatccatagagcccggcatagaatgctgacttgatttcaagtctagtgttttgtatagtgcacccttccttatcctctggaaagtgccccctaccatcttggcgattgtcactgtcagttaagaacccaggcccaagccagatcttatcatttgggcagccgttggcatagctgcgactcgaatgactagataggttgggcatgttaggcagctttggtcacctgacactcaaagatttcagtttgacggttgggggtagtactggccggcttgtttttcatttgtcaagacgattgctgcccaagttcacaagcaaatgccactcaggttcttttgtgtgtgctgtgttgatttagtctcaccccctgctctgcatttttcgattactagcattgtcacatcccttacctcattgtacccacccaaaggggaatccctttggtattattatttgtttgtttgttttagaggtggtcttgctctgttgcccgggctggagtacagtgcatgatcatagctcactacagcattgaacttgtgggctcaagcgatcctcctgcctcaggttcctgggtagctaggaccataagcacgagccaccatgcccagctactctttttatttttttttgtagagacagggtcttcctatgctgcccaggctgactttggtgtttctgagatatgaaataaatgctcagttggggtgatttttatttcaaaggcatcctttatcagtgaaaatattatctgtctataaatatacataatatatgtttgcctctgtatttctggaaggatatacataaaactattagtagtcattgctttagtatttcttattttaagtgaaactccctagtcagtatttttagacactttttattatatccctttcttaattgttcataattgttattcctaagcttttacaatttatttaacaaaaaaaattgtagacacaatttctgtttaatgaacttaaaatctaaaataaacacagaaattggctgggcacagtggctcacacctataattccagcactttgggaggccgaggcaggtggatcacctgaggtcaggggttcaagaccagcctggccaacatggtgaaaacccacctctactaaaaatacaaaaattagatgggtgtggtggtgggtgccgctagtctcaactgcttaggaggctgaggcaggagaatcacttgaacccaggaggcggaggttgcagtgagctgagattgtgccactattgccctccagcctgggcaacagagcaagactctgtctcaaaaaaaaaaaagaacatacagaaattacatagtcccataaacaaatcttaaaactttctactttgtgtatcactaattttatatggttgccttaaagtaatgcgtaagtttcttttttctttttctttttttttttttttgagacagagtttcactcttgttgcccaggctggagtgtagtggcgtgatctcggcccactacaccctgcacctcccgggttcaagcgattctcctgcctcagcctcctgagtagctgggattacaggcatgcgccaccatgcctggctaattttatatttttagtagagacggggtttctgcatgttggtcagtctggtttcccgacctcaggtgatccacccgcctccttggcctcccaaagtgctgggattacaagcatgagccactgtgcccagcccatgatattattaaacagatatccctaaatgtagtgtacgtaaaacacttcaaactaattgacaaaatgtgctttcatttttattggaatatggctgggtgtggtggttcacgcctataatcccaggactttgggaagctgaggcaggcaggtcacttgagctcagaaattcaagaccaacctgggcagcatggtgaaaccctgtctctacaaaaaaatacaaaaattagttggatgtggtgctgggcacctgtagtcccagctacttgggaggggttgagacaggaggatagcttgaacccgggaggtcgaggctacagtgagccaagatcacgccactgcactccagcctgagtgacaaagtgagaccctgtctcaaagaaaaaaaaaatacagaagagaaaagcacaatatagacattatatggagaaagctgtgtgtctttcccctctatccctttaaaccattttctcagggaaaccaccattaatgctttcttaatttttaggaatttttatatatagtaaacacaaattggaagcatcttcaacttacatctgcaaatgccacttaatactatatgtttttatctttcaagaaaaattgcatttactggtattgttattttgcttgtttaaagtgagtttgcttctttttaatctttgaaggatgtgaaaacgtgcttttatatttctttataattatttatagagcacattttatttttaatttattttattttattttattattattactttttttgagattgagtcttgctgtgtagcccaggctggagtgcagtggcacgacttggctcactgcaatctccacctcctgggttcaagcgattctcctacctcagcctcctgagtagctgggatcacaggcgtgtgccaccacacccagctatttttttttttttttgtagtgttagtagagacaagatttcaccatgttggccaggctggtcttgaactcctgacctcaggtgatccacctgcctcggcctcccagagagctgggatttagaagcgtgagccaccactcccggccaatatatttgtatttgtaagttcacatcattcaaaaatctttatatctggtttctacctatttgagacaatatcctatgaattggtttttaaattaaaagaacatcatattggggagaagattgctctgtaatgtttgttcaagaaagcagcaaactaggctgagtgcggcagctcacccttgcaatctcagcactctgggaggctgaggctggcggatcacttaaggccaggaattcgagaccaacctggccaacatgatgaaaccctgtccctactaaaaatacaaagattagccggatgtggtggcatgcacctgtagtcccagatagtcaggaggctgaggtgggagaattgctggaacctgggaggcagaggttgcagtgagccgagattgcactactgcactccagcaagtgcaatgagaccctgcctcaaaaataaataaataaagcagcaaactgattttttaagcaaaaaaaaagaaagaaagaaagaaagaaaaaggctgccagtatcatgtgaaatttagagccctacttctaaaataccgttgctgcataagaataggaatttctattattgtagtatgaaatccatgtgttcatttcatgaagtactggggaatttgctctcatgagagtttttcttgtcccttgtttaaattcctggtccccctttttaatacctggagttgctctttcttttcctcttaatgtttacctggtggtatctgggtgcttaagcaagtctaccaagcagattagaaatactattgtagaaggctgggcgcagtggctcacgcctgtaatcccagcactttgggaggccgaggcaggcggatcatgaggtcaggagatcgagaccatcctggctaacacggtgaaaccccatctctactaaaaatacaaaaaattagccgggtgtggcggcgggcgcctgtagtctcagctactcaggagggtgaggcaggagaatggcgtgaacctgggaggcggagcttgcagtgagccaagatcatgccgctgtactccagcctgggcaacagagcgcgactctgtcttaaaaaaaaaaaaaaaaaaaagaaatactgttgtagaaaatcatctagtgtttctaaagagatccccaagaagaggttcacactggcccatcagcatctggacttttatgtccagaagcactaagattctggacatttatgctggccctttggaatcccagtacattactgatctaggaaaaggcagaaaagatctatgtgtaggtcagttggagagcaaaagtagctgggcatggtggctcatgctcgaaatctcaacacttcaggaggccaaggcaggaggatcgcttgaggccaggagttcaaggccagcctgggcaacctggcaaaacccattctctatagaaaatacaaaaattaaccaggcatggtggtgtgcatatgttgtcccagctaatctggaggctgaggtgggggaatcgtttgagctctgggggtcaaggctgcagtgagccgtgatcacaccagtgcactccagcctgggcaacagagtaagagcctgtctcaaaaataaaaagagaacaaaagtataaagggtatgctgtgatagacctggccagaggtaagatcaccaattataaaagggattgtgcagaaagaaggggcaggaattcagaaggctacccttctgtatgattccatacatacgatgttctagaaaaggcaaaactgagggacaaggaacacagcagtggttgctagagatggggagaggggttgattataaaaggattaacttcaaggggtgaagaagctgttgtgatgctggttacattactttaggcatttgtcaaaactcagtactgtctgccaaaaaagtacattttattgtacatagatgtgaaaaaccaagaagatgagggaaacgctgtttgtcatttgatcatggttacataaagttcagaagagggctgagcgcagtggctcacacctataatcccagcactttgggaggccgaggtgggcagatcacttgaggtcaggggttgaagaccagcctggctaacatggcaaaaccctgtttctactaaaaatacaaaaattagccgtgcacggtggcacaccatgtagtcccagctactcaggaggctgaggcgggagaatcgcttgaacctgggaggtggaggttgcagtcagctgaaatggtgccactgcactccagcctggcaacagagcgagattctctcaaaaaagtgtgtgtgtgtgtgtgtgtgtgtgtgtgtgtagaaattgttcagatagttcagaaggttatacaatgaaaagaaaaaacctttactcccaccccaggcccagtcatgttccccagatgtcatcaccctttaacagctcactctgtatgtgtatatatagtgctgttctgtgccggcttttttacagaatttatcttggagatgtcagcacatcagtgcacataaatctacctcattctttttatcgagtgcatattttctgacggggagtatttcctaatttacgtgaccagtctgcattaatggctattcaaatggcctatgccaggagataactggaaacaagacagcaatgaatatttgtatgcattcaactttgtgcacctgtctaaatatagctggccgtaggacataaccgcaagtgtcattattgggctgaagtcatacacagtttccattttgatatggatgatgccacactgccctcttgggaggtcaacaaatttgtattcctattagctggcatatgggagttcaacatgcacatagatatttgtgaagtagggccaattgcagtggcttacacctataatcccagcactttgagaggctgaagtgggagcattgcttgaggccaggagtttgagaacaacttgggcaacatagcaagaccccatctctacaaaaaatttaaaaaaattaaccatgcaagatgacgtatgcctctagtcccagcttctcaggaggctgaggtgggacgatcacttgagcccaggaatttgaggctacagtgaactacagtgagctatcgcaccaccacacaccagcctgggtgacagggcaagacccagtctcaaaaaaagaaagaaaaaatccatgagtaaagtatagtttgtgacttgagtcaaatttatcctcactttctgaaagcattcacaatagaaatttaattatgagatgaaaattagcaaattatgtgttaataaagttggtattctgaggtttgtgggggcagttaaaaaatttttgatttttaaagttaatttttacaaatcttgattttttttttggccaggctcggtagctcctgcctgtaatcctagcactttgggaggctgaggcaggtggattgcctgagctcaggagttcatgaccagcctgggcaacacagtgaaaccccatctctactaaaatacaaaaaattagctgggtgtggtggtgtgtgtctgtaatcccagttaccctagagggtgaggcaggagaatcgcttgaacctgggaggcggaggttgcagtgagcccagatcgtgccactgcactccagcttgggcgatagagcgagactccatctaaaaaaaaatttttttttgatttttaagttacttgaggggtaaattttttttaaagaaagaatgtatttcattttccttgtatttttaaaatatttttattgtggtaaaacatatatacataaaatttgccatttaaaccatcttaagtgcataattcagtggcattacttatattcacattgttgtacaatcatcaccactatctgtttccaaatcaaataatattttttaaattgtggcaaaatgtacgtaatgtaaaattcaccattttaaccattttaagcatacagttcagtggcattaagtagattcacattttggggaaacatcactaccattcatcttgagaatttcttcatcttcctaaactgaaactccttaccccaacctcccctttcctcacctcctggcaacctccgttctgctttctgtctctgtgggtttatctactctaggtatccatgtatattttttctgtgtcaaaaattgctttgaaaaacacatagtgcaaattgcaaagataaatgtgggctctcttataggagtgccacacattttacatttttctttgcttctgcttcttggagtgcatgctgttgtcatggaaagcaggcattctttggtagcccaggttctggaacggtgcctagaatagctgctcactgtgtttgccagattaactgatggatatatgaaaacagtatactgcgtgacaacacctttgttattccataggacatggacatcttccagcaacagatctcgagaagacagctggctaaaatccttatttgtccggaaagttgatccaagaaaagatgcccactccaatctcctagccaaaaaggaaacaagcaatctatacaaattacagtgtgagtgacaggtttgctatcttcatagttgactttttttcccctttgttcctaagtttatcgttgaattttcttttgtttcagttcacaatgttaaaccggaatgcctagaagcatacaacaaaatttggtgtgtataccaaactatcctttacttggggaaaaataatgactttatttgttagttaattccactaacacttgatagcatagagagagatctttcatccctctcttttgaagctgaacattcagaggctcttaaactgagcttcatgtgggattgccgaaggcgttttgattttaagcactcacacagctaaatcatcatataggctatcagactttagaatgttaccagactcttgtgtttggaggaactttgccaggctgtctagtccatctacttatccagtgctggagtcctttccacagaccttcctgactgcctgtcctgaagtaagttccatctctggacagctctgagtgttaggaataagaattcacatctctgagtccttcattgattcccctaagtaaaactgccctgtgagagtcctgtatgtatttgaacatagctgccatttcttcccaactcctctgttctccaggatccaagtcccttccgctgattctcctatgatttgcgatctaaacctgcttacagaatttgtaaactttaagacgaaaggggagaactaagcttaccagcttttaagttaacagaaatagtattttaatgacccatggtgagcaaatgtgaagaaaaaggtttttagttttgttttgtttttacctttaatatctactacgttcttaagaaagcaaacaattttgtccctataatcagcatactttttagaagaaaaaccttttgttttttattgttttgtttttgaagatagcttatgaaatgtaacaatagcattgaatttcttgctcattccagcacatttctctttattaaaaaatgcccttaaaacaaagcagatgtttatttctaagtcttttctcataaaaatggaatttttccctatgccgatgttgtcctggattaccttttttgtcctgtcttatcacttcgtctcctgtctcgggtttctggctgtctgttcctatttctatttgatgttgtgctctcacttcacacccagcatgtagaatcaccttgctcttccaacttccctgtctgtgccactcaccttgttttactcagcccgttccttagttctctgtggtgaatctgtcacctaagctgtgcattcttcatcggacatgtattttggttctcttgtttccttctccatctctctctccaagcctctcgagccccattcccaagtagctttttttctgactacctttctgggctccaagctatacctgtgtctccttcctgccctgcaatacattaccccaaagtttgtcagattgatctgcttgagttctgttttcttttttcatcacgttttttcttttctctgaaactttcagcagctccctgtttgcagaacataaagacttaactcctgcctggtttttaggggtcccaataatgggattctgcccaacccatccagttctgggtacaagtactgcctgccttacaatctccattcaggtaaggccagggctcctaagagcaggtttggggtccccagcaaagaggagtggctacaaatccatgcgtgactttgtgttggtgaaaaacctgggccccgttgccaggcccctttctggaccccacctgaatcatgtgtactgggcttcctcctgggcactgcctccaatgcagggttgtctattcctgctcatgtcatgcgacgaaaaggaaatgttggacatacatttccctagcagaatccctctttccctgtcctcgattttcattgatcccatgttatttctgaacattcatgagtcacgcatcagatacatttaatatcagatcctaatttaaaaagtaaatgctactcttccaaaagtacacatgatgtggtcactatactgggtcataaagatgtatgggttttcagttagttagacttagaccgttttggaacttttctctgttaaccatttatgtatccctggtcgtatggagctccagtggtgcagtcggttagcacatggtacttacatacccttggtcctgtagccccagcatctggtggtgatcactagctaaatatcagagtcagcaaatagtgtgaacaggttccatttcttgcccttgatccccttttgcatccattgttgaatctgtatgatactttttcatcataatttttctattcaaaaagtgtgcaggttttagcttttctcttggtgtaaaacagttacactcttccctttgcctttccctgtacattagaatctataccataggaaagcttccatggaaccaagctccactctgacacccctgttaaattcatacactgccgtgacctgtcatggctttgtccctgtccctgcacaatgcgcgggaatgaattggttggtgtgttcggtgcgagactacgtgacacccctcccatccccttggcccattgaattgagtagaacataatttatgcttcgcattgtatctttaatttttattcttctgccatgttgatgcccttggggagtattggaggttggagtcgcttccagactatgttgtgttccagctgtcttcttgctccttcctgaaggccagcttgttctctgctcctgttacctctgcctgctggtactgcttgtgttgtctgcctctgtcttgaacattactttcctccctttccatcttccttatttcttctgtgttcttttctactattccccgtctctcattcttctgtctttggaaccaacagaatgttttttggtgatgtcgttttttttcccctcaaatggaaaatagtagacccatagctcccaaaatcctgggacctttggtttttctttatcatcattatactgattgaacaactcttctagatagttggggtatcagaaacctaagcttctgatcagcagggtgttggaatacaacataattcagctaaaaggttaactccacatgccgttttatcatgatgttctaaggtcagttgttagaacacagagtaggtggtctttttcctgttactgatcaggtgctgtccacctggtcaaattttgctggttgtttaattagtgttgctgtttcttctctttaagtcaagaggtgttgccaaagattcacgaagataaacactacccttgtactttggtggggacttggaacacgtggtatggcgagcaggaccaagctggtaggaagcgaagtctttggaataaacacttcttccttaagccttatgtaacacttaagtaattttctaatttaatgcttgttcttatcatcaaagctttccaagtctcagtctaattttatgattaaagtagtttcttcaacaattcattgcgaaaatggttttaaaattgtttttaatgtttgaatctattattgaaccattatgatgtaactcataggccaaaacatggggcattacagtttttttgttttttgagacagagtcttgctctgttgcccaggctggagtgcagtgatgagtatctaggctcactgcgacctctgcctcccgggtttaagcgattcttctgctttagcctcccaagtagctggaaatacaggtgcccaccaccacacccaggtaatttttgtatttttagtagagacagggtttcaccatgttggccaggctggtctggaactcctgacctcaagtgatccgcctgtctcagcctcccaaagtgctgggattacaggcatgagccaccacacacccagcctacagttttgtgctgtgttaacgttatacctatctagaacattttcaagtagtagtatcatgaaattctaaacgtatactgtcttttaaaatgcatttcagtccacctctggaggtatgaaggaggctatccagccctcacagaagtcatgaataaactcagagaaaataaggtaatgatattgaaaaatgtttacttagactaatgatatatagatgttagtacagaattaaatgacttttctgtcttcagtttttgttaataaacttcatttttttgtaacagaaattttattgtttggactcctgaagttgtatttaaacataaacagttgtaatactattcaaacaacaattctgaccgggcgcggtggctcacgcctgtaatcccagcactttgggaggccaaggcaggcggatcacaaggtcaggagattgagaccatcctggcttacacagtgaaacactgtctctactaaaaaaaatacaaaaaaattagccgggcttggtggcaggcacctgtagtcccagctactcgggaggctgaagcaggagaatggcgtgaacccgggaggtggagcttgcagtgagctgagattgcgccactgtactccagcctgggcgacagagcaagactctgtctcaaaaaaaaaaaaaaaattcttattgttcttattataaaagtcaattatgctttgaaactgataaggtggtactttgaaaccggtgactgggctgggtgcggtaactcatgcttgtaatcccagcactttgggaggccaaggcaggcatatcagttgaggccaggagtttgagaccagcgtggccaacatggcaaaacctcatctctactaaaaatacaaaaattagccgagcatggtggtgcacaactgtaatcccagccactcgggaggctgaggcacgagaattgcttgaacccagaaggcagaggttgcagtgtgccgagactacaccgctgcactacagcctgggcagcagagtgagactctgcctcaaaaaaacaacacaaaaaaaacccccaaaagactggtgactggtgtatcaatcagcatggcaggcacaattagctctggatgacctaaaactgtctaattcaggaactgtttgtcacacacatagagtttatcttgggctgactttgctttccaccctcccttcactagcaggtgtttgtcaatagggagaaatttaaaagccacacatcattaagaaagaaattcttttgtatagattcccagacaaatataaataggttttgaattatctgctcttttgtagtctgcatgctacttctattgatgtgccatcaaacactgttagaagaatctaaaaatatagcaaattaaatttgtttgcattgccacctaaataattaggatgaccaagtaatttgtcatctaaacctggacacttttgagaatgaaaaggaatgctgttaatgattatgcaagctcaacagatgtaaactgggactgtctcaggccaactgggacctgttgattaccctattatagtattctgtaggaacatcaatgttactgaaatgggcttatatgtaagtatcagaagatttcatgagcacatttttttcactcaaaggaatttttggaatttcgtaaggcaagaagtgacatgcttctctccaggaagaatcagctcctgttggagttcagtttctggaatgagcctgtgccaagatccggacctaatatatatgaactcaggtcttaccaactccgagtaagtacagaaatataagttattccttttactcctctgtgaaaaagcacaagcattttgtaaggctgacaacagaacttgtgtgtacattctgtgatgtatgtctagcattatatgtatatatatgtatttttttaagactgggtctcacactgtcaccaaggctaagctcttttgctttttatggccttacacataatgcttattatttgatatttttctaaataacatatttgtttttaagaagaaagacctaaagtgcaggataaggtacaatatgtaacatctgttgtggttaaaggagagcagctaataaacactgtgactgttgaacaaattatataacatgataagagtaaaaggcaataatataacactttctagaaattttcctactgaggactagaaagaaagccccacatagcagcattattaaagtggctaatgcctgtaatcccagcactttgggaggccaaggttggaggattgcttgagccaggaagcttgagaccagcctgaacaacatagtgagaccctgtctctattaaattaaaaagtaaagttttggctgggtgtggtggctcatgcctgtaatcccagctttttgggaagtcaaggcaggtgggtgacctgaggtcaggagtttgagaccagcttggccaacatggtgaaaccccatctcttactaaaaatataaaaaattagccaggcatggtggcgggcgccggtaatcccagctactcaggaggctgaggcaggagaattgcttgaacccaggaggcggaggtttcaggagctgagattgagccactgcactccagcctgggtgacggagcaagattctgtctcaaaaaaaaaaaaaaaaaaggttttttgaagttagttttgtcacttaatgttttttctactgctgtttgctatttctgtattttttttttcacagaagaactaacaaaccaaatctaaatctgttttcagccaggaaccatgattgaatggggcaattactggtgagtatattactgaatggtgattttttaagtcttgtgaatagattagtttaggccatagtgttaattctagggaaaaaaatctgaggatagtactgtgacttaacactgcactaatgtttcgtttgatgtttttattatgagatttttcaaacatacaaaactagagagaataatggggctccccttccacatccatctcttagcttcaataattaacacatggccaatcttgtttaggcctaactccttcaacccagattgtttggaattaaatcccagacagcattctatttcattcataaatatttcagtactatatatatttctaaaagataagcaccttttttttaaaagcaaaaccaatattgcataaggttagtttacatacttcttggatatcatcttttctgaaacgttacttttgtcatatatacacaccatgtcaataatggtttcttctttttttccttgctagtttgagtagaaaaataacaatttttccacaagttgatatgtagattcagcagaatccctatcaaactcccagcaggctttagaagtgcaaaagactagccaggtgcactgtggctcatgcctgtaatcccagcactttgggaagccaaggcaggagaatcactcaagtccaggagttcaagaccagcctgggcaacatagtaagacccccaacctctaccaaaataaataaataaataaaactagccaggtgtgatgccacatgcctgaggtcccaggtatttgagaggctgagtaagagaattgcttaagcccagaagatggagtttgcagtgagccaagattgcaccactgcactccagcctgggcaacagagtgagaccctgtctcaaaaaaaaaaaaaaaaaaaagtccgggcatgttggctcacacctgtaatctcaacacattgggaggctgaggtgggcagatcacctgaagttaggagttcgagaccagcctcgctaacatggcaaaaccccatctctactgaaaatataaagattagccgagcgtggtggtgcactcctgtaatcccagctacttgggaggctgaggcaggagaattgcttgaacccaggaggcagaggttgcagtgagctgagatcacaccactgtgctctagcctaggtgacagagtgagactccttttcaaaaaaataaaataaaaataaaaataaagactgggcatgatggctcatgcctgtaattccagcactttggggaggctgaaggaggagaattgcttcagcccagacgtttgagactttgagaccagcctgggcaacatgacgaaaccccaactctacaaaaaaatacaaaaattaaccgggcatggtggcacacacttgtagtcccagctcctcgggaggctgaggtgggaggatcacctgagccttaaaggtggaggctgcagtgagccatgattgtactactattcagcctgggagagaataagaccctgtctcaaaaaaataaaaaattagggcggggatggtggctcacacctgttatcccagcactttgggaggccaaggtgggaagatcacttgaggtcaggagattgagaccagcctgaccaacttggtgaaaccctgtctctactaaaaatacaaaaattagccacgtatggcggtgtgcacctgtagttccagctactcaggaggctgaggcaggagaatcacttgaacctgggagacagaggttgtagtgagccaagatcaccccattgcactatagcctgggtgacagcagactgtttcaaaacaaaacaaaaaattgccttactttcagtgatactaaaaaaaaaaatttaattaaaaagacaagtcatatactggaataaaatatttgcaaatcatatgtctgataagcaaattgaattcagaatagataaataattcttacaactcaataataagaatacagataactcaattaaaaaatgggtaaagaatttgaaaagacagcagctgggtgtggtggctcacacccgtaatcctagcactttgggaggccaaggcaggaggatcgcttgatgctaggagttggtgaccagcctgggcaacatggtgaaaccctgtctctataaaaaaaaaaaaaaaaaaaaaaaaaaacttgccaggcgtggtggtggcacatgcctgtagtctcagctattcaggaggctgaggtgggaggattgcttgagcctggggaggtggagactgcagtgagccatgatcatgccactgcactcccagtgagaccctgtctcacaaaaataaaaaataaattgaaaatggaattagtgtgattcagcagtcccacttctggatatatatccaacagaattcaaagcagatctcaaaaagattcgcatacccatgtttatcatagctttatttgcagtagccaagaggtagaaacaacccacatatccatcaatagataaatggataaagaaattgtgggctgggtgcggtggctcacacctgtaatcccagcactttgggaggccaaggcaggctggtcacccgagctcaggagtttgagaccagcctggccaacatggcaaaaccccgtctctactaaaaatacaaaaattagctgggcgtggtagcgtgcacctgtagccccagctactcagcaggctgaggcaggagaatcacttgaacccgggaggtggaggttgcagtgagctgagatcgcgccactgccctccagcctggcaacagagcgagacttcatcccccgcctccaaaaaagaaggaagtcttgtcttatactgcaatatggtgaacattgaggaggatgtaatgctaagtgaaataagaggacaaatagtgtatcattctccttatgtgaagtatccagtgttgccaaaatcatagaaacagaaagtggaaaggtggttgccgggagctgggcagagagggaatacggaattggtgtttattgagtatagagtttcagttttacaaaatgaaaatgttttggagatctgtggcataacagtgtaaatatactggacactgcataaaaatgggtaagatggtaaattcaatgttaacgtgttttttttaccacaataaaaaatacgtttaaaaaatgtttaggccaggtgcagtggctcacagctactttgggaggctaaggtgggcagatcacctgagatcaggagtttgagaccagcctgggcaacatggtgaaaccccatctctacaaaaaatacaaaaattaaccaggtgtggtagcacatgcctgtaatctcagctgcttgggaggctgaggcacgagaatcacttgaacctggaaggcagaggttgcagtgagctgagattgtgccactgcacttcagcctgggctacagaccctgtatcaaaaaaaaaatttttttttaaataaattttaaaactttttaacggacaaaggatttgaataggatttcaccaaagaaaatacatgaatgcccataagcttatggaaagggactcaaccttcttagtcattatggaaatgcaaagtgaaactataatgggataccagttcctgcacactgggacagctgtaacttaaaagagatagataataacgtgttagtgaggtgaggagaaagtggacccttccgatattgctgatgggaatgtaaaatggtgcagccactttggaaatagtctagtagtccctcagaaattacatgtgggctggacgcagtggttcacgcctgtaatcccagcacttaacgaggctgagggcgcggatcacctgaggtcaagaattcgagaccgacctggccaacgtgacaagaccccatctgtgctaaaaataaataccaaaaacgtagccgggcatgttggtgtgcacctgtaatcccagctactcaggaggctgaggcaggagaatcgcttgaacccaggaggtggaggttgcagtgagccaaggtcacgcctctgcactccagcctgggtgacagagcaagactccatctcaaaaaaaagaaaaaaaaaattacatatgacccagcaatttcattcctgggtgtctacccaaaagataccatccatataaacacttatatatatgtgtataagtgtttcttatacaagaatctttcctccttggatcatcaaaggctaaataatgcaagttagaaagcaaacatccatgtaaacacttaagtgaccatagcagcatgttttataatagccaacaagtagaaacaacctaaatgcccatcagcagagggtgggattagccagagggccagtttactagccctgctttaaatgataaagctgtccacgtcctcccaggagctaccttaaattcaaaacacaagaaacacaagaagcatgctgattacaattgtaacaaaataccagctttcaccattatgatttaataccgtttttagaaatcctgactattataatatgagaaaagacagagacatacaaagcctcaataggccgggtgctatggctcacacctctaattccaacacttcgggcggctgaggtgggaggatcccttgagcccaggaggtcaagaccagccttggcaacatggtgaaacctcatctctacaaaaaatactaaattagccaggtgcagtggtgcacttgcctgtagtcccagctactctggaggctgagcaggaagatcacttgagcccttgctgttgaggctgcagcaagccatgatcatgccattccactccagcctgggcaacagagcaagatcctgtcccaaaaaagcctcaataattaagagggatgcaagaataaattattgaccattggttagctgaagtcagtgcctaggacaggaaatggaaagaaaaacactagtgacatttagggttctgtgatggtgagattgttggtgttttctttttaccagtctccatacttacttcattatgggatttctttggaagctaaaaatactgcctgggcatggtggctcacgcctgtaatcccagcactttgggaggctgaggcagacagatcacttgaggtcaggagtttgacaccagcctggccaacatggtgaaaccctgtctactaaaaatccaaaaaaaaaaaaaaaaaattagctgggtgtggtggcgagcacctgtagtcccagctactcaggagatggaggctgcagtgagccaaaatggcactactgcactccagcctgggcgacagagtgagactccatctcagaatatatatataattttgaaacattgggatagtttcctaaaataatctgaagcatacatctatatctaattcaacaaaagatttatagcattttttttctttgaaacttaacatatttctgtaccttaatttttgtttcttttctttttttttttttttgagacggagtcttgctctgttgcccaggctggagtgcagtggtgcgaactcggctcactgcaagctccgcctcccaggttcacgccattctcctgcctcagcctcctgagtagctgggactacaggcaccagccatcacacccggctaattttttgtgtgttttttagtagagacggggtttcactgtgttagccaggatggcctcgatctcctgacctcatgatccgcctgcctcggcctcccgaagtgctgggattacaggcatgagccaccgtgcctagcctgttttttgtttttagggggagatgtgtgtgtttatttctttgaagtaattatgttaactcttacttttctttggcagcttgctatttctgtttcctaagctggcatttcataactatttacccacaaagggggaggccacatggtgctgagaaaaagctctgggtttgagttacttgacagctctcaccttgaaaagagaacttgtacctttttgcctttttttttaacttcaacttatatcttttcttttttctttttcttttttttttttttgagacggagtcttgctctgttgcccaggctggagtgcagtggcgcagtctcggctcactccaatctctgcctcctgggttcaagcgattagcctgcctcagcctcccaagtagttgggattacaggcgtgcaccgccacacctggctaatatgttttgtatttttagtagagacagagtttcgccatgttggccaggctgatctcgaacttctgacttcaagtgatctgcctgcctcagcatcccaaagtgctgggattacaggtgtgagccaccgcgctcggccccagtttttctcttttttcggttatgaaatttcctgctgtgcatgaaataatttctaagatcccttctgtctccaacaaatagttctgtgatctttatttctaatgaacctttcctccttagatcatcaaaggctaaataatggaagttagaatttcttttcatttgaaaactaagaaatacatatttggttgtatgctactattatatacaatttttgttcttttgtttttggactattgttgttaatcatgtagctactcacggaataggattactcactagttcaatttttgcccattactgatcaagactcgctcgccgtggaatccacagggacatactggggttattcagttatttaaaaaattatttgaccaggcgcggtggctcacacctgtaatcccagcacattggaaggccaagatgggcagatcacctgaggtcagaagttcgagaccagcctgaccaacatggagaaaccctgtctgtactaaaaataacaaaaattagccaagtgtggtggtgcatgcctgtaatcccagctactcggaaggctgaggcaagagaattacttgaacccatgaggcagaggttgtggcaagccaagatcgcaccattgtactccaccgtgggcaacaagagtgaaactctgtctcaaaaaaaaaaaaaaaaaatatatatatatatataatttataaagccagtttagcattcaatttatattttggcacataggtaactaagatggtgaccacctcgtctgtacaggcttctgattgttaccaggctaaggcaagtatgttttgtttgcctaccataactaaattacaaaaattcagaatgaaatgaataatctggaatatttatcactatcaatgaaagccaggtttttttcttctgaatagagttagaatgcacattgaagtgatttgcttaatttcaataatcagatttataatttctgtgaagatattgatcacttaattctcaatgtaaagattaaagatgtcatcttatttgtggataatccatgggggcaatagcaagaagtccctttttcaccataaaggaacccaagcgcttgggtaaggttcccatcatggcactgagcccatggtggattagagcagaggtgtagagtgattttaaggagactggattgcttgagcccaggagttcgagaccagcccaagcaacatagcaaggccccatctcaacaacaacaaaaacataataaaaaataaaaaattggctgtgcttagtggtgcaagcctgtagttccagctactcaggaggccggggcaggaggctccctcgagcccaagagttccagactgcagtcagctaagatcatgccactgtactccggcctgggtgacagagtgagtctctgtcttaaaaaaggagattggcttagtcactcacaggaaatcactcttggatttttttcccccttttgagatgttatcattcagtatatatgaagtttgcctccaggaagagaatgctcagccaagccaactcaagcatcttgtgccttgagagtgacatctttcactgtcattgttagtaggttgctatccttgtttatatgctgccagctcttttgaatgaattagagtgaatctgtcttcccaagtcttgtcacctgtgggaccctgatatgactgagacttcaggccagagcctgggcagtgtggtatggatttactgggtaatgcatggtgtgtcatctcctgatagaccttaaccatgtgtcttctggtgacctccctatgtcatttgaagccccttccttttcacctttgattctagaagactgcttttgaaaaaatgggcacattttaaaacatttttaggaattcagatgcatcactaaatattttttttttaagtggtgcaagtatgaaaggaaagggctctgagccaggcgcagtggctcacacctgtaatccaagcacttagggaggctggggtggacagatcacttgaggtcaggagttcaagaccagcctggccaatgtggtgaaatcccatctctactaaaaatacaaaaattagccaggcgtggtggtgcacacctgtaatcccagctacacaggaagctgaggcaggagaatagcttaaacctgggaggcagaggttgcagtgagccgagatcccgccactgcactcctgagtggcagagtaagactccgtctaaaaaaaaaaaagggctgtaggctggcctggtggctcatgcctgtaatcccagcagtttgggaggccgaagcggggcagatcgagaccagcctggccaacatggcgaaacctcatgcctaccaaaaatacaaaaaattagccagacgtggtggtgggcgcctgtaatcccagctactcgggaggttgaggcaggaaaatcgcttgaacccagaaggtggaggttgcagtgagccaagatcgtaccattgcattccagcctgggcaacagcgagactccatctaaaaaaaaaaaaaaaaaagccgagcgtgatgtcatgtgcccataaccccaactactcaggaggctgagacacgagaataacttgaacccaggagatggagattgcagtaagctgagatcacgccgctgcactccagcctgggagacagaggaagactgtttcaaaaaaaattaaagagctgataccttttgcagtgggaaattcttaaagttttaagccaagtgcctatttttaactgatcatagtgtgatgtccacagaggcacaatgtatattagtactttcttccatatttggtacataatgaatgcctttggtactcattttctgaatggtttgctctagtaggaaagaaaaaaaaaaaaagcaagaggcagctttgcctgcactactgaggctgtaccaccagaaagcttcattcccatggttcctctgtatggcatccaagaagttgcagagtcccttgtgtagttcagagagcaggggtgtttctcaggatttcagagtcatcagctgctttgaaggtgtgcttccttcacctgtgttttaacgccctgccccaggggtggtccctgtctcccttgggtacagtgccctgtggcaccttgggtgctctagttccaggtttgcctcgcttcccctctgagggtgttctggagaagcagtgctttttaaattgacgggtcccatcctctgccagttctagactttatttcaagaatcaccagtgcaactatatatacatcttcaggttgctgtttttatttttaataattattaaatacattttctcaaaaaaattagtatagctacagaaaagtatgcttacatttcatatacattaaaatgacttttagaccaggtgtggtggctcacgcctataatcccagcactttgggaggctgaggcgggcggattacttgaggtcaggagtttgagacaagcctggccaacatagggaaatcttgtctctactaaaaatacaaaaattagccgagcatggtggcgggtgcctgtaatcccagctactcaggaggttgaggcaggaggatggctcgaacccaggaggtggaggttgcagtgagctgagattgtgtcactgcactccagcctgggtgacagaatgagactccgtctcaaataataataaagtaaataaaataacttttgatttgccttagataacttgataccagtttgataaaccattagtcttcattttaaacagcctgccctgagtatggtgaaggtttagtctaccgattctcgttagcgtatctaattcagtgtcttaaacaaacatcatctcattcttacagggctcgtgcaatccgcttcagacaggatggtaacgaagccgtcggaggattcttctctcagattgggcagctgtacatggtgcaccatctttggggtatctgtttttcccttttcgagttactgggatttaagagttcattactaagttgtactgggaagtagagcacatcttgagtcagtaaccttaaccactacagcaaatccgacgtcacagagggacagtctgtacggggctgtctggaactagcgaggtcaacagtgaaagtccatagattgatggcattagtgagctgaaagtgagtagggatgatggggaaaggaataaggggtaaagcaagcagccatggaagaaggaggccagggaagtcaagagtgccttccacagagtggtcccagcctttctttgtagactgactgcttacttcctcgacagaggcaggcctgcattttacccagagcagcagcttcctgcacatactcactgcctgcctttgtagacgtggttccactgtctcatgacattgaccccctcaccatttccatccccacacacttttgtttggcaccatctttggtatttttccaggcctgccccagatgtcacccttccccagtagtgaacatcatcactcctcctgagcccccagagccttgtgtggtgctggttattaccgttgcggctgtatatggtgtgcaaccctcccaggcatgtgaataagcacaggtgctagaagggcaggattggatggaggaaggttccatccctttggctgttgggcagaggtcaagccaggtgcatgctccattcacatcagcacctgtagctgcccggagagggcctcccagatgcaggatcctggaatggcaaacaggcaggcaccagagtgtgaatggcggagctctcatagaggctgtggggaatgcaggacagacctcttgtctctgccctgtcgggaggactcaaggcttcacagagcaacagcaagttgaagatgattgcttgaggccaggagtttgaggctgcagtgagctatgactgtgccactgcactccagtctgggcaaatagagcaagaccctgtctcaaaaaaaaatgtaattaacaagatattggctgggcacagtggttcacgcctataatcccagcactttgggaggccgaggcaggtggatcatctgaggtcaggagttaagagaccagcctgaccaacatggtgaaacctcatctgtactaaaaatacagaaaattaggcatggaggcgcatgcctgtaatcccaggtacacaagatgctgaggcagaagaatcgattgaactcaagaggcggaggttgcagtgagccgagatcgcaccactgcattccaacttgggcaacagagcaagactccgtctcaaaaaaaaaaaaaaaagaaaagaaaccaaggcatctggatgagatacctgtgaattgtaccatgacacaggtgatccccctccacctgaagcgcctttcttcctattcctacgtcagtgatgtccttttcaacttcaacacccacctggtcagcttgcacctttcccacagctctcccattgcttgccctgctcccctatacactgtgtccttgtatgggccacggcactctccacaactgacctcgcctgcctcatatcctggggcttcaccgctggaacacgctccctgcccagatcagtgtagtgcgagataaatgttgagtaaaattgatctgacattgctcatctgtggtctcacagtttctggtcatgaatttaacatgttattggagaatttcacttggtttataaaggtatatcttagattcactagattgtaaagcttaagagggaattgtgtctggatgtggtggctcacgcctcgattcccagcagttttggaggctgagtcgggaggatcacttgagtccaggtgtttgagaccagctcgggcaacatagtgagaccccatctcaaacaaacaaacaaataatttttttaacttaagaatgggccaggcgtggtggctcacccctgtaattctagcactttgggagactgaggcgttttgatgatttgagcccaggagtttgacatctgactgggcacaaaaaaatacaaaaattagccaatgtggtagcacattcctgtagtcccagctattcagcaggctgaggtgggaggatcacttgagcctaggaggtcaaggccgtggtgaaacatcatcgtgccattgcgctccaggctggttgacagagtgaccttgtctcagaaaaaaaaaaaaaaaagactgaaagtttgcttttcccacgtggcctaatataattttgctcagaatttccccagcccagtatattacacacctgaagtagtccctgagaaaactagatgtccaggtgaagcaagactttaacggatgtatgggtggaatgcagtgtatgtgttttaagtcttacttctctgtgtggttatttttaagcttacagggatcttcagaccagggaagacatacggaatgcagcatggcacaaacatggctgggaggaattggtatattacacaggtaatctcttaacagccatgaaatatgctttttgtcttactgtttcaatcatgttctttcaccctgacactaataggtgggttttgtaatagtatgttgctaggatagtgagttatcaggttgtggggggaagggagatagtcaatttttctctaatacttacatgactttttttcaataaagtagaatatccatgctttcaaataggtatatcatctgttacagttttcagacccttggatgttgtaaattttacatcattacctgtttttgtagatttctatattctctgaaaacttattacacaaataaaatttttttctaagctttccttttccatcagaattgttagtatcccaaatcagaacttaatacatcaattaaagagtgattttgaaattagataaattaaacttcctgtatgtacagtatgtatctgggtacataatacatgcatgtgcacatacataagtatattatgaaaccctgtttgcttgatttttaaaagaaaacagttggctgaatgtaacccagtggcattggtagaggtaatcagtaccagccatgttgcatggcaagtatatttcaggccgggcgcagtggctcacgcctgtaatcccagcactttgggaggctgaggtgggcagatcacctgaggtcgggagttcgagaccagcctgacgaacatgatgaaacctgtctccatttgagagactgaggcaggagaatcgcttgaacctgggaggtggagattgtgccactgcactccagcctgggtgacagagcaagaatccgtctcaaaaaaaaaaaagtgtatctcagcccctatactaccaagaaaataaaagagtaatttgtcctagaaagtaggtgttaccttgtctttcagttcaagagattatataacatataattacatgttataattatataattgtatttgattttgctgcttacgcgaacgtttgagaaatcaccatttctcctcacagtatggacttttcctacctcccacaaataaaacaaatatccaggtaggatctgttttttttttttttttttttttttttgagacggagtcttgttctgtcgccaggctggagtgcagtgacgcgatctcggctcactgcaacctccgcctcccggtttcaagcgattctcccgcctcagcctcctgagtagctgggattacaggcaggcgccaccacacccagctaagttttgtatttttactagagacagggtttcaccctgttggccaggatggtctcgatttcctgacctcgtgatccacctgcctcagcctcccaaagtgctgggattacaggtgatctgcgcccagctgatctgttgtaattttaatagcatcttgtaggatggcagctgatacagggtccgcttgtatatttctgcccttgaggttagtcctgtatattatgatattctcttgttttcaagcagcacatctgtgaacattctcggcaatctgtctgttagtgtcatttaccataatgtgtttagaaagtaacaagtgcagtaaccctgatcttgttttcagttccacttattcaggaaatggaatccagaatcatgatcccactgaagacctcgcccctccagtaaagctgtagagtttctatgtgcctacatacatttctgtgacaagtatttgtcgtaaattaattttaattgtgtatcaagtgaaaaagaaacactgaggttttaagctgctgtatatagcttgtgagaaacctcttttctttaaaatttacataatcacaagaaaggaaagaattacagttggactgattgtgacagtgccttgtcgtcctctttgaaacaccccgtgttgtccagtataccttataacactgagccacttctccccaccctccagaaggggtccacgttgaattctgaatcatcttgaaaataagattccaaccacaaaaaaaatttagccatttctttactaaaaaaaaccaaaaaacaaatctgttttataatcacagatttttagacaaatttcttgtatcaggaagaaatacaaattttgtcatgtttctcaagcagtttttctgagtagtttctgaggaggaacaaattacaagtgtacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccac

SEQ ID NO: 35987 - DNA, 44062 bp, Homo sapiens
tgcgctgcccggggcggccagagccctgcagaacaaaccgccgcacggaattaggggccgccgtccgcgcctgccaggcttggaagcggactcgcccccagggccaccgccctaggaaacctcccgtcggaagcctcccaagcaagccgctcacccgcggctcccgcgcgaggcggcgtgggcgtgggcgcggccctggcgcggcggcgcgcgcggggtgaagggagcccggcgcgctggctgcggcgacggcggccgttgctgcgccgggtactggggtcgctgcctgaggcgcaggcgccgtggactccacccgccccggggcctgggctcgctgtggactcgtcatggcgaccgagcagaggcctttccacctggtggtgttcggcgcgtctggcttcaccggccagttcgtgaccgaggaggtggcccgggagcaggtggacccggagcggagctcccgcctgccctgggccgtggcgggccgctcccgggagaagctgcagcgggtgctggagaaggcggccctgaagctgggtacagcggcggggcgggacggggctgcgcgggcggctgggccggggaccccgcatcgccccaaacgagcgtttctcccgcagggatgcgccctacgtgtccccgagccctgcgtgaggacaagaagaggagagggagagatgtttcaaatactgccatagctttgtcccacctccttaactatatgtgtgtgtgcgcgtgcgtgtataatatacacacacatttttttttctttccttctcctctttcccgctttttgcatttctgcctcagtttggggagctcccctggcgaaatggtcaagaacttgagttgtccctctctctgcttcatcctgccccgcagcgggggcacctgttgaatctgcgggtttctagatgtttggtcggagaggagaggagggctttggtctcttggagatcggagtctccctttgcctcgtgttttgaggacgggagagcaagcttacgagttgtactgacagtgtctttgtggctattctgttttagtttcttgttttgtgtgtaagaatactccagcagtcttcctcttcagagaataaaaagtgtgtatttctggtttagacgcttacgtattctctaagcattcaggtagcatgtatttattgataatctaagcattcaggtagcatatatttattgataatctaagcattcaggtagcatatatttattgattctctaagcattgaaggagcatatatttattgagtgacgttgtccatgctaagacctgtcccgagtctggggtgcaggatgggacagagaggagacagacacacggatcctgctgccttcatggctggggagacatctgacttacgactccgtagcctttaaatttggctattaactcccgtagatttcccttatacagacacccattagagttctggaaatactacattctttctgtttaatctactttcatacaatgccctgctcggagtgcttttgttcgtggttatgtacagaagacaccacgtaggctggactctcctacagcttttggtgctgacactaccaacacgtaattctgaccaaagagctttttggtcgttatttttccaacagaagtaattttactatgaaaatatatgcttccatttcttttttcggctcagcaagatcgtaccggtacagcctagtcacttatcatatataatgcccaaatcaagtttcattgtggggggatataccttcacctattgaaacctgcatcacttagttgagccagttaattccaattattttcttatgagcctgtgtgtgtttatatagcgtgtgcttttcacctcagagttctaattttttgttttttgtttgtttgtttgccattctcctgcctcagcctcctgagtagctgggactagaggcgcccgccaccacgccctgctaatttttttagtagagacggggtttcaccgtgttagtgaggatggtctcgatctgctgacctcgtgatccacccttctcggctttccaaagtgctgggattacaggcgtgagccactgcacccagccctgatggttttgatgttaacagtcagtccgaaactctccatcacctacaattggatcatagtaattgtttagtggttgatgagaaactttatttttttaaagacaagttctcattctgccacccaggctggagtacagtggcgtgatcacagctcactgcagccttgacctctgtgtctaagtgattctaccgcctcagcctcctgagtagctggtactacaggctatgccaccatgtcagataattttttttttttttttagtagagacaaggtcttgctatgttgcccaagctggtctggaactcctgaggtcaagagatccttgcaccttgaccttccaaagtgctgagccactgcccctggccaagaaactattttatgacataaatttcttgttggagaggaagtctggatagttatctgctcagcatttaaacttgattgtgaaattgtcatgttacacagggttgttatttacacaacgctttgattcgattttttttaaaaggtcagttttttagtaactcttagtgttaactcagttttcctcataattttttccttttgtattacctgattaaaaacagttttatcttttgtctaagcaggagagctagctttcagcatatcagtgtatttagtaatttgctgtcactgattactgtaaaaagaagataaggaagatataatcctctactgggatttactttccttcatttgtttcttattttaggaagaccaacactgtcatctgaagttggaatcatcatctgtgatattgctaatccagcctcgcttgatgaaatggctaaacaggcaacagttgtcctcaattgcgtaggaccagtaagtaatcaacccttctttgtatcagaacaaacaatccattcatttctagcaaaatattccagaggaacataaggacagaggacagaattgttggttgaaggccttaaccccatatggggagttttttcttcttgcgaggagcagctggagatgaccaaagtctcctgagagagtgagtgacaggctctccatgacgttctccttagggcatgtgtgctggcttgttgattggttacatctgtgattgtcagaattttctttcctttttactatataccccttcggtaaaaaatgtttgagtgtgtctccctagtatattttttatttataaattatattcttgtactactgggtaaatatattttttaaatgcacaaaaagaagactaaaaaacgactcatttattgaataaatatttattgatgcttaccacatgtgaaatgcactattgtaggcacctgggacacaatggtgaacaaaacagaaaatccctcgtggacattacgttcttggggaagacagaaaaataggattgtaataggaggtaatgaaaagtgctttgaagaaaagtgaagccaagaaaggagaaaaggtcctggcatattggtgtttttagatggatggtcagggaaggtttctgtgaggaattgacatttgagccaagatctgaatgaaatgagagcaaattgcatgaaccttttgaggagagacttttccagggacagcaggcacaaaggtcctgagatgccagtgtgcttggcaagactgaagagtgtgacagaggccagtgtggctgggcatggcagagaggtggagagtggatcagagagcaacccgggagctgggtcatgtgggatcttacgggccatggccaggatgtggattttttttccaggtgtgaccaagaggcgttgaatggttgaaaggaagggcttcagctgatttaaattggaagttctttggcttctgagtggaaaagtagataacaaaggatgagcaatggaatggtgcaagcacaagccctggggtcgtagtggtgctgagaagtagttaggtccagagtatattttcaaaggagaacggcttttgctgttgtactgtgaaaaagtcatcaagtcacaggccatcagacttttggcctgtgtaacaaggtgaatgttggtgacatttagtgatctgaagaagccatcacagttggcaagatgtttaaaaattaaatatctaaaatattaataatttttaattgagagcaaaagggtttttgaattgctattaaatagaagtgttgttgatttagattcatctcattcttaactagcttagattccatccatgaggtccactgctgcactctataatggacgccctcatctatctcccttgcctttttctcctcagtactctggaaaaatcccagccctggttattctctgcctgctcttcacctgaacatgagtaacacagtgtggctggagaaaaatgtatccccctgctaactggtcacacttcaaatatgtgtttacaaacgttgtgtggtgcttagcacctccggcagctctgctctatttccctcaggaattctctctcctgctctctgaagcagctcacaaccttgttttccttgaacttttagtatcccgtctctctttccttgttcttatctgattttatttttctttttttttaactatgaaaatagaagctggttaataacagaatttctttcttcatcttcctaccaccagatctatctacctacctacctgtctgccaatctgcatcataccctgtagtctgccatatctcttgttacaaggaaaaactggtcctcttcctattgggcacagttttcaaagactttattatcgggggaaccagcccccagtatttcaacataggttcttttctattttccctaagtgtcagccagtctgagaaataaagagaaagagtacaaagagaaattttacagctgggcctctgggggtgacatcacttgttgacaggttccgtggtgccccttgagctgcaaaaccagcaagtttttattagggatttcaaaaggggagggagtgtacaaatagggagtgggtcacagagatcacatgcttcaaaaggcaatacggtatcacaatgcaaatggcagagcaagatcacaaggccagggcaaaattagaattactgatgaggttccatgtcccgctgggcacgcactgtcattgataaacatcttaacaggaaacagggtacgagagcagacaaccagtttgactagaatttgccagactggaatttcctaatcctagcaagcctgagggtgctgcaggagaccagggtgtatttcatcccttatcttcaactgcataagacagacactcccagagcggccattttagagacctccccctgggaatgcattcctttcccagggttattccttgctgggaaaagaattcagtgatatttctcctattcgctttctgcaagaagagaaatatgactctcttctgcccagtcgcgcaggcagtcagacattatggttatctcccttgttccctgaaaattgctgttatcctcttccttttttaggatgcccagatttcatattgttcaaagacacatgttttacagtttgtacggataactcaatcatcacagggtcctgaggcaacatacatcctcagcttacaaagatgacaggattaagagattaaagacaggcataggaaattataacagtattgattggggaagtgataaatgtccatgaaatcttcacaatttatgtccagagattgcagtaaagacaggtgtaagaaattataaaagtattaatttggggaactaataaatgtccatgaaatcttcacagtttatgttcttctgccgtggcttcagctggtccctctgttcggggtccctgacttcctgtaacactttatgtttacaattacacattatcttgttatcaaatttctcctctttactggattatttcaatcagcatttaaatatgtgatatctcccatattttaaaaaaagctgcttgattccacatacccttccaactactctactttttgtgccccctttttagcagcctccttggaagaattctcatgactcactatctctgcttcttcacctcctactctatcttaaacgcctcctattgggcttttgttttcctccctcctccaatgaaactactctgctaaagtcccaccctgtcaaatccagtcttcatctgaaagcttgcagcattcgatccagctgaccactttctcctttctttgctcagcttctacgttgtcatcttctcgtagttttcctcctgtccaccagcttcaccctggaagtcctcgtctcctccactgcgtctttgtcctccccactctaaatgcttgaggcctcagcgtttaagctttagaacctcaataacctcattcaggcattaggttgcagtaaagtgaaaacgactgaatgaatgaagagtggtgctgaggccctctctgtgtgatggaaactttcccacaaccccatcaggatacctgctgtgtcctgtcttcaacacatgaccacttaacatggcccagggaatgtctcgtagtcagtccatatagtaaccgttaacggaacgtcatgtttttgtaaacattaacatggataaaagttctgatatttacttccaccctcagtggatcattctgcgcttcccttaggggaagactacttgggagaccactgggttagaagatggaactttgagggccaggcgcggtgggtcatgcctggaatcccaaacctctgggaggctgaggtgggcagatcacttgaggtcgggagtttgagaccagcctggccaacatggtgaaaccctgtctctactaaaaatacaaaaaattagctgggcatggtggtacacacttgtaattgcagctactcgggaggctgacgcaagagaatcacttgaatccgggaggcggaggttacagtgagctgagattgcgccattgtattcaagcctgggcagcaagaatgaaactccagctcaaaaagaaaaaagaagaagatgagacatggagagcaggattgcggttctgacctttgagccaattggcctcacaggggagaagtgtctccccgagatgaaggattgctactctgactgttcacctgtctcagacaagcacagggtactaagtggagaaaaatctagcaagttcataaaataggaataagttagtgagaagtctcaactccagattactcaaagaagtgggccagatgtgacaaaatgcagtaaaagtaaggaatgggcagactggcaaataggaaaatgcgttttctttccagaaggagctacgattattttaataagctcattaatacttcactgcagcctgccagtactcatagatacactgcctagctgatgggctcactagccagacatgagaagtgagcctgtggctgtaaggcagagcctggaggagctgggagttggcccagcagaatgaagggagggtgctccaggtagtggaagcaagcacactgggtgtgaagaagcagcatgcttggggaattacatggaatttagaactgctggaacatgagaattaaggggctgtggtatgatatgatactaaggactttctgtgacatgctaagaaatttggactttgtactatatactgtagggatttttttgtttttgttatttttatttaagttctagggtacatgtgcacaacatgcaggctcgttacataggtatacatgtgccatgctggcctgctgcacccatcaacccgtcatttacattaggtatttctctcaatgctatccctacccctgccccccaccccacgacaggccccagtgtatgatgttccccaccctgtgtccaagtgttctcattgttcagttcccacctgtgagtgagatcatgcggtatttggttttctgtccttgtgatagtttgctcagaatgatggtttccagcttcatccatgtccctgcaaaggacatgaactcatccttttttatgcctgtatagtattccatggtgtatatgtgccacgttttcttaatccagtctatcagatttgaagagtggatatgttataggagtgaggcaggaggaaaggtgacatcacatttttattttagaataacaatttgttatgtatttggagatggggctagctggctgcagtataaccagttagggcctatttatagtaaattagatgagtgttgacagggtctgaactaagatataattgtgcaggggagaggagactgatttgagataattttaggaaactgaattgataaaacttggtgacttccaggataggtagcatgaaagactgcttccagatttttttttttttgaggcggttcttgctctgtcacccaggcggaaatgcagtggtgcgatctaggctcactgcaacctccacctcccgggttcaagcaattctcctgtctcagcctcctgagtagctggaactacaggctcatgccgccacacctagctaatttttatatttttagtcgagacagggttttaccaaattggtcaggctagtcttgaactcctgacctcaggtgatccacctgcctcggcctcccaaagtgctgggattacaggcatgagccaccacacccagcctgcttccaggttttaacctgagaattatgtggggagtaatgccattaaataaaaaaaagaagccatctgagtaccatgtgcctggccccacactaagctctttgtattctcttatttcatcctcacaactacccagggaagtgagtgttgttattcatcaccattctttgattgaagaggttgatgcttagagaggtaaagtgacttgcccagggtcacacagctagtggctgcagagcctggatgtaagtgtggcctgacttaaagcccacactctagaccactctgctgttcagccatttgctcagttttgtctcagagtcttccctcttttgagcacaacagaaagatgttagaagtgggacccaggcaggctgaactagaggctatactttgttttttatttttatttttttgagatgggggtctcactttgttgcccaggctggagtagagtggcacgaacacagctcactgctgcctcaacctcctgggctcaagggatcttccagcctcagccctgaaagtagctgggactatagactggtgctatcacatctggctaatttttgtattttttgtagagacagggttttgccctgttgcccaggctggtctctagctcttgagctcaagtgattcactcaccttggcctcccaaagtgttgggattacagacgtgagccactgtgcctggccatgtgtttatatatatatgccatatatatatagtccttatatgtataatatatatatataataagtatatggcctctatatatagtccgtagcatcatattttatacacacacacacacacacacactttttttcttagagaaatggggtctcaaagcgatccttctgcctcagcctcccaaagtgctgagattacaggtttgagccaccacacctggcctagaggctacacattgaagcacgtgctaggaagtggaggaggagaaataggtttagagagagagatgatgaattcggttttagacttgttgaaattgaggtgtctgctagataccttgcatcaagacagaaaatacaaataatatactgtttgtatatgatgttttataagtaagtgagaaaatcagggggaagagaaaataaaaggaaaatgtaggcaaagtgaaattagttttatgtgtgactcatgctacatgtcctgtgctctcactggtcctgacctttctaacaaaaaacagagggaaatcctatcagtgagcaactctagacatagaggttggaggtcacagcacagattttattgaagttgggagagtaggtgagatttcctgggagaatgtctggggcagtgattctccatctttgaagtacacaagaatcacctgtgaggcttatttacaatgcaagttactggagtctacctcagaaagcctgattctgggggtctggagtgggagtgagtgaccagcatgcaacccaggtgattctaaagcaggtggactcatggccaacttgagaaatttgggggtgaaataacttaagaacaaggccgagaaagctccaaatgagttttaaaatggatgtgtgcaaaccctaaggatcaaccaggataatccactgggtgcagaaagcatatggagcttcaacttctgttttaatctcaactttagttctatttaaatatgtttaaaatgtgtgttttattcatttggtaggcaatttaagtgatttataagtaaattcatatagttagtaggtgatggattccaggtgtgaacttgggtcttactgccttgaaatcctttgttccatgataccatactgcctcagaagtagagttcttcattaatttcatgtggtttgttaatgggagggtaggaactcgaatttcacacacttctcccagtcctgtaattccagtgttatccgccattcttagtaagaggtgtgaggtcttggagttaggtaagagggcagcccatctgacctatttgtaaaggtcgattgtgtcttttaagtgtcccttgttcctcaaaggctggaagaaagaaacgatttccttgttccatcttttgctgccaggaatgaataaagcagaggagtttgtgcttctaatctacttcttcacaaaggaaaagatttgtcatgcttctttggaaatgggactgaattctgatgtattagcttttacatatgaaaatttgtattttaattccttgagtttgaataacagataatatgggaaatctaatatcatacaggctcagaatatctgctctgttcagtatcaaacttatcctttgcaaactctcttcttcctgttggtttgtttttaattttgaccaataataccactggttcttggcccccatgtccagcccagctagtcaggaaatccagtcatttccacctttttagtattgtatgtctcatctttagtatatcgtctgtgctataagtcttataccactatcctgtttaaaattcttctggaaagccaagtaaactagaaaggataaagttgaaacttgttagcatggcacatgtggtccttcctgatgtggccgtagcctgccttttcagacccatctctttctacttcctactcaagtgaatttgattcctgcttcaagcaacaggaacagctcctttttcttaacctctgcatttactttttcctgtatctggatttttctttttcctggaaaatttttatttgttctttagggttcaactcaagggaatcacttgtatgaaacttttccttttgtcttcaggtagaggtaagcatacattgctctgtaattccatcatgcctttatttattcacactgtgagagatggtattgtgcaggtatcttctcagtttatctttttgtttctgagacggagtctcactctgtcgcccaggctggagtgcagtggcacgatcttggctcactgtaatctccaccttccaggttcaaaccattctcctgcctcagcctcccgagtagctgggattacaggtgtgtgccaccacgcccggctaatttttgtatttttagtcgagatggggtttcaccatgttggccaggctggtcttgaactcctgacctcaagtgatctacctgcctcggcctcccaaagttctgggattacaggtgtgagccactgtgcctggccactttctgaatttatctttaggctattttattaacagttgatttcttgataactaggactgtttacttccaggattagatggcattttattcatttaaacttgtcaagcaagaataacctctttgttctttttgtttccctagtatcggttttatggagaacctgtaataaaagcatgtattgaaaatggagccagttgtatcgacatcagtggagaacctcaggtataaaaaataaaaaggaaaaacgtagaattaacacataaatttcggtttaatgaagtggaaatatttagtgtaattttgcagacatatttagaagccgacaactcctttctagcattcagatatggtattcgtgtggtattccattgatagctcaaaggagagcgctgatggtaaggtcttagcttcagttttctgaattttttccctccctacaacatcatttcttataggtctgtgcttattatagctacttcatgctttaaactgaatcaattaaaatagcggactgtgcataattcttagaatctcaattctgtcatgttttcattttgaattcccttttaaaaatcaggtacctttaggccgggcacggtggctcacacctgcactcccagcactttgggaggccaaggcgggcagatcatgaggtcaggagatcgagaccatcctggccaacacggtgaaaccccatgtctactaaaaatacaaaaagtgagccgggcatggtggcgggcacctgtcatcccagcttcttgggaggctgaggtgggagaatggggtgaacctaggaggtggagcttgcagtgagccgagatcactccactgcactccagcctgcgccacagagcgagagcgagactctgtctcaaaaaaaaaaagaaaattcagttacctttataacattacagaaaaataaaggtaaaattcactagtgtaaaatcaacctaaacattttaaatgttcacatttattgaatgcttaccatatgcccaacattgtgctaagtgttttatgtaactttttaaaaatatacctatagggtagttatcttcctccattttttgtagatgaggaaattaaagcttaggaagcttaagtaactcactcagtaatgcacctagtaatgcacctagtaatgcacctagtaagtagaagaactaggtcttcaattgaggtttgcctgaccacaggaagttatgtgttaacaggcattaagctctactacagcctttaaaatggtaacctcatgtgtctctgtagtaactactgattatcatcatcagcatgccaatatgatattaatatgcatttgcagtttatcaattggtaaaatactggaaaatactgagacagtgtaaattacaaaaattgattcaaaaaggaggaaacaaattaaaaaaaaaaaaaagcccaggcgaggtggctcacgcctgttaccccagcactttgggaggctaggtgggaggatgacttgagctggtgagttaacaaattagccaggagttggtagcacacacctgtggtcccacctactcaggagaatgagacaggaatatcacttgagcctgggaggtcaaggctgcaatgagctatgatcatgccactgcactccagcctgggcaacatagtgagaccctgtctccaaaaaacaaaaacaaaaaacaattcccatgttattttaaataacccagaacatagaaaatggtgaaaagcttttaagtcatctagaaactatcataaaagtagtatcgaacccccccctttttttttgatacagggtctctctctctcacccaggctggagtgcagtgctacgatcttggctcactgtaacctctgccacctgggttcaagcgattctcctgcctcaacctcctgagtagctgggggtacaggtgcacaccaccacacctgactaatttttgtatttttagtagtgacagggtttcaccgtgttggccagcttggtcttgaactcctggcctcaagtgatccacctgcatcggcctcccagaatgctgggattacaggcatgagccaccacgcccagccataatatcaaaacctaataaggagttgggcacgttggctcatacctgtaatctcagcactctgggaagccaaagtgggtggatcacttgaggccaggagtttgaggccagcctggccaacatggcgaaaccccatctctactaaaaatacaaaaatcagccaagcatggtggtgcacgtctgcaatcccagctactcagaaggctgaggcatgagaatcacttgaacccaggagttggaggttgcagtaagccaagattgcgccactgcactccagcctgggcaacagggtcggatcctgtctcaaaacaacaacaacaaacctattaaagaaccagagggctgggtgcggtggctcacacctgtaatcccagtgctttgggaggccgaggcaggcggatcacgaggtcaagagatcgagaccatcttggccaacatggtgaaaccccatctctattaaaaatacaaaagttagctgggcgtggtggtgcacgcctgtagtcccagctacttgggaggctgaggcaagagaatcgcttgaacctgggagtcggaggttgcaatgagccaagatcatgccactgcactccagcctggcgacagagtgggactccgtctcaaaaaaaaaaaacccagagtatttaaagaacttttacaagacaataatagaaataaagacaatttattttaaaaatgggcaggggatgtaatcctagcactttgggaggccgaggcacgtggatcacctgaggtcaggagtttgagaccagcctgaccaacatggagaaaccctgtctccactaaaaatagaaaattagctgggcgtggtggcaggtgctgtaaacccagctactcgggaagctgaggcagcagaatcgcttgaacccgcgaggtggaggttgcagtgagccgagtctgcaccatcgcactccagcccgggcaacagtgcgagactccgtctcaaaacaaaacaaaaccaaaaaggcagggatgagaagagacaaatcttctttgtggaagaattccaaatgatttatgtagcttctccacatttatgtgcaagcagctgtgtgtgtgactgagtgtgttaatgtgtttgtatgtgtgtgactatgttagtgtgacttaatgtgtttgtgtgtgcatgagcaagtgtgtgtgtgtgattgtgttcgtgtgtgtttgtgtatgtgcatgaatgggtgtgtgtggtgtgtgtttgtgtctggtatgtgcttgaacaggtgtgattgtgtttgtgtgtcaccttctgggagagggagcataaattgacagtggagaaacctggtgaacactgcctcagccaggtgttcaagtcagcattaaccctggtaaatcatgttgacagtgcgtagccccgatgtgatatgatatgataagaatagcactttacccctgtggtctctttccaaaactcataataataatgagaaaagcatgagacaaattccagtagaggggcactctacaaaatgcctgaccagtactcctcaaaaccatcaaggtcatcagagacaaggaaagtgtgagaaaccgtcgcagccaaaagaagccgaaggagacgtaacaaccgaatgtaatcctggatgggatcctggagcagaaaaaggggttcagttaaaactaagggaatcagaatgaactgtgaactttagtgaattaaatcatatatgtcagtactggttcattaattgtaaccactgttcatgtaaaagatgttaaaaatagagaaaactgggtttcagagtacttgggaactctctactattcaatttttctgtaaatcttaaactgtttttaaaaaggaatttctaaaaacaggcagaagagcagagcagacattattcccctgtgccctctgccaccatctactttcctgctctctgtctgtacgtgtgcggagctttatgtctgtgatgatgttcatctgggtaatgctgtttggggtcattttttttttgctttctattttttatattttaatattttataataggcattacttttatatttaaaagtcattctaaaaaaattaagtgtcatacagtcagacgagcacaacttctgtaccacctggtgtgcagtaggcgctgtatttgccgaataagtggaaaatattttgacagttaatgttttgctgcagagccacactgcttagcattttcaaagtttggttgctttgtttttaaagataaattatttaatactggtctacatctttctgcataactaattaaaattcttatcctggattttttagtttctggaactaatgcaactgaagtatcatgagaaagctgcagacaaaggggtttatatcattggaagcagcggctttgactccattccagcagatctgggagtaatatataccagaaataaaatgaatggtaattattgatcaataagcaataatggaatttaacagtaccgtgcaaaggcttcatgtttctaactgtggtgaactaaaatctagttgaaaaaagaaacatagccataaatgggtaatattaaacacatgttttgtttttaatatagctgcacttttaataaaatgctattgagactattgttgagacatggataatactgtattttacagtgatatattattgtctcagtatagtttgggctgtaaaatttctggaaaacaactttggcaacgttataaattcaaacttgctttgtttaggaatcagcacattttaaagcataatttgtatattatagttaaaaggttttaaatttttaaccgtcaaagctagaaagtattgaacacagaattggagacacttatttaagaatggagaaaataatgttacgataaaacatttgaagttactgatgttttgcatatttaagagtgtctggtttagaaaattacctgagcagggtgtggtggcttacacccataatcttagctacttgggaggttgaggcagcaggatctctcgaggccaagagttcaggaccagcctgggcaacatagtaagactcgtccctaagaaataaaaaaaaattagccaggtgtggtggtgcacacctgtagtcagtcccagctcctcaggaggctgaggtaggaggatcacttgaacccaggagtttgaggctttagtaagctatgattgcaccactgcactctagcctgggttacagagtgagaccttgtctcttagaaaaaagcaaaaaaacaaaaaaacaaaaacaaaaaacaaaactgaaacaggtaacttcagtaccatataaagtgttctagacttaaaaaattggaaaatgttccagcatatattaaaaagttagcataactatgaaaccaaagtccaacaaagatagcacacacacacacaaactacaaatcttgcttatgaaattaaaagtaaaaagaaaatactatataaaattttaatccagtgccattttaaaaagttttttaagagacaggatcttgctctgccgtagctcaccgtaacgaatgcctgggctcaggcagtgctccctccacaacctcctaagtagctaggactgcaggcttatgccaccatactcaactaattttataaaatttttgtagagatgagttctcactatgttgcccagtttggtcttgaactcctggcctcaggtgatcctcccaccttggcctcgcagagtgctgggattacagacgtgagccaccatgcgcagctcatccagtggcattttagaagaacaatatattgagaccaaggtttagcattaggaagttatgcaattatatcagaggtgaacagctatatgcccatctcaaaaaatgatttgaaaattgagaattcacaccatttactgattttacatttttaggaatagaatagtttcctacataataaatgtcagggctgggcacggtggctcacgcctgtaatcccagcactttgggaggccaaggcaggtggatcacctgaggtcaggagtttgagaccagcctggccaacatggtgaaaccttgtctctactaaaaatacaaaaaaattagctggtcgtggtgatgtgcaactgtaatcccagctactcgggaggctgaggcaggagaatcgcttgaaccccggaggcggaggttgcagtgagctgagatcgcgctgttgcactccagcctgggcgatggagactccgtctcaaatgaatgaatgaatgaatgaacgaatgaatgaatgtcagaaggcagtagctgtatcatacttaatgaatggtgaaacactagaaccattccaattaaaaagtgaaatgtgaattgaacatctacaaaatattcagtgttccaatccttagacctaatatgtctccatttcttaaaataatgctttaacgtctgtgaagtttagaagttttcttcatgataatcctgtttcttgaggttgttctctgcttttattttgaataagcctttttttccttcataagggagaaatattagtttaaggtttgtttaaaatttttttcagatcctgacacctagaagtcagcattttagcaagcaccccagctgattgttgatgcaggtggtccacttttattggattaccgctttaggtgttctgtgttcttctgcggatcgggttagatcacagagccgcacacccaggccacattcttttagtaaccatcagaatcgctctagtgagttatacgttaatgatctgctttttatttttgtctgtggtcagactaacgacatttatctggctgtagttctcttctgctgcaacagctttgttgatgacgtggttatttattattttgcttggtgtcaactttgtaaggccccatgttttaattttctcttagaattaaaaccaggaacattgtctcttaaggaatgaatatatttcatttatcagattttgagaattagccagcccattatatttttcttttgcctcaatgttcttgagaaactcaataattaaatacttaaccactatgcctgtatattagtcttcatgggtaatatacttgatgtcccctttttcctggcttggtttccaatttttattttatacttctttttatttcattttagtagtcttgttttgagtgttttatatgctatcacagagggtgttttgatagtttttgtgtacattcattgtaagccactgttaataagccttttgaaagctgtcatattttaaagcagaataattcccatggatctaacttcttccttcttttgacaaggtgtttttctgtcacctaggctggagtgcagtggcgtgatcatggctcactgcagccttgaactcctgggctcaagcagtcctcttaccccagcttccctagtagggtggtagtagtagtccctaggactacagatacatgccactgcagctggctaatttttttaaaaaaattgggggccgggcatggtggctcacgcctgaaatcccagcactttcagaagccgaggtgggcagatcacaaggtcaggaaatctagaccatcctggccaatatggtgaaaccccatctctactaaaaatacaaaaattagccgggcatggtggtacgcgcctgtaatcccagctacttgggaggctgaggcatgagaatcgcttgatcccaggaggtggaggttgcagtgagccgagatcacgccactgcactgcacttcagcctgggagacagactctgtctcaaaaaaaaaaaagaaagtgaccctcctaccttgacctcccaaaatgctgggattataggcatgagccaccatgcccagcctcatagatctatttggtaattgtgtcctaaagagcctcccagaattcgggtgagctcaattgttgctttattgggggagattcttactgtcatcagtttttaaatactagaaaagattttgtcacagtgaaatgtgaattgaatatcttcaaaatattcagtgttccaatccttagacctaatagagatagagtttatgctagactactctttctgatggtttacctggccatagctacttcgtaagtctgtgtacaaaaacataataaaactgttgtctgtacaaattttctgtgtcagctgtaggcttagaaaagctagtccctaagtgaatacgcattgtttattattacttaccccaaataatttagatgttattttattttgctttttaccattctcctactcttttaggtactttgactgctgtggaaagtttcctgactatacattcaggacctgaggttggttttttggtttgtcttgtgttgtttcaagttaatattaaaaatattttggaaatgatacatgtgtcttttaggtatgtataatttttaatgtgtgaaagtcaccatgtttaatttttaaaaagatacattgccaagattactttgacttgaaatatactttattttctttttattttattttattttatttatttatttatttttgagatggagttacgctcttgtcgcccaggctggagtgcaatggcatgatctcggctcactgcaacctctgcctcgtgggttcaagcgattctcctgcctcagcctcccaagtagctgggattacaggcatgtaccaccacgcccggctattttttttgtatttttagtagagacggggtttctccatgttggtcaggctggtctcgaactcctgacctcaggtgatccgcccacctcagcctcccaaagtgctgggattacaggtgtaagccaccatgcctggctattttatttttttgagacagagtctcactctgttgcccagactggagtgcagtggtgtgatcttggctcactcaatctctgcctcccggatttaagtggttctcctgccttagccgcctgagtacctgggattacaggcatgtgccgccacacctggctaatttttgtttttttttttctttttcagtagagttggtattttgccatgttggccaggctggtctcgaattcctggcctcaagtgatctgcccaccttggcctcccaaagtgctgggattataggcgtgagccactgcacccggcccctaaaatataatttcttttaaaaacaactgcacagttcattgtattagaatgaattatcatgatctcaacactaaagcatttatcactggtgcacagtaaatgttgttggccaggaaaattttcaccttagtgcaagtcagcatagttttatcatgcgcctaacttaggtactgctgtgaccaaacagaggtgtatgaggtgaatctagtcttactgaatctacagtgcatttgggaacgtaagacattgacgttgggaacgtaagacattgacgttgggaacgtaagacagttgcatttctgggaaaggaccatgttttatgacaatacttttatgctgatagtgcctaacccagttctaggtctgcactgtggcttcagaagtatttgttctaaattatattcattcaacaaatattgtatagtggtgcaaatgcatatagtaactgtgcaagagaaaatgacatgtaaatgaataagatgcaaaccctacctttaaagtgtaataatttagtttggcaggaaagaaaaaaatgtttgttattaaagagatcagatgaaatactgtaggattctaagaatggcgaatacatctaactaagagtccagagatcatgaactttctggagaagctgggatatagctgaatttcaagggctggtgctgtggagatgtgaaggaagaggaaatagtgtatcaaagacaaagatggggtgggatggaacgtgtttaataagaggaagtactttcttcatctcgattgtgggttcagattaacgtaaagaggtatgtaaaatatgctaaaatttgtggttacacagactctttagtagagtataagtgtagtaggacaagccacagacaaaacccctcagacaccgagttaaagaaggaagggctggccgggcatggtggctcacgcctgtaatcccagcactttgggaggccgaggcgggcagatcacgaggtcaggagatcgagaccatcctggctaacacggtgaaaccccgtctctactaaaaatacaaaaaattagctgggcgtggtggcaggcacctgtagtcccagctactcaggaggctgaggcaggagagtggcgtgaacccgggaggcagagtttgcagtgagccaagatcgcaccgctgcactccagcctgggcgacagagcgagactccatctcaaaaaaaaaaaaaaaaaaaaaaaaagaaggaagggctttatttggctggagcttcagcaagactcacatctccaacaactgagctccccgagtgagcaattgctgtcccttttaagggcttacaactctaagggggtccacgtgagaggatcgtgattgattgagcaagcagggggtacataactgggggctgcatgcaccggcaatcagaacggaacagaacaggacagggattttcacagtgcttttccatacaatgtctggaatctatagataacacaaccggtcaggtcaagggtcaatctgtaaccaggcccaggacgcggcgccgggctgtctgcctgtggatttcatttctgccttttagtttttacttctttctttggaggcagaaactgggcataagacaatattaggggtggtctcctcccttataagaataaaaagaagtggctaggcgcagtggctcacgcctgtaatcccagcactttgggaggctgaggcagatggatcacttgaggtcaggagtttgagaccagcctggccaatatggtgaaactccgtctctactaaaaatacaaaaattagccaggcatggtggcacattcctgtaatcccagctactcgggtcatggagacaggagaattgcttgaacttgggaggcagaggttgcagtgagccgagatcgtgccactgcacccctgcctgggtaacagagcaagagactgtgtcaaaaataaaaataagtgatagtgggcctgagtaatttgggaatgcgccatagaggccttattgaaattggctttgaaaagtgaatagcatttggaaggtcaaaggcagcaactggaacaaaggctcagaaacaagaatgagaaaagcatgcttgggacccttggtagcatgtgttagaaacccagcttaaaccaacaaaacaaaaaagaatctattgattcatgtaaccaaatgcctgagagtaaatcatatggctggatctagatgttcaaatgatactgtccgaactctttttttcccctcttgtttctccctttttgtctctttcttttcttctgcttttctttatgtaggctccggacagagcagggaaggtactggcatccccaagtatactttgtaataaaggttcatgatttcttgggaagagctacccagtttatatgtcaaacaatagagaagattagtcattttgctcattcttaagccagttgatgtgacctggggtaatagagtgtgaacccagaaaatctgagacaggtttcagttaattaagaaagttaggctgggcacggtggctcatgcctataatcccagcactttgaggggccaaagcatgtgggtcacctgaggtcaggagtttgagaccagcctggctgttagaaataaattttcagtgccgcaaaagaaatagcgctgaaacataaaatttctcagcaaggcaactttacttctatagaagggtgcatctcgtggatggagcaatggtgagagcacacctgaacaagggaggggaaggtgttcttatccctgacacaggtagcccctactgctgtgtcattccccttttggctagggttggactgcagtctaagctaattccgattggctattttaaagagagcaggggtacgaggaaggacagttacagaacaagtggctcaggatgactaagaacagagcaggtgaccaagggtgactaagatcagagcaggtgatagaggctaggagggggttgtttactgaaactagggtcaaggagacgtaaagaacgaggatgttaaactttaaagaacaaagaacaggggagcggaacataactgacacattggttctttggagaggatctcaggactcattgtacgtaacaatttacaggctgaaaccttcgaagaggaatttattctatcctacaatttcccccctttcaattttcttgttatttcctcttcaaactttttttaacatgtcttggctttgctgctcgactttatcctctaaaagaaaaagctgatctgaatagggtggaggagagctaagggaggttttagttagtgctgcatctgtaagtctttgactagcccacggatgcacggtatgacacaacacccaccaagaatgagtacacctgttacagctgcaagagaagtaagaattgaggctgagttctttccatttaccaaaccacctttctagccacccggagaaagggttatcggctccagaattttagctagttcatgggacaaagcggtaagtctttgtaaggcgctcgttgtgctcccagtgggggtagtgttgtttgggattaaggtacaacactgagtttcaatcataacacaaacaccgccttttttggctaatatatctaggaccattctgttttcccaagccatctggctagtgggccccaattgttctgctatccctttgacagtatccctggtgtaattactaaaccactgctgattataatagatgtaatgtatccagtctttgtttttattaattgtcacctgtaaaaatattgacttaaatcctgcagctatttgatctcgagatttaaattcatctggttctcctcatggaactccagtagcgtttatataaacatgggggtcaaaggacccatgtggggcacttcttttatgattttcttttttatcatgttgacagaatgctagggtggaagggatggccaactggactagagcacaagtgctgctctaattacttgcagaatacccagcaatagtcccccgcaataccaccacgcacctgctcgaggatgaacaagggcagactggtgggtaagctctggaaaaggcttggtttcactgcaccctgttaagtctccaaggaatgctaacttttccgtctgccgtgaaaggcacgaggtgaagttaatatcaggctggaggccacatggccctcgggggctgacccacaaggctcttgacctcagggaacagcagtgaaagagtcttgcatgactcatcgcctcggctgtagggttctggaagagagctaccacacagctcatgcccagtcatgagagaaccacccaggtggaaaggggacagtttgggtatctggcctgcctgttgcacaagcataaccgtcgcttttgtttagcgtgcaaacagaatattttatccattccagccaagcatttgcatccagataccctgtttcaattgctgtagtttgttttaaatctttaacctctacagtagctacataggttttatcattgggtatataatgagagaaagtttggttagtggagaacttagacgagggagaagggggtgcaggatgtgaggaggcaatgaagtacatttcaaaggatcctatggggtccttccctgagacttctcctacaccacagaaatggcctaatgaaggggaagaactctggggagcagcagtcgtcatctgtgctggattacattggttcagctgaccatggggaggggaaactcctttagtaaaatgaatgtatggttttaagaagctgcaagtactagttggggccgtccgtccttgctctttggtgttttatagagcatcggacaaatttcggcagagaagctctgctctaggaggacaagattcccagttcatactggactctttgtcaaagtcctcccaaactaacttatctcagttaacagatttccagtctgaggagagctaggaaggataaagatacttttctaaagtgtagatttgcctctggtttgacaaatcttcacagggcatcagaaggcaagcgtcaaaagtaatggtttggggtgaacttgacctagttacactagtaaagagaggactagcaatagaaggggaaaagaaagagatgcagtataggaggttcaaacccattttcgctttagcttggttggagttggccctggaatagctgtccatgattctggagggggtggtgctctttggacccaggtgtaatgagtccatcctctttctgctgttcgaaccgcggtcttggtgcttagaagcactaggtagggtccttcgaaagcgggttcgagttttccttccctttagcttttgacaaggacacggtcctcatgctaatgttggtgtactggaaactctagcgggggggtacctgtgctgaaagacctatagttctgagggacgagaaagtggaagataaaccaaacatacaatttctgaggaactgatcttttgttttgactgtgggaatgtcagcagtggagtgcaaacagggcaacctatacaacacttcgtaaggggataagcgaacatctttccgaggggcagttcagattctaggcagggcaatgggatggcagctagtccatggcacccgagtctctagactaatttggttaggtggcttttttagagtttggttcattctttccactcttcctgatgaaggtgggtgccagggagtatgatattcccatgttatatccagtacctgggctaatttcttaatgacatgtacagtgaaatgagtcctattatctgagtcaatgctttctattaatctaaacctgggtataatattttcaactaatgccttgactacattactagcagttgtacttgaaaagggaatagtttgtacccaacgagtaaggtgatctattattactaataaatactttagacgaccaattggaggcatctctgtgtaatgaatctggatactttggaatggccttaagcctggactccttcccccaaggggtaatctttttatagtttgtttattggttttcttacatactgagcaactgtctgtaacccgtttggccggggtataaattcctgtgcacccataaactctgaggactgcgtcacacatggcgtggggcccccagtgggtcccttgacgcagctggaacaacatttcgctcataaggggtttggataacatttctctctggtctggcagtatccattttccttcagaattctctttagcaactgtttttattaattttttagaccaaagaaacccaaatgccattttatatttgacaattagcagatcagctaaatgtcacctttctattagtgtgctattaatgttaaactcaattttaataaaaccttttagacatatttatccaattttaatgtctgaccataagttttttatagactctttttaaccctttataatttttgttaaagaacaggttagtactttaagaaaaacctgttgtgcttttattttaatgtccagtttacagaaactttaaccaatatgtttacacacagaatttcctttacaattaacttttcaaaccttgcttaaaccttcaaaacaatttttaaccttttaatgtaggtaaaaatccacattcttatgcctccttataatccttttaccaaaagtatattttactttccttacacaccttgcacataaactgtttcttcaatagttttacattcaggaggcctaattacttttcaattatatgacatttcttgcataaattcccttttataacatttttcacgactttcacagacgacctttgacatgccttaactttctgacttgtcgtaaatatccctttctttaaacaaccagttaatttactttaggacaagaatttaccatataagattctttttacataaattctcctttttttttttttttgagatggagtctcgctctgtcgcccaggctggagtgcagtggcgcagtctcagctcactgcaagctcgcctcccgggttcatgccattctcctgcctcagcctcctgagtagctggggctacaggctcccgccaccacgcccggctaatttttttttttttgtatttttttagtagagacgggctttcaccgtgttagccaggatggtctcatctcctgacctcatgcttcacccgcctcggcctcccaaagtgctgggattacaggcctgagccaccgcgcccggctaattctcctttttttttaatgtcaaagatgataaccattcttttccaaagcacactgccttcatgtctgtggactagactgcctgaggccacaagattagaagttaggatcatacatgttagacttaacttttagcaaactttacttttgttgaaaaccttgtaagtttgggattttaattatgtgctaggtgtagagcctaggacctagacagaagtgcagatgaggtctggcttctcctagcatttaactccatgtgtcctaggttttccctagctgcaaagcaggccagttgtacagctaagaaacggtagtctgtttggctatctgattaatagctctaagttcttgcactaaccagtatgacccatctggcttctttacaggcagaatttgagtgttatagggagacatacagggtttaagcagcccgtcacagagaagaccttcaattatcaattgtaggttttaaatttaccctcacttttaaaggaatagggtattgctttctcttttctacttccccaggggtttttaatttttttaatttaacacgaatcggaggaatctgtaactttcctcgattcctgtcttttgaccataccttgggatgaatgtgttctttgtctgcggtggggagcaagtttagggaggggaggaattttccctaatcaatatagaggcgtaagccaaattttagtactaaatctctctctgataagtttgttcctgcctctggaattaacagaaatttaatatgaactgatttgcttttatatatgacttttgttctttttcccatttgggacattgtcttttgaagtgacctatttttaattcgaaacatttgttttgtcctctttctctccctttgcctcttcgtctgtgtctctgtctctctctctctccgcctctctgtctctttctctctctttgcctctctgtctctttctctctctctctttttctttgactctctctctctctctttctctctccttgactccttctgttccctgtcagtctttctcctctaggattttttttctctacctttgagtctcctggctttactctttcatcctctttatgttgcctggagagtgggggtctaggttctttacaggttctggccccctgggtactttgttgtatggtagacagcagaatttttgctttctgcttttttcttcatctcttcttacatacactttttgggcttctcttagaagctcttctataggtttatctttccagttctctatcttttgtaatttcttattaatatctggccaactgttagtgacaaaatgcagttttaacattccctgcccaagaggatcctcgagacctagaccagcatattttctcatttgttcctttaatctaaaaaattttataggtgcttcatctttcccttgctgtacataaaatgtttgggtaagattctgggatactgattctttaatcccctttattatcaattccctaaggtcctgcatattttcttgaggggctgcattgttattgtcccacctgaggttttgggcgggaaatttttgatccgctgtaggaacgttttggccagaagggtgttcacgttccaagactcccatagcagttcgacggatcgtggctctttcttcccccgagaagagaggaaagggaagttctgaaaatcctttttacattgctctatctcacgctgaagtccttttagggaagaggacttaacgctcgtagtgagtgggctcctgggacagttcccaggaggcagggttataaggagggggacaatggggataggagaagggtctgggacagcagctgctttttcttgtttttggtcctttcattatccttctagtattttaacatgagacctagggggcactcaaggggaatatccttgttatctttgtccttcttggtccctgtcttgcttggggtatttcccatattgggtcctggttaggccccatctctcatcttagagatgtgtctcctatcctttagccccacctgctggaggctcctcgcattcacacacactttcaacccccgcagagtatcccgaccaccgaggaaacgcttggctgctcctgtggtgtttcttaccttggtctgtgcacagagttacctggtcgctgcggtgtgtgatgatccctttccccaggtcgccagccagtttctttctgcattgctgagagtccgggtttatttgtcacacccggtgggtcttgattccttacccctgaggccactgcaacaaggcagcggggcatgcctcctcatgggagaggaccagacccttcaccaaaggagaatgggaatcccgggcgggcccccaaatttgttagaagtaaattttcagtgccgcaaaagaaatagcacttgaacataaattttttcaactaggctgtagcaggataagctgcagacaaaacccctcagacaccaagttaaagaaggaagggctttattcggctgggagcttcggcaagactcacgtctccagcagtcgagctccgcgagtgagcaattcctgtcccttttaagggcttacaactctaagggggtccgtgtgagagggtcgtgatccactgagcagacatgtgtccgtttcacctaggttatctaatttgttggcatacacttttcatagtattcctttatactcctttttatttctataaggttggtaataatgttccctcttttattcctgattttagtagtttgggttttctttctcttttttttggtctgtctagccaaaatgtgtcagttttgttgacctcttcaaagaaccaacttttagttttgttgattttttctattctgtttcatttatttccacaatagtttttattgttcctggatatgaaattaatataaaaatcagctgtatttctgtatgccagctacagttagaaggtgattatttttgtaaaaaacaccatttatgatagcattaaataaatcaagtacctaagagtaagtaatagaaagtgtacaagatttctttgaagaaaactgtaaacctttattgagggaccataaagaagacataaattgaaggatccagcgtattcatggattaaaatatgaatccattttgtagttaattttcttcaaatttgtttataatctcatgcaattcccatcaaaatcacaaacaggtttttttgtttgttttgtttcgatgtgcatctggacaagctgtttctaaaatgtatgtggaaactcaaagggctgagaacaggcaagatattcttgaaagagaataaggcagaaagacactcttggagatcaagacctgttattaagtcagcataaacccttgacatatggtaaaggggcttttcctatcatttttcttttctttttacaaatccacttttactggtatttatttacttttcattagttcaaatccttgaggagtacagcatcacagagccgccgtgactagtggcctaagcaggacggctgctttggaattaggcacacattgtgccactgtttccgtgggcacacgttacctttctccaccttactctggttttgtttggtttgctgccaggagtcagtattattctttgtacacataagcgcatttcctgcccaaatcaaatctcattttatgtcagccataaataccttcagttttaagaagagctgtgtcctccctttggttctggagatcctgctgacggcaaaaacggccttggaccacagctttccaggcatacttgtcatttagaattcctcctcccagcaggcctccgggcttcaagttggcaggaacagcaagggggcttttcggtagatgctgctgggacaattgagtatctacttggagaaaaaatggaattggattcatacttttgcaccccgtaccaaaatcaagtttagatggattgtggatgccctcacggttgggaatggcttttacaaaaagacaaagaggcattaaatgtaatgaaaaagtgatacgtttgtgtacttttaaaattgagaatgtttcccaaaacacacgattaagaaagtcaaaaggctagctgcaatgtaggagttacttacaacacgtggtaaatcctgacatcacaattttgagcataagaagccaaacactcagtaataaatcttgcttgattgcatttctgtagagcttagaaacaggcaaaactaattgtactgtttagggatgaattcttaggtgattaaactctaaagaaaagaatttttcttgattactgtaaaggcaggacggaaggagggccttcttagttgctggttacctgtagttcttgacctggatgtttacatgtacgttggcttcataacatacatgaatatacaatttaataaaattgtattaggtacgtctctatatttttctgtgaaacgcaaatagttttttaaattgaatgtaattttttccttttcaatggcttagttgtataagaaaatatgtttagatttttaaaaagctgttttctcctggtgtttggaatctttacatttgtagagattcacataggcccttttggctaggctcagattgagtagataacaaatcaaacctttaagactttagttctgttgtagttttaataaaacagaagaaataaatctgtaccagaatgaaagttagatttggtatctctgcttttcagtatcatcaaagctgagataggaaaacctgaatctttggatggttttattgtttctcttattttgtttattaacaatgaaaggtaccttcatatctgcctcccacatatccctctttgaaaatcttgtgacagaattagttttgaatctttctgaattactctgttgacctaaacaatgtaaacaacatagaaggaaggacataatacaattatgtacaatcaatataataaatgaagtttattcctgtaatagagaattaaaaggcccacctagaggttgggaaagaaaggtcagtgctaggccgggcgcggtggctcatgcctgcaatcccagcactttgggaggccaaggcgggcggcttgcctgaggtcagaagttcgagaccagcctggccaacatggtgaaaccccgtctttactaaaaatacaaaaattagccaggcatggtggtgggcacctgtaatcccagctactcgggaggttgagacaggagaattgcttgaacctaggaggcagaggttgcagtgagctgagatcgtgccattgcactcccgtctgggtgacaagagcaagactctgtctcaaaaaaaaaaaaaaaaaaaaagggccagcgctgtgatagtaaattcagaggtcgtgtcctctcctggggtctcagccactcgtttctcggtggcgctagaggtaagggttggggaagctgtaaagagtattggtagaatggaaggcactgacagcccaaagtctcatgaaaggatgaaaaatcagtgaataaatgagagtctgagtaagatcaggcaaatactaaggactctgtactggctgtgataccaaaaagaaatcaagggattgaggaaagcaattaaaatacaaatcattattagtgaactttaaatgttttaaacaattattttactaagacttcagtaggaagacagatctataacttggggctagagtaagaggtgttggaggtagacggggaaccaggtgtaacaggatggagagatggacagtacacagtgtatgtatgcataaatgtgcacacggacatatccagaaatgttgaggaatttgtgtaggatcgagagaggattagggtggctattcctgcagatcatatggggcagaaaaaaaaggattagagtggctgatcttgaaggaatatggtcaattagttgagtaaaattgatgaagtaaaactaaataacttattacagaatataaagaatgataggaggggagaagaaagggcttctcggtgtaaatattgggtatgatcaagctaatgaatgtgactgctccctagctggtcatgaaaattctcctcaagattattaaatcagggattatgtcttgtccaaatataagtgaaatattgtttgtaacaatgataagttacttggctttacattttagtaactaccctttcatgtttctttaactcttgaaatattttattaggggttgagcattcatgatggtacctggaagtcagcaatttatggttttggagatcagagtaatttgagaaaactaagaaatgtatcaaatctgaaacctgtcccgctcattggtccaaaattgaagagaaggtaaattaacttaaaatccattttttatatatctagtctaagtatattgttgttgggttggctattaataaagtatgttactaagaaaagcttggagactaatttgtagtaagttcagaattgttttcacagataaataagatataattaatccattaccatatgcttgagataaataagatataattaatccattaccataagcttaagataaataagacataattaatccattaccataagcttaagtacttcgtgtgtaataaaacatgtgaatcctaggaaataagtgaatcttatgatgacttttcactatcaatatagaaattaactgtcaactaaattttatgtgagaactttttttcttttttaaaaatttattttagtttagttttatactgcaggacatatgtgagaagtttagaggtaagaatttagggttgggctgttgaaaggagcgttctggttttttttttcttttgagacagagtctctctttgttgcccaagttggtctcaaagtcctggccttaagtgatcctcctgcctcggcctcccaaagtgctgggattacaggcatgagccaccatgccctgccactgatttgcttattcagacatttaccagccaaagttgtaattgcaggaaatgcaaaatattcataggtctgtcttgcaggtggccaatttcttattgtcgggaactcaaaggttattccattccttttatgggatctgatgtgtctgttgtaaggaggactcaacgttacttgtatgaaaatttagaggaatcaccagtaagtatatatggtttatttatcaataaagtgtgtgttacagttcctctttctattcagtgtgggatatttttgtttataaggcagaaaaaggaagagctaagtaatacatgtttcagcctctggaaatacacagaatcattagggtagaacattttgtattttataaccttgtcttttgattcagatctggctgctgaatatctttttaatgtaacacaatagcagcaaattcaatacgggaaatcctgctgtcataagcaccccagaatccctgtttagggtttcagttgctagaaactcttttgcttgtggaaatgtctggaaccctttctgtcccctctctccttgccacgcctggagttccatcctgctgcttttggcgaggaaagtaattgctttcattgccgagacttcaggaggaaattatatttcaagttaaaaggtggagggcattttcttataggagtctacgttctgtaatgtatgattgctaagctcagatatattagggattatgtagatttttgtgcccaagtaggggaagctaattactatttataaacaattttctttaaaaagtagactatcatacttcctgttcaccaggtctgacaaaacaaacaaaaaataggctcccaatgtctggtttctgaacaagatttcagaacataatgcatttgtaaagtggaaactgcttttgttccacatttgtgatggaagagaaaggtacaagtaactaacattcttacttggtccaaaatgtagggagtaatgttctaactttgtcttctccatcatctaggttcagtatgctgcgtatgtaactgtgggaggcatcacctctgttattaagctgatgtttgcaggacttttctttttgttctttgtgaggtttggaattggaaggcaacttctcataaaagtaagtaagattttatgaaattagattatttttattagaagtattttccatgagttttaaaaaaatatcactgacggtttttttttccctttagttcccatggttcttctcctttggctatttttcaaaacaaggcccaacacaaaaacaggtaatttcttttgtattaagacactaaaataatatttttctttgtgcaatgacggtatcatctaacacttgacagggcactatgtttcagatactcttttaagttctttatgtaaattagattattcaatcttttcaaacaccccttgaatgtaggtattattattatctccattttacacatcagagaactgaggcacacagaggctaagaaacttgcccaagtttctccaggtagtacatggcccagctgggatgagaacccagccatttagctccagaaattgtgttctcttcacttccagaaatctcaaatattcttcttcctccatttttctcctctgttatcttttcctttgtgcctcctctgcccccagtttcacttcctcttccacataccctggattccgacgggggatcaagtgaatttctgtgtgtccagcatccccaacaataggactgcctcattttctaccgtttggcttacagatcccaaccctggctcaggccttgggtcattagctttcatctccttgacaccaggcactcctgggggaaatcccactgctgaacagatggtagcagcaagttcccgtttccccctctgtggaatgttagcatcacttgctgattcttttccttttcgttagtcttgcctcttatctcctctcagtggctttcttcaaaatctacccaactgcagctgtcttccctatctgtaaattatcccaactcctacctcactaaaataattgagagcactgttttgtatcccctcaaattcctactctcagacctatcatcattgttcccatcctgaccttctttcctcctctctggatgatatactccctgtacaaggctaatccccgcctgtgcacttaacgtagcatcattgttccatcccgaccttctttcctcctctctggatgatatgttccctgtacaaggctaatcccccgcctgtgcacttaatgtaggcactgtgcaggaatgcgccaccacgcccggataatttttttgtatttttagtagagacacggtttcaccaagttgggcaggctggtcttgaactcctgacctcgtgatccacctgcctcagcctcccaaagtgctgggattacaggcgtgagccactgcgcccggcctcttttttcttcttattgtggtaaaatacacaaaacataaaatgtaccatcttaaccatttaaaaatgctgagtggtattaagtacattcatctttttgtgcagccatcaccaccatccatgtccagaacacttttcatcttgcacaactgaaactctacacccgtgaaacaataactcctcatttccgccctcccccagccccggcaaccgcattccgctttctgtctctatgaatttgatgactccaagtgcctcatgtaaatggaatcagtctttgtctttttgtgactggcttatttcacctagcgtaaggtcttcaaggttcatccatattgtaagcatgtgttcgaatttctttaagggtgaatgattgtctgttgcctgtctggatcacattttgtgtatccattcattcatcagtgaacacatgtgttgcctccagcttttggctattgccagttatgctgctgcgaacatgggtgtacagatacctcttcaagactctgctttaaattcttttgggcatatactcagaaatggaatgctagaccgtatgtgaattgtatatttaacttcttgaggaaccactaaactgttctgcagagctgctgcaccgttttaccttcccacaagcagtatacgagagttccagtttctctgcttccaaaccgacatctgttattttctgtaatggccgtgaggtggtgtctcattgtatttttgatttgcatttacctgatgattattagtgttgaacatcttttcatttgcaattattggccatttgtatgtcttctttggagaaaatattttcaaatcatatatttgacagaagattcatatccagaaaatatagagaactcctagaactcaataacaaaaaacaacctaattcaaaaatgaacagaaggacttgaaaatattttctgttattctttgggttgccgttttactttgtggatagtgcaggcttctgtctcgtggttggtagtgcaggcttccatctcttgcttgaacttttcgtagcattcctacggtttctttctaatctgtcttcccactgctgtccaagagatctttctaagacacaaaatctgaccttgtcattgccttctttataaaatgttcctggcccactgctttggcagtgattcttaactgagatttcatatatcagaatcatggccgggcgcagtggctcacacctgtaatcccagcactttgggaggctgagggaggtggatcacttaaggtcaggagttcaagaccagcctggccaacaggtgaaacttcatctctactaaaaatacagaaattagctggacatggtggtgcacgcctgtagtcccagctactcaggaggctgaggcaggagaattgcttgaactcaggaggtggagcttgcagtgagctgagatcacaccactgcactccagcctgggcaacacagcgagattccttctccaaaaaaaaaaaaaaaaaaaaagaatcacctaggaagcttttttcactgacacatgccctcatcttgcttctggacgttctgattcagtaggtctggagtggggcctgaaagcatagagcagtggttcccaactttggaagagaacccaaaacagatgaccagagactctggttcggttggtctggaatgcagcctgggcactggggctctctaaatctgcccagtgatgctaatgtgctgccagggttgagaatcaccactgcggaggaaggaagaaggttccagatttgagtggttttggtacccacccctggagcacaaatggccgaaagtccatcttcagagatgtgaggccatcctagacccttcatgatctagttctggatagcacataggattcatttttcatccaactttgattaattgatagtagccacccagagactatgctgggtcggacaatgtgtgtagcctgagagaggattagaacccattagtgtgggcgccatagcaggagatgggacaggtgtggcatgtgtgtctgaccttgtctgtacctcttgaattgtatgttctggaaaggctatgctactgcatcccttcttccctttaaataatgggttctcctttctggaatccatctacttttggggttttaaaacaaccattaaaatgtgtttgtgtgtgtgtatatatacagttcagaaccattgccctctgccctggtagattaataacaccctcctctgagttatgcctgtatgttttagttcatgtcacattgttatttaatctgtttatctctctctccccccctttcctcctactaaactgtaagctccagcaaaggcagtaattatgtctcagggcctcaatggtatctgacccttagttgatacttcataaaaatgtgttgatcatgattgaattctttatcacctcattcctaaatttagtgattgtgaaagatgctaggataagtcctcaagaatttagttttttgagtcgaatttttacatctttaagtggaacaattatatacctatactccaggcccatatttccattacttgctggctatttttgtcttgtcgcctcaaataggtatctaaaaccagatttctatattctgccccccgataaaaactatctccagatcatctttatttcctccctatttcttaccactccccttccccccaacatcacgccagtcttcaaaactgacagcttcaaagaattagttttcgctccctgcttaaatgatgacgggatattctggcagataaaataatgttttcatctattgacaatgtctcacttgaaatagaatagtcggttttactatgttccaggaggaaatgacgtatttatgaaatgcgccctttgccttctccttcacagattgatgctgcctcattcacgctgacattctttggtcaaggatacagccaaggcactggtacagataagaacaaaccaaatatcaaaatttgtactcaggtgaaaggaccaggtatttcacatatcacttaagaatgcttgggaattttatactcttaagctataaagtacaatgccattacaatatattctttttaaagcttaattgttttagaaatacatttgtacaaattaagtaacttaaaattattctgtcaaaggaagattgaaattattgatataatccaattttattagtgcatccctccctctggctgtttttggagtatgattcagtaattcagaatggcaaattttaattagtattaataggaaaagggattggttgatattcacctgtttgaatctcatatgcaagtagtgtaattataatgtcagtcaaatctgtgctctaggatttctttagagtctctgaacaccctgacattgtttgtaaaatatgtatgcacacgtgcacttttcaagggaagggaatggcttctgataggttgttaaaagaatgttgcccaaaacgttcaagaacttttgctgtacattttacagaactatgcagagacagacaggtccacttgtgaactgtggtataattactgtcagagacagacaggtccacttgtgaactgtggtataattactgtcagagacagacaggtccacttgtgaactgtagtataattactgtcagagacagacaggtccacttgtgaactgtggtataattactgtcagagacagacaggtccacttgtgaactgtggtataattactgtcagagacagacaggtccacttgtgaactgtggtataattactgtcagagacagacaggtccacttgtgaactgtggtataattactgtcagagacagacaggtccacttgtgaactgtggtataattactgtcagagacagacaggtccacttgtgaactgtagtataattactgtcagcccttttaggtcacaggctataattttttattgagacggggtctcactatgttgcctaggctgggctcaagcagtcctcctgcctcagccttctaaagggttgggattacaggcatgaattgccatgcctggcccacgggggattttaatcaagccagatgatagtatgtttccatcttgcccttttctgaaattcccacctgactttttaaggtaagttgactgtattttcattatttgacaggattataaatgctaatgttccgtttgtttataaacatttttttaacttatgtttagtcgttattctttaagaaaaaattgagaggatttttttgttgtttttaagtgaagtgtgtgaatacagatagggatcggctcagtgtacaatagagaaacaaaaaacctaggatcattggcttcaatgattgtcaagaagcagtgcagtgcagtgggtggagtgtggactctggaaccagctgcctgggtgtgattttggctcagtcactacctgttagtttggacaagtcacttaacctctctctctatgggataaaagtaatattgaccttaaataattgttatgaaaattaaatgagtttaatagacctaaagcacttagtacagttcctaacacttaataaatactttcgatatgttatttttgttaagtgaccagagtatctattgaaaaaaatctgcacacctagagtaagatataaaatctaccatttgatttttgatgttgttgaatgggtacttcatgattcctttctttttccctgatcaactgttttctgcagaggctggctatgtggctacccccatagctatggttcaggcagccatgactcttctaagtgatgcttctcatctgcctaaggcgtaagtttggttttcttccaattagaagatcttttttatctatgttatattttagcttattttgatttgattttcaggctttgggtttgcatgtaagcatttatagttcagttcctttgcttcaaaaatataggtaaattaaaactgtgagaaggacagcttcttaccagcccagagttggtctcagaggaacaactgtggaggtaaatgagaggagacagaaaagttggagagccatgagttaacttcagccctttataaagatacctcaagtccagagtcagccactcaaaaaagtccctgttgttaatagtattactaggagcttccaatcagtgcctaactatacccagctggcagtagtaaccctgactgacaccagcataaatggaaccatgggatcctggctagatgattttcagacgtactgtcttactggagcatttagctgtccccctaaaactaggccagcttttcaaatgagcagaggcctgctgctgagaagtaaaccaggcatgacctaaaacaggattaataaaagtaaaatttgtatatagtaaaatctaattaaattttttcaaatacctaggtcccccttgaaaatatttagcatttatgaatgttagctattatatttttaaaaacttctttttcatccaatttaagttctgtttacactttcataataattgattatctaaatttattccattcgggtctttctttaatccccctaagtctgaggactgtccttgtaaacagcagcggttcttcggggtgatggcgcacagtgcacccaccaaacacatgcatagaatggaaacagtatctccaggaacagagccagtctagatagggttggctgtggtgcaagtttctcctgactaatagctacttgctcatttggctgattttaggaaggaatcaaaggtagccgtgattaccatgaagacttgggttttcaggggttctgtagcaatttgatagtgaggcctgtgaaataggagactggagaggagctgagtgcactgttttctcttgttattgttttataggggcggggtcttcacacctggagcagctttttccaaaacaaagttgattgacagactcaacaaacacggtattgagtttagtgttattagcagctctgaagtctaaacactggaagaattaactgaagtcataacgtgcgtgaattaacagcttctctatttgatatttgaaattcttctgtaagcctgtctgagtgtatgtggaaacgattgtcaaatctaaaatatctatatattaaaaagtaggaaattgtcctagcttaccctaaatttcaaatctgagttgattttgtgattttattgcttataacagagaactcatatttgacatatttttttcattgatgtgttcctggtagattttcacgaatgagctggcaggtctaatgggggaggcggcgtcccagtctgtgttgcagcagcattctcatcgggggtgcgcacaccatcgttactgtcgggcagtaactgccgcttgccttgccgcagtaggagggaaatctcaccttccttccacatactgtcttgagcctttgctaaattaaactgcactttttgctatttttgcctagtttttcgccaatctacactgattttggactgttacctaagttgaaaaataaaaggttgtcaatcgaatggtggtttaatgtttggacctgccgatgtatttgtatagtggtagaaacatgctgcttaagtggcctaacctgtttcttgccaataagtaggcttatcattttatctttacgtaattctatatctgtgactaggtttttaaggatacagcttataagttgctatcaattttcactacctaagcagaatttttctctaatttactttttgtattttaactaggttttacatggaagccctaaaataaggcaaaagactttttcttttgtaataagcatataataaacacgtatatacatagcaa

SEQ ID NO: 35988 - DNA, 1178 bp, Homo sapiens
gcgaagcgaggagcagcgatggacggtcgggtgcagctgataaaggccctcctggccttgccgatccggcctgcgacgcgtcgctggaggaacccgattccctttcccgagacgtttgacggcgataccgaccgactcccggagttcatcgtgcagacgggctcctacatgttcgtggacgagaacacgttctccagcgacgccctgaaggtgacgttcctcatcacccgcctcacagggcccgccctgcagtgggtgatcccctacatcaagaaggagagccccctcctcaatgattaccggggctttctggccgagatgaagcgagtctttggatgggaggaggacgaggacttctaggccgggagaccctcgggcctgggggcgggtgctctggggagggtccgctgtgttactggccgccgccagggtcgccaccggcgccctccctccgcgcctccctccccctcgagccgccgcgatgtcccctgcgctcctgttccctcccgcgtagtgcttgcctttgttccaggaatagcgctccaggctcctgctgccgcccctgggcctcactctggagcgagccgccgccctctccttccagccagccagcccctcccatgtacatttggacgctgtcctgcgctccagctgcaagctgggctcctgttacacactggacagaccacccactgccgccgctgccaagccctctcctccccaccagactgccagacgactacatcattctgcccacagacctgcgctgccacagccatcgccatccatcgcatcccaccgacagactgctgctcctagtgatctggactcacctcggaggtatctgggctggccacagtccctggacagtgatccagacagctggccgccccccaagggatctgtcaccttcagcgagacctatttcctccccacccccagaaacctcttgtgttcttgcctaggcccaggtgttcctggcagccaaatcgagtctctcattttctcttgtggaccagttagttttgcccataacgcagtattctgagtttgcaactgtctctctgatgtgtgccttttgttcaacacagtaacccctgcattctgctctgctctaatacactacctggagaaagtcttttccttattttcaataaatgtcagacattattgaaaag

SEQ ID NO: 35989 - DNA, 13668 bp, Homo sapiens
gcggaagtcgctgaggggtggtgaagcggttgggaaagtgtcggtttatcttcgcgccccttgcgttcttgccgcggcttgcctgggcaggtaaagcgcgattgcgagagctcggcaaccctgccgactcagccggaaccggctcccggcccgaggggcgtggtgtcctggtgctccgactccttccgcaggctccttgggacccgcggttccgggagtcccttgctcagggtccctttcctgcagtgaggcgccgtccgccttccctgtgtccccgcagacccccatcatgggcaataccagcagtgagcgcgccgcgctggagcggcatggtggccataagacgccccggagggacagctcggggggcaccaaggacggggacaggcccaagatcctgatggacagccccgaagacgccgacctcttccactccgaggaaatcaaggtgcgagcggtgtggaggaacccgattccccttgactaatgttgaggagaggaaccctccactagattcccgtcacatcctttcgaaaaacaccagaacggagagggaggtggtacattacccggtgcacttaaaagccagatggtcctgtaagagttctcttagcggtccaagaacctgtgtctaattaccaatatgagaaagtcaccctgagggaggaggtgctcacttggtttaacatcattaaggagaaagcagctctgggacagagtttcaaattcttaattaattcagagtcgagctaacagtaattgagccccagcttctgcttttctcttaggtgtaattaattgcactgctttgagacaaattccctcacctttacacaaactggagcttttgtaaaagttagtttgggaatttatccattttggaggcaaaccaggtacatatacaagctgaaagtagagcggaacagctgacggcagttgccagaggtgtttagttctgcccaacacttttgattcaccctacttattttttaaaagacggtggtctcactaattagccgggcgtggtggcgggcgcctgtggtcccagctactcgggaggctgaggcaggagaatggcgtgaacccgggaggcgcagcttgcagtgagccgaggtcgcgccactgcactccagcctgggcgacagagctagacttcgtctcaaaaaaaaaatataaataaaaataaaaaagacggtggtctcacaatgttctccaggctggtctcgaactcccgggttcaagcaatctttatgccttggcctcccaaagtgctgggatcgcaggcgtgagctacggtgctggccggttcagcctacttttttttttttttgagaccgagtctcgctctgtcgcccaggctggagtgcagtggcgcgatctcggctcactgcaagctccgcctcctaggttcacgccattctcctgcctcagcctcccgagtagctgggacgacaggcacccgccaccacgcccggctaattttttatatttttagtagagacggggtttcaccgtgttagccaggatggtctccatctcctgacctcaggagatccgcctgcctcggcctcccaaagtgctgggattacaggcgtgagccactgaacccaccctacttattttttttttttccttctttgagatggagtctcactctgttgcccaggctggagggcagtagcacaatctcggggcactgcaaccttcgtctcccggactcaaaccatcctgcctcagcctcccgagtagctgggactacaggcgtgtgccaccatgcctggctaattttgtgtatttttggtagaggtggggtttcgccatgttgcccaggttggtcttgaactcctgacctcaagtgatccgcccgcctgggccgcccaaagtgctgcgattacaggcatgagccaccactcccggcctcaccctgcttttttttaaagcgtacatagaaaagtctttcagcttctagaggtcagtgggcggtgagggtctgtctgaaggaggcagccagcagctactgaacttctctctagtgttgtttaaatatgacttaatcgtgcttaagcaggccagtgcaaacatttttcttcctgctgcagcctgtttaaattcaaaaactcaggtgacttaactcctgcttcaaccacactcctgttaaccaccttcatatggtggatatttccagccgcagggctcagtccaaggacacttagtgattctggcagctggtatttatgtgttatgtccaaaaggaactaattgtttcaaggaacaaagtaggtttaggaaagataaagctgccctctgcccaacataccctgttagtatccaatttcatgttaatcatcatccatttaattgcttggcagctcattccatctgtgtttgtcctcatgttgagcgaggtgatcacatctcacaccttcttttggatcttagttttgagcctgactacaaagaggctgcttttatgtggccctacaacctgtggtttgaacttgctctctgaatttgttgcattcttgaagagctgtgtgcaaagtgaactttagaatcatgtttctctaatgacttgacgtcctttccccaggaggtaattttggtccctggtcccaagaaggctatttaagacaccaaaggaatcaaaactactttcttcagaagtatttgttctgttactattccaaaactcctccaggaaatgttgagcacacacatcatctatggggaatgatttcaagcagcgtccattctcacttcattagaagttactgaaatccccagataccaaaaaagtcgtgaattcttttaactacactagggtgctattttggtcataattagttatccttagtgtgaagtgattccagtctgttatttaatatgtagatcttgttagaattcaaagaatacaggcatcatttggataagctgaggtcggtatttgagatgaaggtgctagaagcctgcttaactccctgaagagtcttttccagcctgaaccttctgctctttttaagtctttggcttctgactgggaaaaaatctaaaaggtgcatgactacatatgtcatccagatagatttggatgagtttatttcttattctggaatacctcagttatacggagcttaccacactggaggttatcatttatcctaatgagggttcagtctttgtcttgctttattccccagtccctagacagaactttgtgagtagtttttcccttcctcaaaatctggatttgcctattttcaagttgacagctctagaattgttcctcttaaattttcatgtacagtcatacatcacttaatgacagggacatattctgagaaatacatcattaggtgattttatcattgtgtgaacatcatagagtgtacttacacaaacctagtctgttctcatgctactatgtagaaatacccgagactgggtaatttataaagaaaagaggtttaattgactcagttccgcatggctggggaggccttaggaaacttacaatcatggtaaaaggcacctcttcacaggacggcagaagagaatgagagcaagcaggggaaatgccagatgcttataaaaccatcagatctcatgagactcactcactgtcagagaacagcatggggaaaccgcccccatgatcgatacctccacctggtcctgcccttgacacgtggggattatggggattacaattcaaggtgagatttgggtggggacgcagagccaaaccgtatcacctagtctatatggtgtaacctgttgcttatggactataaacctgtacagcatgttattctactgaatactgtagacacttattccacaagtatatttaaggatttgtgtacttaaatgtatctaaacatagaaaagataacaataaaaatatggtataatcttatgggactaccatatacacagtccgtcgttgactaagacatcatgcacatgactgtacttcaaatcttgcttgattaagggaggaacatgacattaagctagtcttggattcgtagtagccccttccaagtgtgtttcatagcttcttctagaattttgatgtcaacttctttaatgacaacaatagctaataattagcactcactgtgtcagacactatatagagcacttacatggactgtctcagtcttcacaaccttaaaaaatatatttctattttgcaggcaaggaaactgaggcaccactagtaagtttccgatcctaaccatgaaccaagatagtaacagctgcgtctttagaatgaattgtcaatattgtctgttgtagggagctcgcttatggctttctgagtaaactgctctgcttctaggcaccagagaaggaggaattcctggcctggcagcatgatctggaagtgaatgataaagctcccgcccaggctcggccaacggtgtttcgatggacggggggcggaaaggaagtttacttatctgggtccttcaacaactggagtaaacttcccctcaccagaaggtaattgcctggggagtgttcacatatttgtcttaacataaattctcttctttctaaaacatctctgagagagaacagaaaatggatgtttctataaaatggatgcctagtggaaaaataattttgcttaataagtcttaaggttcaaatgttaaaccttggtggtctctaggtttagagtacagaagaaagagaatatttctgtgtcacagacatctttcacttcagatcctcagctatctgttcggtcaggacttttccacagaaacacaaaaatctgtcttaatgcagtaagggagcactgggctggaatcttagaaacccacatttgagcccacattggccatgctgtcagtcacctaacgttagttaacctgagcctcagcgttcgtttctgtaaagagggaatattggaccagatcatctctgaggtttcatctaactttgactctgcgtaatactttgtttgaaaagtacatgttggctgggcatgggggctcatgcctatgatctcagcacttttgggggctgaggcaggaggattgcttgaggctaggagttcaagaccagcctgggcaacatagtgagacccccatctctacaaaaaaattaaaaattagctggacatggtggtgcacacctgtatccccagctactcgggaggctgagatgggaggattgtttgagcctgagaggtcagtgctgtagtgagcagtggttgcaccactgcactccagcctgggcaacagagcaagactttgtctccaaaaagaaaagaaaaatacatgctatgtaggtgtcattagcaaggattatagtaagacattttatcaggaaccccagcatggacttctgtcttaagttgtcagtgagagaacacctttagtgagtattcttgataaaatgagggagaaagtgtcaggcctattgtcaggggctgcctgctttccagcgtttccattggagaaggagggagccactcagcacagcagtcacaggtcagttcaagccaggggacaaaacaacccagtgaaggggctcttccggagtttggtttttcagtcattaggcaagtttctttagagaacatttgagcttcctattcaattgatcccttctcctgcccaaggcaaagtgacaaagggtaaaacgaggcagcttctgtttatcttgtgttgtcatcctccttggcatccaggagccttgcgagcttgagacgcacaaatgcctgactgttgaccttttaacattagggatgtggtttcctggtatttgagtaaggtgagttttcaggaaactgtgtcgcactgctgcttccttatagccttttcagattgaggtcattatgctgaattgtctaaatgggctaaaaatgtttgttctcctgcagctgaactcttggttttatgtggaaacgttttgttctgtagctggtttggcaagtaagctcggggggcagcccaccccacggaagtcctctgcttcctttttccttgcagccacaataactttgtagccatcctggatctgccggaaggagagcatcagtacaagttctttgtggatggtcagtggacgcacgacccttccgaggtactcttcctcccacctctggtcctctgggtgcccgcacattccaaacaaatcaccttcccaagagattgccgctaggtccctttgcccagctagtaaaagtccccgtgtgtggcagagctgagtagcagcactacctgtcagacagttggcatacttgaccaagatgagcagggtggctagccaggagatgaggccttccagccaggaattccaagtcctctgaagaataactccgcagaccttccacgttatgatttctgcctatctgtctcttcccagcccatagtaaccagccagcttggcacagttaacaacatcattcaagtgaagaaaactgactttgaagtatttgatgctttaatggtggattcccaaaagtgctccgatgtgtctggtatgaacacagttattttataccacatgcgtgcaggtgggggctgtacagtctagacatactcttgtttctcttgcctctcttgagctgaagctgcccagtcagataggcatttatagcccccacttaaaggccacagaacttaattcctgtcaggttgttgaaatttagccctaagggagctacaagtcatttccctggtcatctcaggtattcagtaggtctgcttggccacagaacgcagacagcagaaatggaaccatagcttgatctcgtgccaagggcagggctgaagaggccctggagggtggcactgagtcagtgacagcccagcactggggaagcctgtgtctcatcccacttgtggtgcctgaagaatttcagcctgacaggtgtaaatggacacctcagtgaccttagcagtcacttatgtggtacattagcaccttgtcagaatccctttggggaggatgcggctccccacgggaaacagcctgcacagcccaactctccttgatgggaagctatttggtacagaaatacagacccagtaaaacttctccatcttgtaagagcctttcaggcatcgaggtttcaataaattgctttccctccaagccccacaggaagaaactacctggaacatgattcatacagttcgggggaagagggttgcgatctaaagtgttccccttcttggaggcgggggcttaacaattcctggactctgagggaggcagtggaaagatgccctggcagaatatctggcgccctaagaaaacagattccgttcgttgacaggagagttcttcatcattgtctagttaggcctggaagttctgccaccaggatttcttgttaccagttcagaaatcacagtggtaaaatgatcacaatgggctcactgtggttgacagtttgttgagcaggacttggaaatccgaaatctgtgcttttatctgggtaattagtcttttagagatatcatctagtttttttgcagatagttgagaatcagggaatggaggaagtgtgcccaaatatcctccaaaatatataacttactgatacatgtaattttaagccacttacaagctttttagtcaaatttccacctagggaaaggaaacggacccctcactgatacgaagctaattccacgttctctacagacttctgtttcgacacttacttcctcaaaatgttatttactccttatggctcagttttctgcacttcatgcttttctcagtttcttgctgtgatatggttgggtcacataaacggggcttgtcccctgaaaaatgacattgagggaattggcagagctggggcatagcagattttccctggaccagtcccaggatctggcgaccagaaccatcccacgcgttctttggatgatggcttggtaccttctggctggccaaacgtcactatccagtgttctagcattatgaaatcctgctcttgtagcagcttctcagtgtatctgaataatccagatactcaagcaagagtttggaaggaacttgagtgtaatggagttaaagagcctttagatattgggctttcaattttcccccccattttgaaatgtgcctcgtttagcctgttttctccacggcctctgtgtaaacagactgcctcatcttctgttgcattgcggccgggggtgcccataacttggacttagctactcaatcctcacttagcctccagcttctttgtggttttgccagcccagcctgaagggagaaggaagtcttattctgccgtgcgtgtgggattaagttatcgagaatagcctccttgtgatctgacgcagactcactggctgggccgtgtcttccaccagggcatctgagttgactactgagttgtatgctagtcacccagattccaaaagggttttctcctctcctctattctgcactcttggaaccagtgcatccttcaagagaatgtaaatctgcattgagggaacaagagacaaggaaaatgagatgatgacaacataagtaaggctgctcctagaatgcctgattttcaaagtaaagtcctgttaccatctcccaacagagctgtccagttctcccccaggaccctaccatcaggagccctacgtctgcaaacccgaagagcgctttcgggcaccccctattctccccccacatctcctccaggtcatcctgaacaaggacacggggatttccgtaagtatgtgggcatctgcccggaccatccgccgtgggtcatgttcagttgctttctttcctgtgtccacctcttgcaaagcagctggtgagcaagctcagtgtcaccccctagtgtgaactgtgccgttcacctctgctgtggggatgggctgataacaagaggttcccagtgtggacaccgctgcctcgtcttgcaaagcctttctgcactactcttccttgtccttcacgcctgcctcagtctaagccctgttcaatttacatttcatgacaaactgtatcaccatctcttcttagtaagctacatgctctggcccccacattttagaatctagttttaatcattcaattgcttttagaaatatcagtactcctggatcaaaatttgggatatctaggtaacacacatttctcctccgggaaattattacatgcagaaaagaagtgtgtgtcctcctggatcttgaagaacagccagttctgttgtgattctgttttctgttccatctaacctggattgcctgcccagtccgcctagctctgggatgcatggcacagccgtaattcttgggaatccaggaattcagcttggtccaagctacctcttaagaggcattgtttacgaggtgcttaaagtaaccatgctgctactgaacactccaccctgaagtggagggcatgtgtgctgagacgaggaatgcacgtgtacacatgcaggtgtccctacagtggtccctgccgggctgccaggacagggtctcagtgcttgttaccctacagggtacccaacagggcttgcctttctcaggtcacctcctgtgctgggagtgcccctgcagctgggtagccatcctggtataggcccagaagaggccagtggtaaggacagcacgcctcagctggcagggcccaccatctttccagcactgagttggcaacagtctcaaataggtcacaggtgaagagtttcaaggacatgtagcttctgccttagaagcacttagttgacactgcttcccttagctctaactttacaaaggttggtgggtaagatgactttcagtgccctcctaagctagtgaggtttgtttttttttttttttttttttgagacggagtcttgctctgttgcccaggctggagtgctgtggtgccatcttggctcactgcaagctccgcctcccgagttcacgccattctcctgcctcagcctcccgagtagctgggactacaggcccccgccaccacgcccggcaaattttttgtatttttagtaaagatggggtttcaccatgttagccaagatggtctcgatctcctagcctcgtgatccacccgcctcggcctcccaaagtgccgggattacaggcgtgaaccaccgtgcctggccaggttttgttttttctagaaaagggaggcatcactagccatcttctctgatggagactgctgctgggaatagacaagctgagagtggcccagggggctgggaatatgagaatgtcaggacccctctgtccaaggtagcactaagctctaatgtaaactgtggttacagttgtcactactaaagggttaacatttattttgccccaaactaatcttaagtgcttttcgtgtattcttattcaagcctcacaacaaccatgtgaagtaggtgcaattattacccccattttagggatggggaaactgaggcacagagcagtagggagaacacttaaaatctactgtcttagagattttcaagaatacattgttactaatagtcaccgtgttgtacagtggatctcttgaacgtattcctcctgtctaactgaaatgttgtattctttgaccagcatctccctacccccaccactcctagccgctggcaaccaccactctactctctacttctgtgagttcgactttcttggattccacataagtgacatcacatgggatttgtctttctgtgcctggctcatttcacttaatgtcctccaggtttatccatgctgtcacagatgacaagattccttttgtaaggctcagcagcactgcattgtgtatcagtacctcatttctttatccattcatccattgtggacacctacgttgattccacgtcttggctattatgaatagagctgcagtgaacgtgggagtacagatatctcgacatgctgatttcatttccttggagtatctaccctgtagtgggattgctagaccatgtggtaattttagttataactttttaggaaccttcatgccattttccataatggttgtactaatttacatgcccatcagcagtgcactaaaagtagcttttaagtgttctcaccacaaaaacatggtaagcatgttctgcgtgtgttgatgagcttgatttagccattccacaatgtgtccatatttcaaaacaacatattgtacatggtaaatatacataattttatctgtcaatctttgaaattgattaattttttaaaaacccctcttaggctcacacagcaactggctgagccagcagtcacatcaggcttggctggtgccagatccttggtagttggtgctctcagcagccaccctgaatggcctcccagcgggagcttgctgagtatttgttgacacaatgattggcccagcctctgggatcctaagcctacagcagttgttctacacttttttccatttgaattgcatttataacagttgggggtatacaatgaaaaaataaatcccgatttctggcttctcttaaaacataggaaggtgcggcgggcagctctgagtgccagcccggtggcagattttccagagtagtggtgtcttgcccaggtatccgtttcattcttcaggttcattgagtcttacagatacaagttttgaatccattgctcaggagcgtttagtgcagatggtctcttcctgtgttctctgaaagtgctgttaatagctgctttcttcctgccccaccctccataagaggacagggccgtggcccacacttgaaagaggccggggtaaatgcctggccagagacacacaccgatgcctccagcaggcatgcagggagctcccttcaggtcagaaggcgtgaccttcatctcacctgtcgtcttggacaagcccttgcgctgcctgatttgggaagagaggtcggcctgagcgctgcctcctgtcctttgatatctggcactgggaagtaaaggggagaatcttggtttccaaatcccaaatgctcaccgctgcctttgttccctcacagtgtgatccagctttgcttcctgagcccaatcacgtcatgctgaaccacctatacgcgctgtctatcaaggtaatgacatgtctgtccccatgagagctgtgttgcccagtgtgtgctctgaggacccccagcagtggaatgacctggcgggactgacttaaagggcagcttccagggtctggcacaggccatcaggctcaggttctgaagctggcccgggaatttgtggttttatgaagcccttaatgattctcatgtcctctgaggcttgagccccttagtccagcctttgatcatttccaccttgttccttaggatggagtgatggtgctcagcgcaacccaccggtacaagaagaagtacgtcaccaccttgttatacaagcccatatgaagagctgggggcggatggtggcccaggagacagcacaccaccaggctccacacgtgcatgctttccccaagagggaatggactgtacattgctcatttcacactcttcagaagacatttcatacctgccctggtcctgcttgaaggtttgtccaggcagagcagctcctgcagcgcctcggtctgtgacagtcctcctagcacccccatggctttgagcctcggggactcatcaagtccaagaaaagagggaggggtggcagaggatctgcagccctggccccgcggtgcatgaggctgggtgcagttctaaacctacattctcgatttttcttaagccaaaaatgaatgctaactcctttgccagtaaaattctgggaaacagggactgaggccacacatcatttccagtcatctgtgtgtttttaaggccagccacttgtccctgttgaggcctggctatggaactaaatacagtgttggtcttgcctgtccttcaaaatcaacaacagattgtctctcggctccagggaggtgtcatttctatagaaattagaagctttctgatttctagatgaggttttacaattgtttcttacagtcatgtgcactaagtactctttttgtaagcagaggtggctggctctgcagccttaaggccattttttaagtcaccacgtctagaagtcacatgaactctgctcagcaataatctgttctcagaacagacttttcaacctgctgccggatttctccattcagctggatgatcctcaggactgaccagttagctggcaggttgtccagctttttattccagtcataataggtgacagtgttaaccgtgaaaacttgagaggcactctgccctcttccctataaaatcacacagcgtgattttacaaggtcccgtggcaccttgctcaggacctctgcccctagttagcaagactgcagcagttgctgttgcttattctgaaaggaatgtagaacttgacagcagccttctgagtctgggtcaggaagatgtcctttggaccaaagcagacttctttatacgcagctcagtttcccgggagtcgccacagatgtacccactagcccaggttgctgtgagtcagcggaagctcccgttatgccctttgctcctggtgggagagggaggagtgagctccctgggttccagtatttacttggtatacctgagtttgggggtacccttttttgtgacttttcaaaacagtgaattactgtcaccttgatggacaagtttcaataaaactttgtaaaaataattgg

SEQ ID NO: 35990 - DNA, 12829 bp, Homo sapiens
tgagaagaagcgcttccggcggtcttagatcactaatcaacaaaccagctttcggggtctgacgcgatccttgcctcaggcctctcgaggtccagacagccgcccagcccgctctgcgacgcagcagtgaatagtgtggtacctccttgtctcggttcaggtccagacctccccgtcttccggctgccctgaacgtcaggcgacctcaggaccctgtgattggcgcctgcgccggcggaccgtgaccgaggaaacccctggagggacttgggcattccttgggctccgtgcctgttcttcgtgctcctttcggtaaagtaagggaagagggcgacttttttgttatttcgttcattcatttattttttttctgaaattattaaggcagaatagttaagtggttaagagagcagactctggagactgtcgatttttgacctcgccatttgtgacattgggcaagacactaggcctcagccctcactctgaaaaatggggataagattattagcctcatagggttgttggaagaattgaatcaaacaataaaggccagccagaccggtggctcatgcctgtaatcccaacattttgggaggctgaggcgggaggattgcttgagcccaggagttccagaggaggctgggcaacatggcgagaccctgtctcgccaaaaaaaaaaaaaaaaaagaaaaaatccaggtttgatggtgcgcgcctgtagtcccagctactccagaggctgaggtgggaggattgcttggtcccaggaggttgaggctgcagtgaaccatgactgcaccactgcactccagcctgggctacagagtgaaaccctgtctcaaaaaagaaacaaacaaaaaaggtgaagtctggcatatagtaaacattcaacaaatgccagatatttctgtgtgcctggccctgtaacaagaccacagccataagaaatagacgggcagaaaaaatctattgcgataagtactaattaaaatccaaggataactgctgtgacatagacttgcaaagcactgtgagaatagagaaagggagatgcactggtgaagtgacggacggtggggacttatgctgtacttaaaaatgaatatgagtctgccagggatgtgcaaggttggcagagcatttctggcagagttcacagctgaaagtgtcaattgtggaaatgtacagcattctcaagaaactgagtagtataatgttgttagaacaaaggtagtcatttcacccaggaagctcctcctttgtgcttccagtaccccaggtccatatacctctagaacagtacttaccatgtttcatattgaaatattctgcttctgtttctcttcctcacttcagggcaaggatctcacattatcagtctttgaccgacacagaatgcctggcatttgataaatgtttgttgaacttgaagagacatatggacaatgaatctgcaaaggtgagttgaaaccagattgtgaattttgttgaatggtaagccaaggaattctgactttttccaataggcaatgggaagccatttgatttaagttttaaaaagagtaagtctagcagcagtgtagagaatagatgacatacaaagagagattggaggaagggataccagttagaaggcagcagaaatctctcacgttctatatgtcaaaagttgaaagcataatgccatttagattaatggttcataaatttttccaccaggatcatgcctaagacacacagagtaagaaccacttcttattatctttaaccctactagtttttctcctattgatccagcacagatgtatcaagataccttatcatgccttgcttattgttcaggattgagcgtgatggtagttctggtaatgagttagtgagtgagatgggaaatagggatactagagctccagatgctgttgtagctattggtccactaatgacccaaattctaccctgtggttcagtgtagtaggaattgtcatagtatgacaataaccagcatctaacagttacatttctcttaatttatttagggagaacacctttggtcctacagttttgctgacactgacatttttctaagtggtcacaaatagcctactttttacataaataactggctagacctcgtatttttcactacagaagcctataatctaaagttgccaggatttaaacacattacttttaggttattgtctacatttatcctgagacctcttctcttcttattccaaaatgttgagatactggggagagataccaatatcatcaagccagaccaacagaagttccttcgatttgctcccacgggagttccgtctggtggaagtccatgacccacccctgcaccaaccctcagccaacaagccgaagccccccactatgctggacatcccctcagagccatgtagtctcaccatccatacgattcagttgattcagcacaaccgacgtcttcgcaaccttattgccacagctcaggcccagaatcagcagcagacagaaggtgtaaaaactgaagagagtgaacctcttccctcgtgccctgggtcacctcctctccctgatgacctcctgcctttagattgtaagaatcccaatgcaccattccagatccggcacagtgacccagagagtgacttttatcggtaaggcaaggctttgctgtatcttacttttctcaagtcatcttcccaacaaccctgttaagcctataatagcatttccattttcatgcgaggaaactgaggataagagtaattgacttggccaaggtttctccaggtaattagtgggatatctaagttttgaatgccagtcttcagaattcagggtctgtattttttaattttttgagtgcttactatgtgccaagcactttactaggagcagggtaatacactggtatgtaaaaaaggccatggcctcatagttcttaggatctagtctttctatttaatataaaaaaaaattatgggtttagctcgttgtcttcaaattgggattcatggacttattctggtatttttaggaatccgcaagtctacacaagaatctttaaattgtgtgttttcattttgataacatagttcaagaaataataatataagctgagcacagtggttcatgcctgtaaccccaagactttgggaagccacggtgggtggatcacttgaggccaggagttcaaaatcaacctggccaacatggcgaaaccccatctgtactaaaaatacaaaaattagtcaggtgtagtggcgcacatctgtagtcccagctactcgggaggctgaggcacgagaatcacttgaacccaggggaggcagagattgcagatcactccactgcactccagcctgggtgactgagtgagaccctgtctggaaaaaaaaaaaaagaaataataatataaaaatgttattgatccctgctactcaatatctggtccaagatctgcagcatcaacatcacctggcagttttttagatatgcagaatctcaggcctcacccagtcctgctgaatcagaatctgcattataacaagatctccaggagatttgtatgtgcatttaagtttgagaagctctgctccacatcctctgaacgtgactgccttataacctagagctgctactagatgtcagtgtgcaagttgtatttaatgccaattacttttttattttcattttgaaatttgccaaacctacagaaatgtgtaatagtcaacaaacatccaaataccttcaccatgactcactaatgtttaacattttgccacatttactttctcacatatgtgtgtgtatacacatatatacacacatatacaaacatacatatatgcatacttgtatatgcacacattttttcccccattttaaagtaagttgcagacatcaccatatttcacccctaaattcctcagcatgcatatcctaagaataaggaaattttcctgcataatcataataccattaccaaagtaaatgaacattaagtaccatttaataagttcatattcacattcttccaattatcttttgtaagtatatttacaaaatatcttttgtaaatgtcttttccctcgaatccaggatctaacaaagattcatgcattgtacctggttgttatgcctctttagagtcttttatgagttcaggtcgcttgtagaatgtcccaattactggatttgctgattatttcctcaagattagattcagattaaatatgttcggcaagaatactacagaagtgatattatatgttatttattacatctacctgttgctggtaatactattttagtggttcccaaactaatgagaaaagtacagaaatagactaaatacacaggggttgcattgcagttgggccaggtgaaggccagattatatcaaggtccattgtaatcaaaggttctgaagtcactggaataatgaaaaggggaggcataactgtgttattacatgcacagcatatgctagcatagacacgcccaactcaaaaaacttgctctgtggtgatcaatactgtattcacatattgagggcaatttaatttcaacaatataatgttatctatcatattaaattgatgctgtttattcatttttagttttgtatcaaatttatatagtaagagccatgaccatcaaaagtttgtacctggttttattttatacatatttaggaaactgtataacaaaaataatttgcatcagttatgggggcaccaaaaaattactttcctttgaaagaggtccagatattattctaggaaagtgatattggtttagttgtctctgtttattaggtacttatgaggcctttagcttttggcccagagacactggccatggaaatgatgaagatagtaaatgaaaagttacttggcaattagttatcttattgtcaaactattatgtaaactgcaatagttgctattgaacaggtcagagtttagtgggtggataaccactcaggcacttttgtacagtgcgtgatgacacatgccaagtacgaaccaaggaaaaatgattttctgtgctctattttatttttattggtaaaataaattcctttgtcaggggtaggcagaagccagtaggaaatttcaagagacaggtaaattattaaaagcttcttaagttatttttagatcaaatagctttcttaatttttttcttggaaaattaagatttctgcagtagtgattaggggcaaaatggtgtattatgcaggatacggtttctggagtcagaagctttaccacttactaattatatgtaaacaaattttggcaagtcagcccttctaaacctgtttcctctcctggcaaatagaaataataataatacagaccctacccattgcacaacacaggataggatgaaaatgctttgtaagctatatatgttttaaattgcttttataaaattgagttgacttccctgttttgaaatggtcccttgtaactttataagaatctaagaatcttaaactcctgggaactgtgaagaatctctttattggaactgtgaatttctaaaagtttgtattaatatattgcccagcatgtatgaaaactaggttatggtaaaataattagagcatcattgagcagtgtctgggctatactgttaaacttaatcctaaaagtgatcaaaattgaacagttgctagaaggaaactttcttttcactagatatccttttggattgtgtattatagacatgtattgcctattcaaactatgtctttggaggagctcaaagatatgaccatgggttgctaagacatgcccagatagcagcaggatgaaactgagctatgtaacttggatggaatttccctggaaagctaggccagtggcttgactggaattgtaaaactcctggggaagacaggaggggtcacccctttgcaagaacattaataacaccaccgtatctccactttcagtgggaaaggggaacctgtgactgaactcagctggcactcctgtcggcagctcctctaccaggcagtggccacaatcctggcccacgcgggctttgactgtgctaatgagagtgtcctggagaccctaactgatgtggcacatgagtattgccttaagtttaccaagttgctgcgttttgctgtggaccgggaggcccggctgggacagactccttttcctgatgtgatggagcaggtattccatgaagtgggtattggcagtgtgctctccctccagaagttctggcagcaccgcatcaaggactatcacagttacatgctacaggtgaggcgaccctgttgaaaagtgggcacagatgtctgtgcaatctcggagtgttcagcaggatcccacaacacttggtctagagtgcagagcacagagtcttggaacagagtgaacttaacatacttttatgatggccctagcgatgttcctggccaaataccatgggtctcctttagtcagtgaatggccacattcactgatacttcctctggaagaaactatccacaagtatatggaatctgagagaatgcagttagtctgattttattcaacaagtatttattgagtgcctgttgagagtcgagcattgtgggattcagcagttactaagttacctgagtttacattgtttttgaagggagacaaacacaagtcaataaataacaatcaaaacaatttcaggagctgggcatgatggcacatgcctgtaatcccagctacttgggaagctgaggtgggaggattgcttgaggccaggagttcaagaccagcctggacaatatagtgagaccccatctctacagaaaattaaaaaataaaaattagctggacatggtagctcatgcctgtggtctcagctacttgggagtgtgaggtgggaaggtcacttgagaccaggaagttaaggctgctgtgagccatgattgtgccattgcactccaacctgggtgacagagcaagaccctgtctgaaaaaaaaaaaaagagaacacagacctactgacaatcctcctgcctcagcctctcaagcagctaatataatggtttgactggaattgtaatatatatatctaatatagctgcttgggaggctgaggtgggaggattgtttgaggccagaagtttaagaccagcctgggcaacatagcaagaccctgtctctaagcacatacacaaaaaaatacaattttggataatgttaagtgctatgaaaaaaacagagtaaaatgatattgcctggaggatgggttggtggggggtgatgattttgcttggaaccagaaatatctaatctcttcagcccttgtgctcttaagtcatttgttcactgtttcagtttctgcaggtctaaaatatgattaggaatttttaacacccaagaaaaaagtctttgctaagtgatccagatttcccacaccattgattattcacctaggatacatatgtcaacttttttttccctttttttagacagggttgcctgggctggagtgcagtggcacaatcacagctcactacaagcgatccttccacctcagccttccaagtagctgagaccacagatgtgaaccaccatgcccagcttttttttttttttggtagagatggggtctcactagatactgcccaagctggtctcagactccgaggctcaagttgtcctcccaccttggcctcccaaagtactgggatgacaggtgtgaatgaccgtgcccagcctactgttaatttttatagccaaaaaaatgtaatcttttgtcccagttctaacacatttttttacctttatgtaacttttaattaatgacatacacattctctgccaaaccaattttctttacatatctctatcactcataaatgcaaactcagcaccttaaacaaatccctcccattggcagtgaatgttttaaaattctgttattcatgttctgttggcttttccatgggacgtcacaagctgactatccaacttgcttttaacatttccttggaaaattgactcttgcttgccaacagattagtaagcaactctctgaagaatatgaaaggattgtcaatcctgagaaggccacagaggacgctaaacctgtgaagatcaaggaggaacctgtgagcgacatcacttttcctgtcagtgaggagctggaggctgaccttgcttctggagaccagtcactgcctatgggagtgcttggggctcagagcgaacgcttcccatctaacctggaggttgaagcttcaccacaggcttcaagtaagacaaataaacttactcactttgattctgggagatctgccaatttcagtactttttgctttttggaatcaagctcaagaggtagaagaacaaaagcagcagtgggcagaatggaaagtcctaaaacgaatacagtttcacctatctagagatcccagcattcttctctttctaattagtgaagagaggattagcacagctttacaggcattctttaaaataatccctagttaagatgtagatgcaatgtgttgtcacgttgattaccaaggctgattcagctgatccagctggttgggaagatatccccttcctcctttagtattttatttttagtattctgtattggtccttcctgatgcttgtacttcattgaataagacagctgccagatagatgggggagtgttaattgctcaaggatgttctcagagtttggcttccctgctagagtattctaacaaactgaagatgaaagacattgaaatagggcttccggctgggcgcagtggctcacgcctgtaatctcagcactttgggaggctgaggcgggcgaatcacgaggtcaggagatcgagaacatcctggctaacacagtgaaatcctgtctctactaaaaatacaaaaaatatgctgggcgtggtggtgggcacccgtagtcccagctactcaggaggctgaggcaggagaatggcatgaacccaggaggcggagcttgcagtgagccgagattgcaccactgcactccagcctgggcaacagagcaagactccgtctcaaaaaaaaagaaatagggcttcccagttagaggtagctggcttctttttccagactctgtgattaccttaggagccaggacaactgactggttacgtgtcagttaggttgcaaattagtctggacactcagttgtttacaagtataaattgtcatcaatgcacaaatgactcaaatagcaaatcctcaaatgtggtctaaatggaattaggtcatacttttaaaagtgttgggcagagagcctttcactatggaagaataaccataagagaacagcattgctagaatacatagagagatgcgagggccaaagagaaattgttgcggacttcgggaccatgtctcttcaaagaagaccaggtagagaactgctgttagcattatgtagtgaccattaacttttcataatgcaagagatgaccagagacccaaacaaaaggcaggaaaacaagatggccccataaaagaaggaaggaaggacaggcaaactaaacaactgaacaagtcctgtggttgtgcatgtctttgggctgtgagacaggggatctttccacctgcctagtttcacttccctggtttaggggaaatgggggtgggtgaggtagaggaaagaaaggtagaagaaatggaaaagaagataatcagagctggtaattttttgggatggttaactttttgaagcagagagtaacaaccatattctccagccaagtacagaatcagagtgaaaactgagctcaaagcatattagttggttctgagtgatatatttactctttgttctacacttggctacacatatacacttggtgtatgtccatctttcctctgtttctaggtgcagaggtaaatgcttctcctctttggaatctggcccatgtgaaaatggagcctcaagaaagtgaagaaggcaatgtctctgggcatggtgtgctgggcagtgatgtcttcgaggagcctatgtcaggcatgagtgaagctgggattcctcagagccctgatgactcagatagcagctatggttcccactccactgacagcctcatggggtcctcccctgttttcaaccagcgctgcaagaagaggatgaggaaaatataaaaggaaaagagggagatgttttgtccagacctactagacccaacagaaaaggtttttgtattagaatctgtttccttaaaaattgatttgactcctgttcttaaacacaagtggtttttcctaattccagaggaactggacgtcaccaaacaaggttgcattttacttttgcatccagtttttatagttttccacaaccaagccacccttcacagataaaatatgatgctggcatggcaatcagaccaaagcactgtccccaattgttgtcttaactatgactagacatgttatacagccatttatcttgtacaactgagaagaatcatactttgacctaccttgtagagatgtgaggatttagatgtttgctaacttcaaaactgtgcttgaatagactaataatatatgctcatatcagatgtcagttttcatttaacttgattcatttttggctcaggtcattgggaacccattactaatacctaacaggaaatagctaaacacaacacaccttatctattagtcaccttcttaaaactgtttttgctacttttgaagtgtcttatttataagatcagaggtctgacaccttttttgcttagacagctctctatctcatccatttattttcttctctagacttactccatctctcctcatccttttgcctttgttatttctgctcggactcacatactttcaccatatacatattttcaattgtttctttccttttctcctttgtgagcaaagcaaacaagtactgtccaaggacagccttgtgcatatttcatttgttgcatttgcttggtcatcagaggacagcagtccattaagcacactttgctgcttctactgtaaaggcagcctttaaaacatagcaatatgcacctttcaactttacatcatgtcctgaacaacatcactgtggttactcatccatcagactatctgtatatataagtactgaatcagtatttattaagtaaatgatgtagcactgtagtgattaggaatcattagcaaatgtgttgcttcatgccttggtgatggatgccagcatgttaaactgctgaagtttgattttctgatgcaaaatatatcttgtaaaatttagaccactcctttaatgcagaccaaaataaggcacagctttaattcattattgaatgccttaaatgtcccaggtattgagaataaatgaatatgatacaaatgaggttatagtttaacatataattttaaatttgccaattgtaactctttagcacatttctctaaaccctttctgtcacagtcttttttttaatttatttatttatttatttatttttgagatggagtcttgctctgtcacccaggctggagtgcaatggtgcaatttcgactcactgcaacctctgcctcccaggttcaagcgattctcctgcctcagccacctgagtagctgggattacacgcacatgccaccacacccagctaatttttgcatttttagtagagatgaggtttcaccgtgttggccaggctggtctcaaaactcctgacctcaagtgatctgcccgcctcgggctcccaaagtgctgggattacaggcgtgagccactgcacctggcctctgttgcagtcttatcttcattttcctttgtttataatgaaagtggcgattaggcagttagtttccataaagtggccgtatgggaatttagttcattcatccagcaaacattgagtaccaattatttgctaggtcctgtgcaaggaatacaaaaatgattaagacttcttccttacccttttggagcttgaagcataaggaagacaagttattctgtaaggaagataaagcattcaaaagtactacagagaaaaaccaagtatgcttgagttttgcgaatgttctcctcttaaagaatagcttcaaattttgagaccagtggttcccactaagtatagaacattaaaattaatactttataataaaacacttttattgctgcagaatgttaaactgcataacaggcaccagatggtcaagacgagggaaatatgagaaggcaaatgatgtgaggattagtatcttgagattcacctggtctggaattatgtcataggctactatgcatcagaatcacatggagggctttctaaaacagactgctcagcccacccccagggtttctgagttcataggttataagaggtaagttgaacaattccccagatgatgctgatgctcctggtccacaatgtgagaaccactaagttggagtactgactcatagagataaaattctttgaaagaaatgtactgttttaagatactgtaaaatgtggaggcagggcaaacgtttataagggctgttatgtatgaaatgtgcctctgacccaaatccacggactttgcgaaaatcaccaaggagactttgcattaagttcagagtacaatacaaactgggcctagctctgtatttagtcagtatgtgcacgtgggaaactttagtaaaatatcacctccttattgagacaagtttggacatctggccttaagcctctgttgaacaggagaagtgaagctgtttgcaattatataattttctaatttgaaatcatgacaagcagtcttagaacaaagttaaaattaaaaagtctttatccaagtcaccaatg

SEQ ID NO: 35991 - DNA, 17708 bp, Homo sapiens
acagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaaggtgaggcgcggattggagcagagttgtggagctgggctgggctggggggcagcggcccccggccctcggcccccgaaacgggcataatagggaggggaccaagaggccgcgctttccagcgtggagaccggacggtgcggccgtgctccggctcaggccctccgcgcggtaggaaacggcgagggccgtcccggggagcagcctcacttcgcagctttgctcgccttggtagggaaatggccttgggcggaggcgggggacaggcagggaacggagtggccacgtccaggtttcctgcggccaccgaaccggtgcctcgcgccctggcgcacccacgtcctcggttcggggtggacttggggttccaaaacagccccagccggtggcggagtctttacgacagggaccagcgggctcgcccttgtccttgcagcgggccccggatgtgggcctcaggcggggacaggcgcccgcagggaggcctccagggccgctatgcacctgcgcgcggcaggcggcccggaccacacagggcgtgtgggtgttttcccttttctaaggatcatatgagtaatgccaggcttattgtagggaacgcagaaataataaccgtaaagagtaaaaacatataatcccagcattttgagaatcccataattagtaattaggtgtatctttctttctttttatttatttatttaattttttgagactgagtcttgctctgtcgcccaagctggagtgcaatggcgcgatctcggctcactgcaactttcgcctcccgggttcaagtgattctcctgcctcagcctcctgagtagagtagctgggattacaggcgcgcgccaccaccccccgctaatttttgtattgttagtagagacggggtttctccatgttggtcaggctggtctctaactcctgagctcgtgatccgcccgcctcggcctcccaaagtgctgtgattacaggcgtgagccaccgtgcccggcctattttatttttttatttgaaacagccttgttctgtcacccaggctggagtgcaatggcaagatcttgactcattgtagactacgcctcccggcctcagaccatccttctgcgtcagcctttatgcctggctaatttttgtatttattatttattattattattattatttttgagacagagtttcgctcttgttgcccaggctggagtacaacggcgcgatctcatctcactgcaattcaggcgattctcctgcctcagcctcccgagtagctgggactacaggcatgcaccaccacggtcagctaatttgtattttttgtagagaggggtttcgccatgttggccaggctggtctcgaactcctgacctcaggtgatccaccgaccttggcctcccaaagtgctgggattacagacgtcagccacagtgccagccgaatatttgtatttgtagagacgacatctcactatgttgcccaggctggtctcgaactcctgggctcaagtgatcactccgtctgggcctcccagagtgctgggattacaggcgtgcatcaccacacccggccttaaaaacaagatttaaaatggtgactggtatgttgcaccgttattcaaatgttagacatgtagtttgatttcagtttctcttaactgtggaataaacaacttggctgccgtctctctctctctcttttttttggaaacagtgtctccgtctgtcgttcagcctggagtgcagtggcacatttacatgtcactgcgtcctccatttcccaggctcaagcgatgctcttacttggacctcccaaagtgctgggattacaggcatgagccaccggtccggcatctcttggtttatttgtaagatggtgcctagaagtggagtggcgtttgccaaaggtctctggaagggcttttacactttcaccaatggagtggcctaaattcagtaattatactctcaaagtaatgcagttttagtcaactcatgtttttctggcttcaatctgggactacgtacttaatgttaaattgctttaaagtggtcatagctgctacaggtttgtgctcagaaagtctgcacctgactggtctgatttaaattttacgccccttaggtatgaacagtgtgttttaaacaagtacaggatggggctgcagaagatttaaacgcttgagaacaagtgctgtattttccccttttgtgaccccagtattgagtttagtgttgggcagattaaaggtggttcatatcgactataacttgaacagggaaaaattgaaatcaacttagggtacttgggatacgaaggatcaatataaaaactctggtttgtcatgctagctttttcttttttttcctcttcagttgaactgaggagatagtttttgtttttaatgattgtgctcttttaactagacaaaaggaattagatagtcttgcctattcgaagttaaatgaacttttgaggttgttaaggacaaaactattaaactgacatcaataatacagaatgggctgcttagtatcactttccttatcaggtactaggatttaatttagttaggaaactcacttaaagggaggactataactgcagttgaaagtgtaatttttccaagatataaaattgtttaaagattgaatatattcctgttaagccccaaaggaaacatccctcatttaagaaaatggggtgggagagcaagagaaggtgaggattcacagatcctagaattggaatagttgatttttttttgtaaaagaggcggtgacagccgggcatggtggctcacgtctgtaatcccagcactttaggaggccgaggtgggtgggttacctgaggtcaggagtcctagaccagcctgaccaacatggtgaaaacccgtctctactaaaaatagaaaaaaaaagccgggcgcggtggctgacacctgtaatcccagcactttggtaggccgaggcggacggatcatgaggtcaggagtttgagatcagcctggccattatgctgaaaccccgtctctactaaaaatacaaaaattagccaggtgtggtggcatacccctgtagtcccagctacttgggaggctgaggcaggagaatcgcttgatcctgggagatggatgttgcagtgagctgcgattgtaccactgcaatccagcctgcacgacagagtgagactctgtctcaagaagaaaaacaaaaaaaggcagtgactaacagggatgttacttagcaggacaggactgtggaaggagctaagactgggagtttcacaaagacaaagctagaaatgatacttggagagctgtgttcttgttttaaaaaaattgtaacaggaggccaggcacagtggctcatgcctgtaatcccagcactttgggaggctgaggcaggaggattgcttgaggccaggagttcaaaaccagcctgggcaacatggcgaaaccccgtatctacaaaaagttaaaaattagccaggcatggtggtgcatggctgtagtcccagctacttgggaggctgagacaggaggatcacttgagccctgtaggtccatgctgcagtaaaccaagattgtgccactgcattccagcctgggccacagagtgagaccctatctttaaaaaaaaaaaaaaaaaaaaaaaaaaaaaacaggaatgcatgcagattaaactatgtgtctgtatacagtatgcaaactttagcaagtgccaggcacttaggcagtagtctatagctgaaaaataaaacattcagaaccactttttaaggttttgtgtccttgtaactttaggcattattattacaatataacttagctgggacatgagagttaatagatccacattttaaagtagattttttttttaattttctagaatgtgtctgtgaaaactacaagctggccgtaaactgctttgtgaataataatcgtcaatgccagtgtacttcagttggtgcacaaaatactgtcatttgctcaaagcgtgagtaaaatatcctaattacctgtaagctttattttgacttaatacttctttaattgatgtgccttgagttggaaagagttttattggcttaaatctgaatcatgttacaaagtaagtgtgggaacacataaatttcaaataatctttgaccctggaactttagagttaattttttttttcccgtaatcatgaaatcagttatttttcagtttggcattaaggtttctttttcagtggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctagtgagtggggctgcctatactacttgttttcatgctgttcagattcatttaattaaatttatttttgattatgtaatatgatttcatggtttagaattcagaagatatgagtgtccagtgaaaagcttccttctcattccagtccccctcgctacccattggacctccacagaattgatgttattgattattctataaccttccagagatagttgatgaatttgttatatatctgttttattatttttacataaatgatagcatactaggtataatttttcttttatatctttacttaacattattcagtatttcattgttgcattagtagtaaatgtatgtaatttaacctatgtatttgcttattgattgtgttttaaaagtgagatatgcttgttttagggattgtttaatgaaaaggcacagaaacccactcaagctagcttaagcaaaaaaagacttcattggaagggactagaaactggaaaggatgtcaggaccaaagtgggcactttgtttttctgttctggtcttctggagcctcgttgtcagttttctctttgtgccctttcttttgttttttcttttttcttttcttttctttttttttcgagatggaatttccactcttgttgcccaggttggagtgcagtggcacaatctcagctcactgcaacctctgcctcccgggttcaagcaactctcctgccttagcctcctgagtagctgggactacagctataccacacctgactaatttttgtattttagtagagatggggtttcaccatgttggccaggctggtctccaactcctgacctcaggcaatccacccacctccacctcccaaagtgttggattacagttgtgagccaccatgcccgggcctttcatgccttttcatctttttagttgaacagggcatgacactgccagctaaactttgacttaatgtgactttatgtattgtgtccagagaacagagggtcaatattagaaaaggtgttccctcctgggtgtgtcctttatgaaggatgtgtaagggaagaaattataggaatagctactgcataaattttttttctcttagtccttataattcgagaattttaggattagcttattaggaaaatagtatggaagactgagttatagtcaactgacattgtctttttactttatagctggatcatcattgaactaaaacacaaagcaagagaaaaaccttatgatagtaaaagtttgcggacgtaagtgcaattaaatgcatcatattcttgcacagttggtggctcaaatcttccatcctacaccattagaaaaagcaagtctaaatgcttttttatatttctgaaaaataaagttacttgaaatagagttgcaagaatagcacagagattctgggaatacacttcactcagattcaccaattaacattttggcacatttgctttttatatgtgtatgtgtggatgaatatgtgtgtgtgctttacatcagtgtatctatgcatgtataaatatttttcccagaagcacatgagagcaagttgtagacatcaggcccctttacccctaagtacttcagtgtatgttttcctaagaacaaaaggcattcttttatataaaccactatacaacgatcaaatttaggaaaaatttttttttttttttttagacggagtctcgctctgtcacccaggctggcgtgcagtggcgtgatctcagctcactgcaacctgcgcctgccggtttcaagcgattctcctgcctcagccttccaagtagctgggactacaggtgcctgccactacgccctgctaatttttgtagttttagtagaaacagggtttcaccatattggccaggctggtctcgaactcctgaacttgtgatcctcccgcctctgcctcccaaagtgctgcaattacaggtgtgagcttccgcgcccggccaggaaatttaacgttatatcacgttgtgcccattttcccaatattgtcctttgtagtaatttttcccctctgattcaggacccagtccaagatccatgtatcacatttagttgtcatgactctttagtctcttaatatcgaacagtttcttggcctttctttgtcttccatgaacttgctatttttaaagagcatgggcaagtcattatatataatgtccctcaaattttgatttgtctgatatttcctccttttttttttttttttttgagttggagttttcccttttgttgcccaggctggagtgcaatggtgcaatcacggctcaccgcaacctctgcttcccggattcaagcgattctcctgcctcagcctcctgagtagctgggattacaggcgtgcgccaccatgcctggctaattttttttgtatttttagtagacacggggtttctccacgttggtcaggctggtctcgaactcccaacctcaggtgatctgcccacctcagcatcccaaagtgctgggattacaggcatgagccacctcacccgagccttgatgttccctcttaactaaaagcaggttatgcatttttgacaggaaaactacttaagcgatcttgtgtcctttataatacttcacattaggagttgcatgatgtcagcttgtccctttactagtaaagtaaactttggttaaagtggtatccaccaggtttttccactgtgaagttaccattctccctttgtaatccataaataatctatgggcagatacttggatactaagtaaatgttctttttctaattaaactggtacccagcagtttgaatatcaatggatgattccagcctgaatcaattattattatgatagttgcaaaatggcagaaaaattttaactttaatgacagttttagaccctgagctgtctgcttaaagagtagtgcttcttactgttgtgtggtacaaacatttttttttaatacagattttaaattctttacagtgcacttcagaaggagatcacaacgcgttatcaactggatccaaaatttatcacgagtattttggtatgattttttaataagtgagctttagcagacagttggtgagacagtatgttttgagtataaggacagccagtgatttaagtggtggttaaatgcacttactggagcaacagtttcggatctgggtacttaatgtgaatttcctgttactgtttttttttgtttgtttgtttctttaagacagactattgctctcttccccaggctggagtgtcatggcaagatctcggctcaatgtaacctctgcttccaaggttcaagcaattctcatgcctcagcctcccgaggagctgggactacaggcacatgtcaccatgcccagctaatttttgtatttttagtgtcggcggggttttgctatgttggccaggctggtctcgaactcctggcctcaagtgatctgtctgcctcagcctctcaaagtgttgggattacaggtgtgagccaccacgcccggcccattgtttttggttatcgttgttttccttccatagcctttgaaaagcctagttttactcctaaagaaaacgtagtatctcttagtatccctaaaacatttgagttttcttatcctggagaacctgtccctgtggatgagctccagtaacatcttaaagtaaatatgcaccaaaattacttttggtaaatacagttttggtgcatatttactttaggatgttactggagctcccatcttctctgctttaaggaactagtccttaactagttagcccttacttaactctttaaactctggtttaaaaaataaaaagaagcttgaatagtgtgacggaactctttaaaggtagtatgaatttattcaagagtctttagaaagaatgtactttttttactctttaaaaacaaaatgatggccgggcacggtggctcacgcctgtaatcccagcactttgggaggccgaggcaggtggatcacaagatcaggagatcgagaccatcgtggctaacacagtgaaaccctgtctctactaaaaacatacaaaatagccgaatgtggtggtgggcacctgtagtcccagctactcgggaggcttgaggcaggagtatggcgtgaacctgagaggcggagcttgcagtcagctgagattgtgccactgcactccagcctgggcgacacagcaagactccgtctcaaaaacaaaacaaaaaaacaacatggaaaatgcatgctgcgttttaccttgcatttctttttcttttctttttttttttttttttttgagacggagtttcgctcttgttgcccaggctggagtgcaatggcgccatctcggctcaccacgacttttgcctcccaggttcaagcgattctcctgcctcagcttccctggtagctgggattacaggcaatgtgtcaccacgcctggctaattttgtatttttagtagagatggggtttctccatgttggtcaggctggtcttgaactccggacctcaggtgatccgcccacctcagcctcccaaagtgctgggattacaggcatgagccactgcacccggccttacctttcatttctttagtaatttagttttaaagtagttctaatccaaataaaatactttcatatcttatttaaaaatcttttcaatataagaaaatcctcttaggaaaaattgtacattgtaattatgtttggttgcatggctgtcttatttccctttgatagatttagagacctcccaaagatttcttgattagtgataaacttagttatccactaatggaaaggaacagtgatgcatgtagattatagaaaatcaaacactgaatattctgattctcaattaatgttattttcaaatgattttgattatattagtattaatttgtattattcaatttttttccccagtatgagaataatgttatcactattgatctggttcaaaattcttctcaaaaaactcagaatgatgtggacatagctgatgtggcttattattttgaaaaagatgtgagtatcatcttctttattcctgtgttcaggaatgtagtctatcatgcctcaatgaattaaatatatttcatcacctttttatccacttacagatcaaccaaatggttcgctgctgccgttaattttgtcctccctgtcactcacatgcatcttgcttgtttgtatatttatgcctcttatcaaattgttctgcctaaaatatctcccctctttcttataattcttatttattatctacttggtggttacttagtttgtgcatatatgctcccctatgatatttataatttacacaaataaaagtctgttaaaaaagactgtaactgatatgattaaaatattttgttgaaactttaatatattatagtgaggtattttctgctgaaatatgaggtttgcttcaaaataatctgggcgggggtgaaaggatgaaaggaagaaaagatgaagtaagagaggctatgtgttgttggccttgcatctgggtgataggtacatgggcatcattgcactactctttctactttcgtgtatgttgaaaggttcctgtaataaacagttttttaaagttccaataaattagattgttatcactaaaaccataaagattcttggcagcggttcttttggcatacaatttgtatgtaattatatgtggccatggttggtttccttaaatatttttaattccttttctccttttcaatacaggttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggtgagtacagaacaagtaaaatttcatttaagggtatattttttcaagaaaaagtaatagtggctgggcgcggtggctcaccacacctgttatccctacactttgggaggctgagacaggtggatcacttgagcccaggagtttgagaccacactgggcaacatggtgaaaccttatctgtagtaaaaatacaaaaattagtcagatgtgatggcttgcacctgtggtcccatctacttaggaggctgatgtgggagtggtcagttgagtccaggaggtcaaagctgcagtgagccatgatcacaccactgcactccagcctgggcaacacagcaggaccctgtctcaaaaagaagaaaaaaggaaatatgaaaaagtaacatccatattccaaaacattcagggaaaaaaatcttcatttttaaataatttttttatggtgaatgaatctattgtatctctggtctctttttacaaaagtcattttatgaagcaagaaaggatgctaatattaaaaagcttgtggctgtgcacctcacaggccagttaaattgccatctagcagcaagcgtctttcagttgtcactgcaaacaattcaacacctagtgcaaaatacctgaacccccaaaccactcaataagatggaacaacagaacacaaagttaacgttagccatacaaaagagttaaaagtgatatgtgaatcaatacttccaagtaaagatgagcaaattgaatttaacagtgcttcagcaaaagaatgtattgcttgaagaagtgaaaggtttattttaggaatgtaaggatgcttcggtatcaagaaatcttactaacactggccaggtgtgatggctcaggcctgtaatcgcagcactttggaaggctgaggcgggtagatcacttgagatcagaagttcgagaccagcctggccaacatggtgaaaccctgtctctactgaacatacaaaaaaattagctgggcgtggtggcacatgcctgtaatctattcgggaggctgaggcaggagaatagcttgaacctgggaagcagaggttgtagtgcgccaagatcatgccactgcactctaatctgggtgacagagcaagactctgtctcaaaaaaaaaaaaaaaaaaaaaaaaaaaaaggccaggcacagtggctcatgcctgtaatcccagcactttgggaggctgaggcgggtggatcacccgaggtcgggagttcgagaccagcctgaccaacgtggagaaaccccatctctactaaaaatacaaaattatccgggcatggtgtctcatgcctgtaatcccagctactcaggaggctgaggcaggagaatcacttgaacccaggaggtggaggttgcagctgagatcatgccattgcactccagcctgagcaacaagagtgaaactccgtctcaaaaaaaaaaaaaaaaaaaagaaatcttactaacacaacagaattcagaaagaggtttgagggtatttaggaacttagatttccagttcaatcaaccatgtttggctatccatctggaacaaaatgaaagttgaattcctatttcactccaccaggctggccatattgcccagctgtgtgagggtggcatgtccagagcacagtagtaggaaaggcgttgggcagtgtatccattttcaaagacatttacatatttaaaaatacaaaaaagtaaactcccaagaaaattaattgagggaatgtttgtacaaccttgtggtaggggaaattatgtaaggcaagaaatctggaatccatgaaagaaaagatacatatatgtgtatgtatattttgagagagggtcttgctgtgtcacccaggctggagtgcagtagcatgatcataactcactgcaacctccaattcctggacttaagtaatcctcctgacctatcctcccaagtagcaaggactacaggtatgtgccactatacctggctaattttttaatttttagtagagacgaattcttgctatggctgccgaggctgggcttgaactcctaggctcaagcagttcttttggcttagcctcccaaactgctgggattacaggcatgagccattgcacctagtcctatatatatatattttggcttcattaaaattaagcattttatatggcaaagaaactgtaaagtaaaaaataacgatgggcatgaaaaaaatatggcgcataaagcaaaaatggatattatacataatatacaaagagttcttacaaattgatgaggaaacctaaagaaagaatgacaacaggtagggatagacagttaatagaaatttcagatggcaaatgaacacaagtggttaatgctggaagtctaattgttctgtagaaataaatgaaaacacaagtgcaataaggaagcacattgttattgtatcatagcattgcttgtaaaggtgaatctggccaggcgtggtggcttacgcctataatcccagcactttgggaggctgaggtgggcagatcacctgaggctgggagtccgagaccagcctgaccaacacggagaaaccccgtctctactaaaaatacaaaatgagccaggcatggtggtgcatgcctgtcattctggctactcaggaggctgaggcaggagagtcacttgaacccaggaggcagaggttgtagtgagccgagatcatgtcattgcactccagcctgggcaacgagagcaaaactctgtctcaaaaaatgaataaaaacaacaacaaaagtgaatctggaaaatagcctgagtgtgtatcagtaagagagtaaattatgtttattgtatctacgatagggaataatgtgaatggtgaatgagttcgatctttatctttggatctggaatggttgctatgatgttgatacaagctgtgcacaggtggtgatgatactgcatggtcccatttttagaccccaaaacttagatgcatgtgtttatatatgatatttgtattagtgtggaaaaggaggatgtggaagaatgcacaccaaactgttaaatttctttcttttttttttttggaatggagtctcgctggccggacgtggtggctcactgctgtaatcccagcactttgggaggccaaggcagctgggtcacgaggtcaggagatcgaggccatcctggctaacacggtgaaaccctgtctctactaaaaatacaaaaaattagccaggtgtggtggcgggcacctgtaatcccagctacttgggaggctgaggcaggagaatggcgtgaacctgggaggcggagcttgcagtgagccgagattgcaccactgcactccagcctgggtgacagagcgagactccatctgaaaaaaaaaaaaaaaagaaaaggagtctctctgtgttgccctggctggagtgcagtgtcatgatctcggctcactgcagcctccacctgccgggttcaattgattctcctgcctcaccctcccgagtagccgggactacatgcagaagccaccatgtccagctaatttttgtattttttggtagagacagggtttcaccatattggccaggctggtctcgaactcatcacctcgtgatccgcctgcctcggcctctcaaagtgctaggattacaggcatgagccactgtgcccggcttcttctttttttttttttttttttttttttttttttttttttttttttttgagatggagtcttgctctgttgcccaggctggagtgcagtggcacgatctcggctcactgcaacctccatctcccaggttcaagccattttcttgcctcagcttcccaagtagctgggactacaggcgtgcaccaccatacctggctaatttttttgtatttctagtagagatagggtttcaccatgttggccaggctgatctcgaaatcctgatgtcaggtgatctgctcacttcggcctcccaaagtgctgtgattataggcgtgaaccaccatgcctggcctaaactgttaaatttctttaaagattattcattgtttcctttttttctttctctttcttttctgttgtcccattggatccagcattgtttttgattttgatttttgtttgtttgtttcacttgtcgtggtagacttttttttgtttagtagtgaaagtttttattttattttatttatttatggagacagagtctccttctgttgcccaggctggagtgcaatggtgcatgatcttggctcactgcaacctctgccccccaggttcaagctattctcctgcctcagcctcccgagtagatgggattacaggcgcctgccaccacgcctggctaatttttgtatctttagtagagatgaggtttcacaatattggccaggctggtcttgaactcctgacctaaagtgatccacccacctcagcctctgaaagtggtaagattacaggcatgagccatcatgcctgacctattttattttattttaatttttttttagagatggagtcccactctgtcgcccaggctggagtgcaatggcgccatctcggctcactgcaacctctgcctctcgggttcaagtgattttcctgcttcagtctcccaagtagctgggattacaggcgaccaccaccgcgcctggctaatttttttgtttttttagtagagtcggggggtttcatcatgttggccaggctggtcttgacctcctgacctcaagtgatccgcccacctcggccccacaaagtaccggtgagccaccacgcccagcccaccttatttatttttaagagacagggtcttactctgtagcccaggctggagagcagtgatgccatctccactcactgcaacctctgcctcctgggttcaagcaattctggtgccttagcctcctgagtagctgggactacaggtgcgtgccatgacacctggctaatttttgtatttgtagtagagatggggtttcaccgtgttggctgggctggtctgaaactcctgacctcagatgatcttcccgcttcggcctcccaaagtgccgggattacaggcatgagccactccactggtgtgaaatttttaatttaagaagcaataaatgtttatggatagatgttaaaattagttttttttcagatcaaaattatgtccattaaaagcatatatgtctgtttagataatctttttttgaatagcagtcctaaaacaatagttgtctttcttccactcaggttatttccagaaagaagagaatggcaaagtatgagaaggctgaggtaaatggattacttacctaaatagaaaggccctgttgaatctcttactcctaatcactctaccttcctacacactgatgcatttcagttatactggagtccctttatactgttgtctttagggtcttagggacagtcttagaatgtactcttacctaaatattcttgcgtgagttccatggcagatcaccatctgttttctgcctcatagaagagtggaatgggaagcctatggtttttattctacaaagagtcaacatctaacagaatcttctgaaggcatactccagtggattcaccttggagaaactcattgtgactgatgatctgatttattatctctatgccagtgaaataatcatttaatatgaacttaatttgtcataatctattgtgtactaactagtctatactagtgtgacatcaaagtgtcagattgttagtgtgtttcagtcccttggaattgaatatgaacacttatccttgaaccctatcaataacatttttcacatatctcaatttttgtgtgtctttgtagttgtatgtgggccacttactaatattttagcaagtaataaaaatagaaacgtaaaggaatattggaaaaagtctaatggaaccagaaagttctagcatttttttcccattctgtagtaggtcatctggtttatttggtttggtgaccgcaagtctagaagactaaccctgaattgaatggtaacagacaggcagaatgacaatgtagtgttgcagtgcagagcagtacagacctgggtttggctgggcaaaattatataacttctttaagcctccatgtttcctcatctgtaaaatgaggataatagatagtatggacctgttgcaaggattaaacataatcagtgtaaagtgttggtcccatgcttgccacataagaaaatatttgtcaacagagtggtagttgtcattatcattgtctcagtttgcctgtaactagttgtgtgatctgagacaaacactaattttgaacttgagtttccccacatgtaaaatgaaagattgataatagaaagtaaatcaattttttctagcattaaaaatagtatgcatttaataaaaatcttattcttaatgatctagcttacctccaacttgccctagtcactttggcgatcttgtctctaaatagaaccttgaaaacacttaaatgtgtgtttccttgcaatataactttttctttttttatttaaataagtcttataaatgtgggaaaaaattatcttgtgttcctttaatttcatttttatttaatactattttcagaatgaacaaaagattgaaaaattatttagaatttttttctgtgctttttcctgtttcagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactg

SEQ ID NO: 35992 - DNA, 1690 bp, Homo sapiens
ctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggtgagcccccctgctcctgcaggggagaggaggaggctagcagggcgggcagggccgggggcgtgcggttgaaacgggggtcccgggggcctggggagttaaacgttggcccagcaccgggaaaaacaggactcctgattcccttgctcaggaattgggagtgcgggtcgcttctaagggcgctttctgctctgtaatcccagcgctttgggaggccgagacgggaggatcgcttgaggccaggagttcaagactagcctgggcaacatagcgagacgcgcccccccgccccgaccccgcgccattacaaaaaaaaagcaaacaaaaatttttttaaagatcatcgatgaagagagaaaatgcgcttttctacagagtccccttcccacccacagccccatccccagataagcggggagttccctggcgcggtgccagtttctagccgctgagtgggcgtgtgcgcggctccaagtgcgcctgcgtactgctcactccccagctccgcgccctgctccgttcctcccaaaactctgaatcgaagaactttccggaagtttctgagagcccagaccggcgggcacgcccccatccccaaccccctctgttaatccctaccagcctgcagtcctggctgcttccaagcaggaggtggggcctctggcctagcggggccgaaaggcagtcccctcccccgcagtctgatttccctcttccccccaaaggcaagcacgaggagcggcaggacgagcatggctacatctcccggtgcttcacgcggaaatacacgtgagtcctggcgccaggtcggggtgggtgggtggcgtgggggtggggtcagggaagagggcacagggacccacccggtgtgtaatgtaacgcttgcctttcctctctgcacgtccaggctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctgt

SEQ ID NO: 35993 - DNA, 57826 bp, Homo sapiens
agatcagacccacggggctgccctcccctgcgcactcccctcgctgcccgggcccggagcgcagcgcggccgcacaggtaggagcccccaacggggggtcgccccgagcgagcccagtactcactgggccgcgcgcgggagagtgaggtggggtgagctgaggggtgttgagtacccgagaactgccctggactgtgcagggtgtctcgggcagagagggaggtggaggtgtgcagcctcggaatgcgatctgtcagcaagtgcgagtactcgggtgacatctgttgggatgggcatgtgtgtgcgcgccgacaaccagccggcagggctttgcccataaacgtggttttgaaagtttaggggaccagtgtgcgagatttaagccgcacctggattccataggagctggttagaagctgggacgctgagcagctccaggggaccgccgcgttagcttgctgttaagaaaggggacctcatctccctgccgggccaggccgcccgcccgaaactggtaccttgggctgcggtgcgatccctggttccggtcctaggcagcctgaaaccgaaggtagcgtgtcggggacccagactgataagacaaaagagaatcagtcgctttgggctgcccctccacacaacctgggacttttaaacaaagctgtgcgcagagaaaggcgtggaaatgccactttgagagtttgtgctgggggatgtgagaagctctgagacatgtgagaaggtctagtattctactagaactggaagattgctctccgagttttgttttgttattttgtttaaaaaataaaaagcttgaggccaaggcaattcatattggctcacaggtatttttgctgtgctgtgcaaggaactctgctagctcaaggtgagtatactgggaaagccttaacgttctagagaacagagttttgcagccccacctccatcccccggggtgtgggactggggggcaggaaatgcaccgtcccctttgaaatggattactgttttttcctttcgaccccctctttctgcagcctgctttgtaggtgcagtataaaatgcacgctgaatgtcttttgtatgtaaacagcgtagcaggatggagtaacgtgaaatgcaattctacagcagtttttacgtctttgctgcctcgttcgttggctaccgagaaggttcaggagggggaggggagatgagaaagcagattggaagttgagtatggtggagcctcagcctctcccaccctcctttcctcgcttgtgctcactgctaaagttttgttactttccccgcagcagatactaaacattagtttgtcctgtattttctttgagattcacaatgttgaaagcccttttcctaactatgctgactctggcgctggtcaagtcacaggacaccgaagaaaccatcacgtacacggtaaggggtgatggaatttgaaataagtacggttcagcgggattctgtgacaaaaaaagactttacacacccctgccagtgtatttgggctatactctgctgagggtgataaattaaacaacacttcattcatgcttcatatctaagattcgttgtaaattgcccccttgatcctttcaaaagttcattgggctcaccacctaagataggaaccaacatgtaatcatttgtgcagggctaaaaatgggatccgttcaaaaactaaaaccaaagaaagttacatgtttccaaaacattcaacaaattaatgggtgtaaggaactggaaaacctggactcctaccacatgcagataaaaccaatacgtgcagaataagactcaagtcaagtaagaacgttaaacaccataaagacacatggccttctttgtgtacatgacatgcattctcaagtaagtggcctttattgaatttataaaggctatatattcattctttttgtataacttgataattctaataaataaaggcagacaacagtttatgtgttaccaggatgcatattggctaaagtggttttaaaacgtaatgtgtgcaactccgttttgcattttctaattagcgtctctgatatttccaagtaatatttgattagttagttgcataggtgtaaccaatgtttaataaaatattaaaaagatcacctgacccctcccactgctacaaatagttgtggtgagaacagagaaggacagtactgacttcacttctggtgagtttgtttgcacctctgttctgtgttttcttgtctttaatcagtgttaggcaaatgacatttgtcctggattggaatatgaaaagcacatttttctactgctcccagtttaaaattaagtaatcctactcgaaagaatgtgaaaaatttttgaaaagaaaactcttaaaaatgaactaatgtcaattactgataataaacattatctcactttttggtaccacattatccctagaatgttagtattcatctggcaaatgttcctttctgttgttcagatccactataaataaaatagcttaatacaaatattttgttaacttcatgttaaatgcagttgcttcctctgctgaagataaattaagcaagaaaaatgaaggcatgtgctgtttatcttaaaatgaaaatgttttgttattcagactaaacttactgccttctcagggagctaaaattaaattcactacccacttttataatcatctcataaaagattttacttcttttccagttgcttatcttctatgcccttccctttgctaatcacctaaatcttcctcatttttaccagagaaggttccctgtggcttaaacatgatagttttaagaccactaactagggttcattattattgtaacaaattttccagatatgttacccttttgtgctaagattgggcctattctcctttaaattttgtatgcctaataattcatggttaaaggacaagataataactatttctgagtatcccgctgtggagacacgatctcctttgatccttgcggcaatgtgtaaggtaagtggcatcatcttccttccactaatggtagaactgaagatcagagagagtgtctaacttgcttagggctacatagccaagtggtgaagctaaactcagtctaggcttacttaatagtacactgacattaaatgtctagaagtaaatacctaaaacaaattgcaagtcttctctatttaccatacaaattattcaagtgaactgccatttttgcctggcttgaaagatacttttcagaagaatgggctcgtatccacataatagcctcatagtcctcttccatattaaagatggtgtccattcagctgtttactcaacaactatctgcataagcaattctcatcactattaaaagaatttgtttgtttactaagaaaattcagtctcctcttggagaatttagcctgggaagacagtgttgaaaactacaaagttcctaagcaaggacaaatgatactattatacagattatacaaattgccaaggaaatagaaaagcaaggaggtgattaatgttggtgccagcatattagaggagacagaactctgtgctggttcttgaaggaagtgatgaccttggttggattgatctagaaaggctgaagaggcacctgagtcagagagtggcataatcaaaagctagagctgaaagcacctgagaccaatccaggtggtgataaggtcagatcagctggaactgggtagtgggaagaacccagagatggtgatgatgagagatctgcaggtcactgtgaggtctcagagagaggagcaacataaccaagagcacaagaaagatcatggggtctgtatgcagcatgtagagatgcggggccttgcctactcatgggccagcaaaagcctttcttagtagacatggtagaaatggacacaaagtcagcagagatggaaggaaaataagtggagcattcagcactgatgttaaagttggaatcctgggtttcgaaaaaggtagtggtacctttaacactgtttgggaaacaagaaaaaaattagtctgagagacaaagtgaatttagttctcgctccagtaagtttcagacatcagtaaaatatctaaatggatctctgggcttccattcagctatttccttgtcaagcatccattgtgtacataagcagctctcagttatattaaaagaatttaagtttatttgtttgtttactccacttttgctcaatccttccttgggcttcttccttacagtgactttctcaaatgagcgtctgatcagattgtttcctgagcttaaaaattcttcagaggcctcttatcgcctgtagcaacatttctcaagaagtagttcctagacaacctgtatgggaatcgcctgggatacttgctaagaatttagattccaggccccctacccagacctacagaatcaaatcctttgggtgggcccaggaatcttcattttaacaagaaccctgaatgatccttagacacaataaagcttgagattcactgaccttcagggtagaattcaggcttccattcctaaagaaaggctttcttgttttggccctgcctacctctgtaacctcatcctccacctacccagaactccttgcagctccttcccttttcaaaaattttatgcctttgtcacaatagcctctcttcctagaattcccacattcacctggaaaaatcctgctcatcctgtaaagcctgatttactgtcacctcctctgtcaagtcttcccttctgccctgccatgctcacccatgcccccgggcagagtccattactccttcctgcatacacttgtagaaggcacctgccatcttgctgcaacttgtctacctatctgtctcctcttctggtctttgagctgcttgaggacagggacaaagtctgcatcatctttgcatccccaggccctaaaactgcctggtttcagaaggtgatccataggctgtttgttcagtgggtgaactagagaggagattgaagctgggaactgctaggaggaacacctctgttccttaggagctgaagctagggagcaggtcagggtgtgagatggaggtgcttgaatgctgtaagaggatttagagagagagagaagagtccagggctggttgggggtgggggcgggggagagggcgaggaaagagagagaatttggtcttttttttttttaacatttccaatgtgggaaaaaaggcaaattaataaagagcagtcagagaagttggagaagattagtctcaaaacagaaaagaagatggtactgggcaactgtaccaaaaagaacagaagagtttaggcagctgatggttgagaatggacccccgaagctgtccaatgcacagacttgtcttttgaaaaaaaagcgatagaatgttaaaccacccatctcatcatatatctaggactttagcacaaggattgttgccataagaatgaagcttttagagtgatttcttagggaatggacacaccaattaactgtctcctggccccacctttgatgttttcttcacagcaatgcactgacggatatgagtgggatcctgtgagacagcaatgcaaaggtgagccagcttcaaagacttccatgtgatcattgccttctgtctccatctcttgtgtcactcttcctgtcctgtctgtgttataccaaaaaggcatgagcattatatttacatgtttgatttttccctcttagaagattcctgacttattttattactgaccacagatattgatgaatgtgacattgtcccagacgcttgtaaaggtggaatgaagtgtgtcaaccactatggaggatacctctgccttccgaaaacagcccagattattgtcaataatgaacagcctcagcaggaaacacaaccagcagaaggaacctcaggggcaaccaccggggttgtagctgccagcagcatggcaaccagtggagtgttgcccgggggtggttttgtggccagtgctgctgcagtcgcaggccctgaaatgcagactggccgaaataactttgtcatccggcggaacccagctgaccctcagcgcattccctccaacccttcccaccgtatccagtgtgcagcaggctacgagcaaagtgaacacaacgtgtgccaaggtaggaataacttattttcctaaccattgaaagcttttgcccaagtgcacctcgtggtgaggatgatgataatttattaaggacttctcgcgtgccagacatcatgctaagtgctttgtctgcattatatttaatcatcacaatattcctaaagggtagttgctgtagttgtcatcattgctttacaaatgggaaactgtggcttagaaagttcatcagtggttcccaaccctagctgcccatatttagagtcacttgggaacctttaaaacttctcgatggcgaagctacaccccagcccagttaaatcacagtctctgaggtgggttccaggcatcggcttttttttcagttcctcatgtgcggccaagtttgagaaccagaggtcacacaggtgctaagtgcagagctgaccttccaacccaggaaggcgggtgccaaagtcacagctggcaaaagtcaccatcaggttattcactgggaatttgaaattatgctgtcaagctactctacagatgtacccctttggtttctcaagtttcttttcatcgaacttgccacagacttattttcctcattcaggagtaaagaaatggggctcctgcttctcattaccttggagggattctcccccactcacgtttatatctcttttaagctctcatttgacgacgtttcacttatatcacttgcaccatggcatcatctgcctagggttttctgtttattttcacagagcatacacatcactgtgtattctagaaacagctgtaggctcgtattagcaaagtgataagaatctggggctttgaagacatgtaggatattagctaactgaactgtgctatgagattgtttccctttcttcttggcaaaccatttcagagcagcctggtgtggagactgtgttactgaaatggggccataggagcctccagactcctttctccctgccagaggctgattaggtagatcccatagtgcagaactccatgtcaccaccacatacgtgtatggcacacgtgggccaatggaaagggtccaggagttcttactttctaactggtcatgtgtaaggaagagagcaccttcctcccttaacaccaagggtttcaatagagaccactgagctgctacattaaatgaaagatgcattttcttgtgccctgggatgctgccccttattcacccgtgtttagttttatcttctgtgtaaaagatactcgagtttaaatggcttaaaaatgaagcaaggggctgggcacggtggctcacgcctgtaatcccagcactttgggaagatgaggcgggtggatcacctgaggtcgggagttcaagaccagcctggccaacatggcgaaaccccatctctactaaaaatacaaaaattctctatgaatggtggcacatgcctgtagtctcaaatactagagaggctgaagcaggagaattgcttgaacctgggaggtgaaggttgcagtgagccgagatcatgctactgcactccagcctgggcaacagagtgagactctgtctcaaaaaaaaaaaaaaaaaaaatgaaggaaacttgtcatgctctgactcttatttatttcatattttgtttgtaagctttaagtaccccacatcaagacctaacccatgttgtgatggtgtcacttttcagagggtgcatcgtattagcatctgtttcgtgttactgtcatgagtcagaattccagtattgatgatgaatgcttcagcatctgcttgatattctgatattgaatttaaggattatgtcaaggagataaaatgatgaggttattcttatacatgtatttgggttaatactgataaaaaaaatcttgagtttatttaagatagaccaacttttaattgtgttatttagttatataactagactggaaagtttggtagtatttttcccaaaatcaaaaaattttgctgaaaaattcttaagtatcaacttttatatactgaattattttgaatactttagatgtgtactttaatggtacttgggagaaaaaaaaaccagataaatgaatgagtcatttcccaaagtagtttgtagaccgtcattgacatttatggttgaattcaagaacaatgcccagaactaaatgaagaggtcctagaataaaatatattcaagacttacaacatgtattggttacggtagaaactgtactgtgattaatgaaaataaaatcctatttaacttttctagaaaatatttagactacctaacaaagtaagttacgtttcacatagtaaaacatttatagttctttcttctttgggaattttttttagttataagcagactattaagtgccttgcttatggaatatgctaaatacatacctgttgactgtgtgcacacaggttatttccaacccaaattgatctgtgtaattcagccagtttctaaaatttgggattggtgtctataccattgaaagcagggttaaaagttttttggaaggcttagggcttaagttggatttcttcccacctcacaattttgcaaagtgcccataaatgtggatttacttaattgttgataaaagggggttatttcatatgataacaacaggataatctgtctagggaatttgactaacataagtcgagtcacacttgtgcccatttcttattgagctaatcaaacatgcagtccagcttcttctaattgcctgcagatgtatgacattctcattccaggccagcagcacaaaataatattttataaccaatgtggaagtatggggacctctgtttagaacaataatgtgctctaaggacctatattattgacatcatcatggagtttgaagagtcttctgttttaataaagatctccactcccttttaaatgttgcatatttatgcccagtaatccagacacatttcctatggtctactggatagaataaatgaatcttacagatgagtcttatttgcataaaaattatttcttttttctatgtatattttttagcaggtatagtttatcattatataacctaaaactcaggacattttaaatgtaagaactgaaatctgtactgtgtttcagtcttcaaatcaattgtgcctttgaatgcactataccagtcacagatggcttctaaataatttaaataataccactagatattttaaatgtacactattttataaatatatcctttaaatagctgtccatttaactgtttaatgaaaacatgatatgtttattccccttcatgtatttttgggggtgttttcagttttgtacaaaaacaaggagtttgaaatacaacataacattcaaagatcaggtcacagtgagcaggtttttttcaggtaattttttgctaaatgaggatcatgctgtgggagccagtaacgctgggagtttcccatgactgacattattcttggcatctataaaatgaagatcatttcagtgttacatacctggggccatgtatagatagagttttcgaaattaattgtttccattagatatcatctgcctcaaagacaacagatactcatctacaccaaaaagaagttgaatgaatggggaatatattataatctgttgatggctcactttagttttctacacctttattgcatagtctctttctcctttttttttgagacagagtctcacgctgtcacccaggctggagtgcagaggtgctatcttggctcactgcaacttccaccttctgggtttaagcaattcttgtgcctcagcctcccgagtagctgtgactacaggcgtgcaccaccacaccctgctaatttttgtatttttagtagagatggggtttcaccatgttggccaggctggtctcgagctcctgacctcagatgatgtgcccacctcagcctcccaaagtgctggtgttacaggcctgagccactgtacctggcaatagtctctatataatctttctaaaggagatggagttagaaatcactagatgaagttgagaaaggattttttaaaatcatatataactttctaagacttccattcctgtattaaaaaaaaaaagtcatttgggaactgacaagaaagagaaagcattgattgccctaattgaagaaacttgtttgtttaattgaactttaaaaaaattaaaacacatggcattttgcatacctggtaattaagccactaataaaccctgtcaggacttacaggcatgactactaacttggtaaagaaactgtgccatcgagaaatgaactcagtacgaatgtccaataaagttgattgtaaaaccaaatcgagtacagtacctggcttatgttgtataaagtatcattgagaaatatgaaaaaaacataccctagggtttccaccatctctgtctaccaggactgtccagtttcaaaaccaaaagctccatgttcctggaaatgcctttgtcccaggcaaataggatggttgagcccctagcatacccacacagccaaatcgcctgcacctcacagacaagagtgaagaagtcctaacgttagagccattttttcaggttgaggcattgcttgtccagtgagactatttttacaatttgttttgtactttcaaaagacaaactgcattgatttttaagtagttggacagagtctttctttgcagttgtcgggatcccatttgccagtgtgccaatgagcaagtttctacattgttttagatgttttatgtgtaggatgcctggacattagaacctgcacacttagttatgtgtcatatgtgtcataccatgggaaagttagcaatcttttcacattcccacctagaaaaaatttcaccacacagccaaattaaatactatgtttcacctataaatttttcagtttgctaaaatttttattttttccaactttcagctatattttcaatcattttattttgtcattattacatgtgatacaggagtgattagaacactaaaaaatacatatttgcctcctgtaaagtctaaaggaacaaattacagtgtacatagggttcaaatttaaaaacctctatagtcttaggcatcatccatttatattctacatatttctttataaacataagggtaactaaactactcttttgaaaaaggaagaagttattatctgtacatctacctttgcaaagaggaacttgaagtaacatatacagcttctcagatgctagggatatctttctttgacttctttcattttaaacttaagtgatcttatatccagaagagaattagaaaatcatagtgtaaccaagtggcttagatacctggcattgtcattaccaaacagctttcaaacactgcccttttgttgattctcattaatgtcattagggtcgctggctgcatgggttagttttgtgaggaaatgcctaatttttcttccatataattatacagcccagtgaagacctgtgatctcagaaaatagatattttgcaaaaggaagactataattgagtaaattatgatgttaaccttaaaaaaaagtactttaagcagtaagaaaaatgggcatttagcctccttacagttcttcattgtttttagttgttaattatctcaagtacctgaaaattctcttaagttatataaatggataagagttgagtttacaggggagaaaattatttttcaaataagccgatgcagtgtatggaagtaattgatttactcctaaaaaaaatctagcattgtttcataatttacttttcaatatgctgcagccattaaatttctagtcaatttatgtcattttcaatacacatttgtgagcagtatttataggtatctgattcatacacagtcagaaagtgttcttaaaattgcttcataaaaattgaatgacaaccgttagaggtggaaggatagaagaggtcagtatgatcactctcctgcagcaggactgtgctacacacctccctaattcagtgggtctcaaagtgtagtccctagaccagatgcatcaagcatcatcaggtaacttattagaaatgcaaatttcccaggtcccaccccagactgactgaatcagaaactctggggccagcaccagcaatctggttctgggattatactgttttaacaatatattatataacatatattgttataataagacaattaaatatattgttataacaatataactacatatagttatataacatataactatatattgttttaacaatcccataatatggacgcctactcaagtctgagaaccaatgccttaacttaatcttaacttctgctatataaatcagagggcagggtcagaatacttcacatgggatatgggaagcagtgaaaagaaaacatcaaaaatatacattctgcctctagggtaagttagtatttctattttacttttctcactcttcttactgtcatcaccaatactccgattcctaaacatgggtggccatgagtcctgattaagactgtatccctgaaccaaggacatgatgtatgcaatctaaaggaaaaaaggacatattaacaagaaaacaggatacacatctctatgaaacctacaaatatgcaatcatataactattcttaaattgtcagtaggtgagactctaatttttattctggctatggcaatgactgatgctaagtgatacctatatcttctatagggctcctccttaagttcatggcacaaacttgtgagatgaggcaatgctgtagcggttcggtttgtgtagaaccacaaaagagaaggagattgactctgactttgactgtaaagtatccttcagtcaccaaagtgatatgagatcctttcaatatcagatgcacagctaaccatctctttccatttagactctgtaaatatcagatatttgaagaatattcacataagcatcttctttcaatttaaactttataagaaatttacttcccatcaaagacgaggagattctttttaagactagttaacacttaatctgtggaatgaatttcctcctccccattgaagcaagaaggagattagagtagaattgcaagcccgggtaacttcaggaaagtgcactggtactggctcattatttatttatccagcaggaagtctcaagctatattccctgaaatcaacaagttgccccttttgtaaggattgcctttgcacgtgttgaattgctggcacaattttattctttgaaaccaaagagtaaacaaaaattttcccaatgtgtttgattttacatgaatgtacaaataagtaattcacaccgcatctgaaattcattagcatgttgctttttccaggaggtaattgcaaatcgcacactcaaaataaaactgatcaagaaaactgcatttcaaatattggcaaaagaaaatgctgtcattgcaaaaatttaaaaagaattgcaggtttgtagtttaaactgaaatgatttgtaaacatttaataaaaatgaagtgaataaatgacatgaaaggaaggctgaatgctgagctgttagcataactacagattaaaagaagaaacagctaatcaatgtatataaatgtgtactaaatagactaaaaagcttgagatttgcactaagtcaaattctaaaagttcaactacctttcaaatgattgtacatctatcccatccagggtaactaggcagtattgcaagtgaaattgatcaaatggaacataaaaccattccattagagttcagtgaattcagtcaaatttgagaaccactttctgctgtagcttaatagagtcaaggtagaaggaaggaatgctcatagtctttagggaatttgtaataattgtcccatgagttatcaaataataaaagaaacaaacaacagttcaataaagtaacatgagacatcactggaagtacataatgaattgccaaaagtagatgtaaaactagtatgtgacacaggtagcaccacaattaactaaaatacatatttggacagaaaaagaaaacgtgttctcagaaatgtggttaaggacaaaagtctgtttcctcgctggaatggggcatttgggagagaatgatgaggggacattgggaaatctgacaaggaaattagcatccaaatatcagaggaaataatcatactgtaactgcacagaacaagtgagaagcattgtatcatgtccacattccatctgtcctagaatgatttcccaggagaggtccccagaaacagtgtgtttctgattggaatgctagcaagataaggtggggaagaaaaccaaatcagaaagaacaattgatgaaccactttgcagagcaaacatctatgactggttccatcctccgtaactccaccaaaatgctaatgaattcatttagctctgtctaaacatattccagaactgcattctgttttacttattattgaataggcaattagtatatgttgtttgtataaatgaatagattttaatcataggagaactcagacttaaaccatccttgaaaataagctaccaagtaccatgtgtatataaggtatatttcccaactataaatgttatacaatattagtgtggtccatcagtaattattaaaagagactgtcctgtcccttttaacatggaggtctcagataccttgtccccgttttaagcttatgctacttgaaagaaggattcataaaacctattctttatatcctggattactaggttttccataaatattagtgactaaacaggttggtgttattcctagaggaagactagtaattgggaacactagaattcttttttattttccaataagccatttaaccagggaatgcatttctgtatcaaatacatcctttttcagaaatctcatggtgaataatgaaaatacactttggttgggaaagtgttaatatttatgatacttgaggtcagataatcataagcctgaaaaatatttttgtttttataattttatttttaattgaaaaatatacatatttatggggtgcaatgtgatgttttgatatatgtatacactatgggatgattaaatcaagctaattaacataaccattacttcacttgtttttttgcagtgtgaatatttaaaatctacttgcttagcagttttgaaatatacaccatattattattaactatagtcactatgctatgcaacagatttcaaaatcttcctgtttaactgaaactttgtaccctttgattaacgtctccccatctccccccattctcaccctcagcctctggtaaccacatttttccctctacttctatgagtttgactttttcagattgtacatttaagtgagatcatgctgtaattgtctttctgtaagggtagaaaacattgatgtgagctctctgatactgcgaagaaactcaaggcttttgatgaacttctgtaaaataagatcaagggagaaggactctgagcagtccatcttaccttggacatttccctggctagaaattatccttctcaaatttgtttttagaatccaagaaagtcacttagttgtgtacaggtgatttaaaagaagagttttctgatcttgtcccaaagtagagaagctcgggggagctagataagtgagaagaaaaagtcatagctctcaggaacccaggaagaaagaacagagcttactgagagcccattgagaactgttaactagctgagacttgaactgtaggtgaaataagagtgacgtagggaagggaatccaagacagccataaaaactgcatgtgcttttatgtgtgcctagttaaaatgagaatcatgacaggagctggaactgcatgtagttaaatcgttgtggggaaggtggtgaaataagttttcactctaaacagccttgtgtgttgcaaggaatccaatcctactcccttgagtgaagccacagaacacaatccaaagtgggaaacaactcatggggtccaactcactgcccaccttgcagaccaagtctgtcacaacccgggttagggaagaatttttattcaatgatgatgttagatttcccttgtgaaatattttgcagcaaagccctcctcttgtacatacattcacaccagcatgccattaaattaacatttttactattttctgaaaacttatatatcccaatattttctaatataccagaatgacaaagggcagtgtaagtctgtttttcagagtttgctgtttaatcctcagaatcgtatttttacaatttgtaaatgtgtgatatcaaaagattccacttctaaaaaagaaaagtatatcccaagagaaataactaaaagacactttagaaacctgcctacgtaggctaaataccccttttcttgcctagtttattctaactatttatgcccacacatgtgcacacatacagatacctattcaagtacatgcctatacacatgcatatgtacaaacatgtgcacacattattttcagtaggaaggtaccatgtaccaaaatgaaactgatcatagttgatgatgcttctgaaatgactgaatgcagagagaggtttcctctcattattcctgtaacattaacactggaaactgctttctgaatacatgtgtttacctatcacaagagaacaggacaccctggacagttaactacactttttgctgaacaaagaattgtgttagatggattaaatagaaagtgttgacaaaaaagaagtgaaggtgctgaggtataacctctgaggctttgtcatcatatacttctgcagcaagatgatcatttcattactaatctttctcagagatttgcctggatttcatcctgacccactattttatattgaacaacttaatttttggcaaaattgacatttttgatgaactatcgtttaaggtggattcaaaaatgacttatctgggactgaactgaatctccaagctttttcattcttcagactttggtaaattatatagtcaggaagtagtctgaaatagaactccactcaacaagcaaggcagaaaattccagtcattcattatgaattaaactttgcagtaaaagctgtgggcaccttttgttaaaacagttcatgtcctggaatatcagaagaatcttaatccagggagggagccagaaaaaaaagtcctcccatacaagctggtaaagatgaagggttttggctgggcatggtgactcaagcttgtaatcccagcactttgggaggccgaggcaggcagatcacttgaggtcaggagttcgagactagcctggccaacatggtgaaaccccgtccctactaaaaatacaaaaattagctgggcgtgatggcacatgcctgtaatcccagctacttgggaggctgaggcaggagaattgtttgaacctgggaagcagaggttgcagtgagccaagatcacacactgcactctagtctgggtgacagaacgagactccgtctaaaaaaaaaaaaaaaaaaaaagatgcagggctttgttctgaacttcaatcatatgacctccctccttcagtgattgtcgtgggtcagggtggggggtaagctaatggtaaaaagaaactaaatggaagaaggaaatttaattgtcgtgcaatttaagcagataataatagttctgtagaacaggaaagattagtgaacagctcattcaaaaaaatgttaaatagcaaaactattgtaaattagagctcaactctaagtaaactgaaaaatattttcattgatttttcagtttaagcagaaaaatggattgtgtaagcatgccagagcattagtttccagtaaaccaacctatcacagaaggttaatacaccaaatggactattagaatgtcagtctgttagaaaaagagcttatactatctaatttcattgtaaaaacttggctacaaacagtattaggattctaatagagctttaaagaattattggaaaatcaggctgggcgcggtggctcacacctgtaatcccagcactttgggaggctgaggcagacagatcacctgaggtcgggagttccagaccagcctgaccaacacgatgaaaccctgtctctactaaaaatacaaaaattagccaggggtggtggcatgcggctgtagtccccagctactcaggaggctgagacaggagaatcgcttgaagccgggaggtggaggttgcagtgagccgagattgcaccattgtactccagcctgggcaacaagagcgaaactctgtcacacacacacaaaaaagaattattggaaaatctgtttacagtatcaaagtcaggaacaggcagactttacacattaccaaaagtattatgaacttactatgaaattttcttagtaaaatacatagtttctggtttcagattaaaggaaaagtttatagtgacaagagaaaatcaggaagaccttaataaagaagattacactaattatttaaaaatgtgaatggtatttttcattttctccatagcttcaaaaaattgagtaaaagtcctgagaagtggataaaactaactgcaagcaacagacctgtttatttttcagtgtaaatcttgataggctgagaagataggaaaagaagaatcagtgcaggttcaaattcataccaagcctttgcagttggagatcctaagttttgtaattattctaataggtaatatattattgttatgccaaagctgttgctcagcaaaaaaaaaaaaaaaagaaaaagaaaaaaaaaaaagccactatcccttagaagagaagaaataatttctctgtcacagttaggtgaacctctgtatttagtcaaggttctccaggaaaacagacccaataggatacatgcagagaaaaagagggagagagatttactgtgagaatttctcatgtgattatggaagccaagaagtctcatcatctgctgtctacaagctggaaaacaaggaaagccagtggtgtaatttggtctaagtctaaagggctaaaaagggtgtgggagatgggaactgctagtgtaagtcccagagtccaaaaaatctgagaaccaggagtagctccaatgctcctttcttaagggcaggagaagatggatgtcccctctcaagaagagaaaaagaaaattaatccttcctctgactctttgttctatttgggctttcaatggactagattacatccacctgctttggtgagggccatctgctttactcagtcaattcaaatgctgtctattctggaaacaccatcacagacacactcagaaataatattttaacagctatctaggcatcccttagcccagtcaagttgacacataaaattaaccatcacaaactcttaaccacaaagatcacaactgggtaacagcaattgctgaaaattcatgacttggtgttgcttgcctattggtcaatttaaaaaatatatactgcatgctattatcatgaaaaactcaagctattgatggtacttcctggatcttctgcaaatctcaagtttcagtgacactcaccctctagcaccacctaccaccaccacacagcactcaagtatgaaaatcagtcttctaaggaaaaagcaaaaattcagggagtacctgctagggtaggggccaggactatattcaaacatacatttgtggagaaaaagcaaaaacggagcaaacaactgagccatacctttatcttccaggcgctgcttcttaccctgaaagacaggaccccctgtaagagaaatgacaggcagaaaaaaagttgtggaatgtaactgggagggagaaagagagcaagacaagggagttgaggacaatgagcaatcacaagactataccaatcaaaagtagattctcctaaagtatctcataagatattgtaattaccaactgtccactcatatatgtatgtatacatatatatgtatacatgcatatatatttgtataaatgcatatgtccctcaaaagactgatgaaggaaaatagaaaaggtgacacctaataaattggttttgctgtttttataaaattggctaaagaagtctttagatttgggattcaattgtttaatatgttttttagaatctcctgtgtgttatgcattatagattagtgcttctcaaatattaatgaacatatcagttccctggggatcctgttaaaatgaaaattctgattctgggtaggtctgggttaaggcatgacattatacatttctaacaagctccctggttttgttgatgtatgcagaacctgtcttccagtagctgacagtatccttcctaccaagaaactgatatgtctaatggattcttcatcttctactttctgcagcagcaaatggggtataatctggatagagtcaaatttgcatgtggttacttttcaaaaatacatttttctcctttggttagatactgtttctccaatacaaattacattgtaacagctatagctataaatcacagatatttccctctcttactaattaatagaattttctcctgtagtggaatgtttttatgcttgaatgctcaagaggattccagaaagtagtctttggcagcaaagggtggtggaaaccccatgaaactaagcaagagacaaaagttcccatttgggtcttcccctaaatgacttgctgactttattaaatcagtttatcttgctggatagttttctcagctattaaaattaagagttgtcctttcagctcttacttgaaattatttacaaagaacaggaaagagaaagagacagagagaaaatgagtgcactttgtctaggctgtaagccttgtggatgtatggtgatgatatggttcttgattgatatatgcctggcatttaagctgtttccattgatagttcatttttgccttttggatggcatttttatcaggaaaacataccgaggcaagtcaaaatccaccttgggaagaatgcaggtgcattctgtgattataatagaattaatgactcagaagcaaaaaaccagctggttctaatcacctgaatctttattgacaaaacagttcacacctactactagttgtttgctaaaagtctgcaccaaatcactgaagctttaaaagctagatcactgcagtcttttccccaggcactgacatgggtaattacggtattgtggttcatgccacagccccagacttcatttcaatcctagcttggaaaggagttatttttattttggtgcgcaggaaataaactttttgcatatattaatataaccccatgtaaaatgtaaaggtgccagcactaaatgtgaccagccctttgttatgttcttgattcttgaattaaggtttcccatcttcactggagacgagtgcctttcggcaaagaactatctgtttaaagtctgaattagttcatttcaccttttggaatttctttcagcctccaactcaaaccatgcttacaaccaaagccatgagtcttgcctgagtttacgtattattttccatcacatatgaaccataaggaagtctatgtgctagttaatctgttactgcataacaaattactccaatgcttagtgacttaaaacaacaaacatttattacctcaccttttctctgggtcaggaatcaagttgtggcttagctgggtcctctgactttgggtctctgacaaggctgcagctcattcaaagctcgactggaaaagatccactccctagctcaaatactagtggttgctggcaggattgacttcctgcctctgtttctcataaattcttccaccttcaattccttgccacatacacttctccatagagcatctcacaacatggcagctttcttagcaagtgagggggcaagagaaggttccagcaagagagaggatgctaataagaccaaagttaagagtctttagtaacctaatcatagaagtggcaacccatcaattttgccatatactgttcgttggaaacaagcccctggtgtgaatgccaagatgttggcatcattgagagccatgtcagaagctgcctaccacaatctagaattaaaattctccctgagttgactccaaccatttagagttaaacctagaattttaaatgatttcaaaaagcaaaataggaattcagagcaaaatataccccctccccagcagtgcaagaggctgtatgactcatgcagataggcagcctaatgggtgtggtcagtagcacaggcaaagaagaacctggctgtttctagaagctccttttgagtaaacgtagccttttcttcactgacctgagtcttctaaaatgctatcaatcctcctcaaaaacactcataaatgattccatctccttcaattttaaaactagtttaaagtcttttactccactcaacaagtaattttcataaaacaaaaactttaaggacaagcataaaaactctttattgctgattaacatgtactcacatgcttgttacataaaagacatttaataaacactgctcttgctttatgttaccttttgtcctagacattccaatatttgtgtttgttagggaatcatggatatcacattctccatctctctcctagaaatccctgttctgttctgttcacatttttcttcccacagtctattcaaaaacctgctcctagaatcatcacctttatgtttaaatatgtttacatcgtttcttttgccccaaaagtctactagaagacatgcactgaacatatcctaagattacaataaataggttgtttaagagttaaaacttcagaagcaacaaaatctaacatgaattttcttggggtcccaaggaataggtatctcaataagaggcaggatagtggcttatttttcaacaaagcggcactaatgaagtaggatagcactctgaggaaaagaggaaagatatatgactaaaaatcgataaaggtagaaaccaatttaacaataatagcaggacctataatatgagatggtggcatgaagggacagctgccagccacatccagtttccccatgaagaatactctagtagccagattgtcaattaaccagagagaaaaatagagaaaaggctaattcagctattagaaagtataactaaaatccaaagcaaagttttgggtttttttggtaaagaagatagaaatagaccaaacattcttaaattgcttttaaaagtgcataatacagctctgtatggagcacagtacattttctccttagtttactctcccccagattattttccagatttctccaggtgtttctcatgccaataataaaaacctctgtgagccagttgagtgggttgtgggataaatgggtgcctcacagccaggtagaggccaacccggagcatcccgggaaggctggtctagtccacgaagaaggcagtgagagttggtgggggggatcgtgggggcagtcagatctgattccctttacagtgaagcccagaggggaaaaaagcattctgctcataagatttcctcatattcagccatccatttgctaatatattctcttgacataagtagccccactaaattcctctttcctcatcaccaactctaaaatgacagtttaaggattatcctttctgccacttaccacgaaactcagctccaagccagtttgttgtaggtttctgaacttaaccgcatagctcacaactgagtgtctaatcaatcattctatgactgaatccatctggaacaaatttgaagaagtggccatgtaggtttctttaggggaaaaaaaaattaaactgaaaccagagttgattttttcaaaagttcagaagaaaaaaaattataaaacttagcaatgacttcccccccagaaattgttcatgctctctgaataagacttattctgtcctaccccattctgcattgcatttaatccttcagagaggtgacctgtgaatgtgttgcagcagagtccactttcctgataatgagctcatggtcactacttgggtagaagggaagagggatatggtgtggccaggtggtcaccataacctcatgttgctcttaaattcccaaacacacagggctcaactgagagattatgtaaccaaaagagcctgtttctggtcaattcttgctagaccactggtttttgccccatacgcattaaaggataatttaaataatgcagccaggtagatttaagtactagatggtttttagaactccatctttcctttccttgctaggcccaaattgttaatgtaagtttaggatatacttctccatatatacccttaagtctgcaccatccatgcatttgttcaatctttaatgatttattcatcagttcatgcatcaatgcattcaattaacacgtgttcaaactgtactagaagcctaggcacaccacctttcttacaaggacttcctagtctgtctgaagatgtaacataaggtcagacttttaaaaattaaatgatacaaataattcagctcaataattcaagtcaacagaccctagttgagagcctcagtccccacatcatcagtggtaagtggcgattactgaaaaattctggagaagtcagaggaggaattggtgctgccaccaggtagccagttaggacttttctgagagaatggatgtgatgcagttaatgaaggatgaaccagaggggaacaaacctgagaagaacaggacaggctttggtgggtggacaccctaggtgcagcataatggtgacagtattgtccttgtgtatcaaactctcctttcatgtctcttgctagcatagttaccatacgtacagtacttgaaagtaatgcaattcttttttgagaaactcactcccttttccataaatcatactgacgtcagccctcaccaccactgttccccaccccagtcccagtgtcactgtttgggttgaggcaaggcaggtactgtgggtgcagcaggaaacaagatcggaaaattccattggaagacagttgaggtaggacccagaattcttggttaagccatttagatttattactgtcacaattagtgacagattttgagcgaagagtgacataatgaaaaccctatctccagacaggtgtaggatgaggaggaaaaaaatacatttacacatatggttaaatgtgttaaatcatcttaatgggactgaggtggggagcattagtggtaagggcctatgtcagtctgatttatggaaaagggagtgagtttttaaagaaagaattgcattaactttcaagtactgtacataaagtatgctagtaagaggcataaaaagagagtgtgctacgtaaggactattttctggatcataataattagtttaaaattatttataatagataattcattattttgccacagagcagcttctgctgtgtgaaacagtgattctaaacaagtttgactctaagtagggtgaacagtttgtttctaatattattgagcaatatatttattcgtaggtattacaaagataagcatcaattacaaattaacaagatggtgtaatttcaccccccacacttcatgaaataaccaatttggagttaaataggcccttcaatggtctactgaacaatcagcctctctgcctcatgctcacattcattaaactgtaaaatgttcgttaatcgtagtgtatgactgaaggaatatggagcaagtctctaaatataaactatgtctaaacagtctgttaacaacaattactcttattttagcatgtttaaggcagtcaccctgcaaaatacgatgaattcaacctaagcagagtcattgtaacaaggtttttgcaatattggaaattatagcaggaggcaattatccataggcccattctaccccacaacccccctaccatccattctgcaaataagcatgaactaaaaagtaatctggttgtagatagaggaaagcaacaagttttcctgatacatctaggggaaacattttccagttaaaggttatttttatataaaaataagaatttaaaagcggtacagaaagaggtttgggagtaggggtgaggctggactgccgagctaataaaacaagaatttaagaacataagaatagatggtttagtttatggattaatccaaaagaattttaactggatttcgatctcacttcactaagtcttgactttttttcttgggagaccccacagctagtttggaaaggtaaaacacctggtttatccatttattgacctatttaagtttccattctgaaacacttcattaataatagtcatacctgtacttttccttctcaatggtgggggtctgctggagatgatgtgttcattatctggaatttactttttattttctatcagatttaggaagaataagatcggggaaaaattgatattgctttgttagttacagctggggagatagcacaaaaccccagactaggtatcctgtagctggatccctaaacatcatttcaaagtgtgagactattcaacaagcctgaattaagtaactagtaaatgcaaagcatagtgggtgctgagaatacaaagataaaagcttatggggcctaccctcaaagagttctcagtctctgaggaagcagacagtaattacagtgtgacattttaagtcccattttagtgacttcctagagaaggtgacaccaggcctccgtcttggcaagttgtggcatttagactttagagaagtagggaaaggagaaagaatgttccaggcagagggagcagcatttgctaaggtcatgagaagatgggaaaagggaagagcaagttgttctgcataacttcagtgtgcagtacatgaagatagacaagagtcaaatcatgaagggccttgccagtcatgttttaaagtttgggtttcatcctgaaggtggtaaggagtgatgtaatcagcttccatttatacaaaatgaaagatgccctgtatcagtctgaaacttgtgtatgcaaatccacatgaaatgtgccctctttgctcacaaaggaattaaatgcatcatttacttttaaaatttatttctgagttctcatttgttaacctgtctggataattttattgtaactaattacaactggttttattctctatttataatagttctacaggggcaaattaaatatagatttcattcaagaaataacacaggtctgtctgtatgcttaaatttttatcaaacataaggagtagggaaaatattttagctcaaggaaaagctacagaagtcaaactagccttaaaaattgaatcaacaggtaatgcatcgtttcaggccatttctagtttttctccacatagaatataactgcaactcttaaaggatttttactgtttgaggtttgctccattttagagtctgtgctaccacttactggaacactggattgaaaacaaaattgtaattcagcctttgcagaagttgcaaggaaattttacacattcacgttttttgtcacaacatctcctaatcttgtaagacaaagtgttgtaatgatgatataattgtgtaaatactatggaagcgtcaaatgttatttatctgaactgttttgccagtttatagtataaacatgctagaatttatacatccagcctaatggatatctcaattgctaccttcaacaagttgaggctataaaattatataggccactgatacgtgcctggggttatccagctgttagtttcccagtggagaatgccagactttggtggtcagagcaaaactcgtttaggaccctgagccagccagacaaggtgcttcatccttaagggggctttaattaaggatgaggtgaggagcagccattgccccaagtcagtagagtttccagagatagtgagtttgctgcaattctctttcttaaaaaagataatttggccgggcgcggtggttcacgcctgtaatcccggcactttgggaggccaaggcgggcggatcacgaggtcaggagatagagacaatcctggctaacacagtgaaaccccgtctctactaaaaatacaaaaaattagccgggcgaggtggcgggcgcctgtagtcccagctactccggaggctgaggcaggagaatggcgtgaaccccgggggcggagcctgcagtgagccgagatcgcgccactgcactccagcctgggcgacagcgagactccgtctcaaaaaaaaaaaaaaaaagataatttgtggacacagctgtcctaaaggtcacctgaacaagctactttctgtggtgacctggagttgagctggacccccaaggggagtctttactggtaagatagggaatttagagggaggcttacggacaaaggcagacaagtggcaagaatgtgttgcacgtggcagtaggtggccaggctgatgcagagggccatgtaagatggcactgatgagatggagcccaaggaaaagacaattttatgtatggaaccatctgttatgtggcagtgaagattcagaccaatcatacaggaccatctgcattttgttaacacctgtgtgcacagtcacaggcaggtcttggagccctgggagcctggcagcagcccagcatcactagaaaggtgaagatggcagggacagccctgccaatcctgcaaggagtgcactagagagcctcagcactgggccagggaagctgcccaagaagcagtgtccagggcccacagaccaatagaaggcagtcctcacaccatttcagaggtggcagcagtcagagttctcaagttggaagaatggtctcaggggcaaatgcaaaattcagtatttaagtaggaaggggtcagaaatgtaggatgatgattgataggctaggatgacaacagagaaggagtcagcctagccacgtgattcatcaccctattaccataagcatggtgcttttccttgggccttaagttctttcatttttcctatttgttaatactctctcttacaagagtaacaagaaacagtcacgtatgtacatatcatttaccttcagctataatgaaggcatttgaagaaggtcattttgtattcaaagaaactataattaactttccaaaagaatacttttctaatatgccatggttttactatattactagcacaacatttaaaaaaacaaatattggcccaaaattaaactctcctatctgatatgactgaatgaatgtttcattaaatacaagtggtgtagatcaccatgctgcttagtgaagactctgccaacctgcttatttgaaaagtcaggcatacaacattttcatcttaaagtctaactctaagctttgttattaagaacaaatgaccagaaatccttgtcctggctttatatgcatttaactctatgacatttgaaaatattccctgttttttcatagttctgatcgataattttattactgtcttgaaagatggtgaccacaatgtccttaacattctcaaaaaaataaataaataaaagttgctgctgaaatttacatttttcatatctttttcatagctagaacttgttcacacaatagttctctctcagaattacatgtaggttctaattagagctctagttaatgttatgtgtgctaggtagtctttataaatattaatacttcattgccatgaagcgattctgtagccatcaacagtcctttcctctgataggactgattttatggaatcaaatattatgaaatgcagaagatactagatttgttttgttttgacagattttgttttgtttgaatgttttcaattttcctaatgagaaataacttttagcaagaaaggctgtgtttgcctgttcttgtatccattcatctggaatatgccaaaggaggggaaggtcataccatagatgctcctgttgattgggtgttagtcataaagaccatattgaaaacatgacactaagcaacaaaacaaaggtaggatatttaataatgtgaaagtatatagaaaattacattaaaaaccccaacttcctgcagtgttcttgcttccttccatctgtatatagctgaagtaccaccctgatcccactaccaatttaagtcttcacactgttaagtataatttattgagcacttactgtggaccaggtacctccattttgagtgtgtattgttttaattgtcctcacagtatcattttgaactgaacattccccgacttcatagatgtggcagtgagatttggaagagtagaaaagtcaaataactttcccaggacacataactaaaacgtgatgttgcttggatttgaactgagacctatttgactctaaaacctgtgatcttacccacccttctgtctcaagcatatttctgtcagtgagttgtttaagagaaagagttattctgtgattctcagactttctaaaaagatcaacaagtcctcccctgaactcctaattcttggtataataaattatatataaacattaattcttggtataataaggctagtaaaaaaaagctagcataagcaactacagaaagatacaatctcaaataaaataacttagaacttaaaaatactagctgttagagaatagtatgattcctctaattctgaaactcatgaaaagagattcgtaattgaaggtcactgacagggtacccccttacacctatctggcagcctcacagtcatccacattaaccacatatgtgcctgaagccaaaggttttcacttaaaagtttctataaacaaattattacatttctaggggaaaaaataatcctaggctaattttaaaattaacaatctgaattgctcaatttttccattttctttcaaaatgaaaacttggaatatgatagactccgtggatgtgctccatacagtaaccattttaagtatatataacagatctaagaacgtagagtttggtttttttcatccgtttattcatgccaagaaattctctttaagattgacttagtttggcatcaacctttaacacatcaactgcataactggcttgggtctacctgcctttgtactctgcagacacacaaaccatgtatagggcatgtttctccaccagattttctttttcagaatttgcactgccaaacagacattaagctactctaaattcttgacaagtatgtaactttataggaacacagtagtgtatttaaacattgaagagaactttctattcatcccactcttctaacagagccatttaatcctatccagaaagatgagtccattttcagactctcctttgatcctacagattagagggacagagaagtcaccactgaaaattgaaaaaggacgcaagaagaaatggagatccatgaccatggccccaagaaagcaaaagcatgttactcaggtttcccaagatccaagttagagaggggagaagagattagagctagaaaacaaatacttttaaaaacagcattttggaatttatcaaagtaggctttaatgtcagattcataaaaatgaaacagatctcagagaatgtattttctgagaaacttatttctgtccccaatggaaatgtaaagtaaaatgccccagactcattttaaagtccaaagactattttatatgctagctttgagaagcctttagaattgcaacactcacagggtcagaagtttttttgaacagattttcttttgtcccttatggcctttaggcactccttgagctaatattcaggagttatttgaatgctgttgcttcacaacactgaaagtgttttaacatagagggaggaaaatcccacagcctatgtcatcataatttatcaacaaattaagtccaagaatgcatgataatttatggataacttggaggaaatggtaactatggtatcaatttggaacaaaaccaggaagtcagatctcacttgatttaatgttatctgaaggatttgggcacaagtttaacattttgatcacggaataatcttatgccttaacatgatgaagactgagtcttccttcctgaaaaatccttaatacaggacaagaaataatgagtctaaaatttcgtaactgttttcctgctcaaggaagagagaaggaataaataaccacttacaatgaaaccttttcttgctacacttcatcatgaggcaagtatttcagatgttgggagatagattgtaaaggtataaaagttaacttcacagctatacaaagctatacgtatgtgcaccatgtgtcaaatgagagaaagtatagatattcaatgttgttgaatcctcacaattttctatattagagtggatgcagcatctgtttttcaatttttaatcatcaacattgtcaagcttagagaaaagttgactgtacagtacaattaacaaggaacacccaccgttcagattcaaaaattattaaaactctgtcatatttgcatgtagcatgttaacactgtttttaaacacagatgactagtcaaatcccccacctcctgctgggatccacattgaatcgtttgtgtatttccagtgataggaaactcattatctcctaatacatcaaaacaaataataaccacattttctcttacactgagcgaaaatctgcctttcttgcatttctagccatttattctatttctgctttttggaaatacatggtcaagatcttttcctcttcccagggagaagagcagaaaaaataactattgagtactagggttagcacctgactgacaaaataatctgtacaacaacccccagtgacacaaatttacctatataacaaacctgcacatgtacccccaaacctaaaataaaagttaaaataaaaagatcttttcctccttccctaagctccctttcataaccctgaagatgatctcagatatagatctcatctatgttttcttctcttgtaaattgagtacaaagaaaaagataaggatgatatgaggaggtagggtagggctatgggccttcttatgggctggcatttttttccataaattttgatctgtaatattttcattttcattcagtttgagatttctcaaatttcaatttagctatctttaaaccatgggttgttgtgaagtatgtctaattttccaaaagaagggctttttctagttttgttgttgttgttgtttctatcttatttgcattgtagttggagaacataatctgtatattgcaaatttttgaaatttatttagacttactttaatgccagcatatagccattttcttttaatgttccctcagtatttaaaaaggctatgtattctgtactgtgctctatacatgtcaattagttcaaaggttttaatcacattttctattcatttctgaaaacatgtatttattctttcaattaccaggagaagtgtgttaaaatcttactgtaactgtgcttgtcaatttttccttttagtttcattcatttttttatttgtctatactgagcctatatgattaagtgcatttaaatttagaatttctacatattcctggtaaactgaaacttttatcattatgtagtatttttttaattctctaataatcttttttttccataaagtcaacctcttctaatactaatattgcatagccaactttgttttggttagtgtttgcataaatattttccatcttttttattttaatctctgtgtccttgtatttaaattatgtctcttgaaacagtatatttgggttttgttttttaatcaatttgacaatttttggtttttagtgagtgcatttagtccatttacatttactataaccactgatatgtttaggtttaaaactacctaccattctatttgcttttcatttgtcctgcacattttagtttccttttgttttcttaccttcttcctaaattgatggagtattttgtattattctattttcccctctattagctttgtagttttattttttttttttaccattcctttattgtttttcctacagatcatttgaacatgcatccatgacttatcaaaatttaagatcaattagtacttttaactcttcctgcgtgattcaaggaccttaaaatatttaaactctattcctcttcctgccaaactatatatgctattattctcatgtattttaattctaaatattttataaatcccaaaatactttactattattgttttaggcagtcagtacttatttagatttatccacatctttattctttttattgtgctggaattttgaatcaaaaagagaacagaaaaaagaatttagtgcaaataagggccctgaggcatatggagaaacattgcgcagaaagatcataagtaagatataatgaaatgggcaggaaaatacacacaagaaagtaacattctctgaaggcaagaggcacaaaggtattctttattgaaaaagctttaggcagttaatgagttggagaagtattgccaagttacactcaccaaatttagtagtatgcctcaatttagtgggcacaaaagctgcttattgttgaatgaacaacaagcataatgtaattggtttcatacaattaggaggtcagcaagccatgcttgttataattggcactgccatagtcaggggcttatgcgacctcaagtgatgatttgcctgaaggaataagccaggaatgtgtgtgctttgggctccagagacttgactaatctggctgcaaggcctcagggagggaggccaagaatcaaatcacagtgctcaggcagggcttggtagactcagttgaatgtagtcagtctccattcagttcatcactcaccagtgtttgagccggagccggggaagtgggagatagaggagaggagagatcaagtggccgggaaccaggaaaacacaattgaaatgtcagtgcagaggcatcccataatagggcgggatcttaattcctcccaaggccatccactttgaagcaggtctccagcctgtgtggcatgggcttaaaccttcacacaaagggtctttaatttctagtactgagccactctggagcaaagactgatgttgctgtttgtttcaaaatacaggtttacctccacaaggtagcagactgatgaatggttgttaatatcccaaatatcagggttttcttttcccaaacattttctaaattaataattaagtttaagaaggcctgtaatcccagcactttgggaggccaaggtgggtgaatcacaaggtcaggcgtttgagaccagcctggccaacatagtgaaaccctgcctctactaaaaatacaaaaaattagccaggcatggtggtgggcgcctgtaatcccagctactcaggaggctgagtcaggagaatcgctggaatctgggaggtggaggtttcagtgagccaagattgcaccactaaatgctagcccaggcaacagtgcaagactccatctcaaaaaaaaaaaaaaaaaaaaagtttaagaaggaaaaaaaaagagtttagctgggtatgacatactcacaaagatgccagaaaatactcctaacaattaacaatcatttaacagtagacaatgttgtttccttgagattctgaaagcataagcttcatgttgccagtgggcaaaaacagctgaagaatgagaagtaaagcctttgtttctttgctcttcctctgtttcagcctatgacccattggttcatctggtttatgtgtagtacagatgagtcacagattggtcgttcacatgcattagttggttttcttccccatgttcatgaactgtatgcctaacctcatccaatcatctggcaaatgaacactgttgtccacagaggaagctacgtgaggggggtccatttgcaatgcaaatccgtcatcattgctagaaaagcaattcgaagtagcatgatttttttcctatgagaacagcatattgtaaagttctgatagaacacaatgcaatgccaagggcttctaggacacttgatttcgccactctctaaaacaaagaaatgaactatcagggaggctgataatttgttgattttggtgatatttttgtttatcatttaaagcacaccaaattattaacaatctgttttgccagaactgataagaatctagaactataaatctactgctggccatcgattaagacagttctctcttgttacttaatattagtatttattttctccactagaactgcttagcttgagtgaattctagctgataatttcagaagggtgaaaagctaactagaactgggcatttggcccagataaatctgattccagtactatgaaagaaacagcaagggaactagaaagtctttgacaaaaaaatgttgataattggctaaaaactggggagggaaacagaaaacttggagagctatgaatgttattctaagtagaagaaagacgcaagggaggaatcaaggtgctgtgacattaacaaccctatctttaaggctaaaaaaaattaaaaacacctataaattcacttaaaactactctccagaactcataggaaataagtcttcctcaggacctaaattgcagaaacaaaatggaaatctggtgtttgaatctctgctctgtgtgaccctgggcaagttccctcaactgagtctacatttcagtgacatccttttttttcttcatctgtaaactgtggatgaagtaactacctcttccacagggctattaggattaaataagaagctttgtaattctgccttcccaatcaaataatagatctttttatattgctaagaatttacctatttttataccaattaattttagaatgttaccaagtttgtatatgaatctgtataaaatattatatacttttttctaaatcagatttcaatctacataatttattatattaattactcaggttatcattatcaatagcaaatactggatgagtaaaacagtagtaaacttcagtgccctcaggtcttgctgaagtaattcttaccttccaggattatattgaaaaacaaaatactccaaatacctctaagaccttcactcagtgagtcccttttatttaaaaagtttcagagagtaagtaaaaagagtactttggtaggaactagtttatcaccctgtctctagaaaggattgggagcaatcattttgagcaggtgggtatctaaatcattaagaatgttgggaggaaggaggccaatggtaaagaagctcttccttctaacaaacatgaatcctttaccttgaccatttttctactttactccatttatgagattaaatcagtttgattgaggaagctaggtataataaggttttaaatccacacagatcaagaagtatcaccaacttgaatttaaccactatcttttctttaaccacaagagttcacaggatagcaccattaaataatatttgcaaagcatgcacagtgccccacacagaactagtaaagatacggttattttactccaggggtttacagtctggaaacaaaaaaagtatattgtgaagaatctgaatacttttaaaaatctgtgtgttattgttgaggatagactctctatttcagagatggagaaacaaagagaaaaaattgataccatgaccctagatcacacagggagtgacagattcaaaataatttcagtcttctttgtcctattactagtgcattctcatcactagtctacagtggcttattcaaaagtagttctaaattatttcttaaaccaaaagcagcacaaattataaaagtctaaatggtactcaacaccattcaaggtgcagataatttttgcccatgaaaacatgctaaagggactccatgttgtggtaagttatcaaattatggaaagaacattgcagagattaaaatgttgcataagagagagaaagcagcatgagtcaggggtttgggaaatatgagtcagactgaagggaaggagccaaaaacatagagaatgagggcctaagcagggacttaatggacaccacagagatgtggacaaagttgtctccattaactttgagagaaaatcaaatgtgcggttccctagacgtgggggtcggtgtgataaagaggctagaagagctgagcaaagattagcctgtgttatttaaagcaactaacggtgccaaagtcagcaagagagggacctacaatagtataaatcactaggagggagcacgtgggcacatttttgaaaaatgagggaatcaccaaatattgccattagctattgttaatgtattagaatgacgaaatgtgttatggtattttaggaagcacaatctattattttgttctttggtaatgttaacattaggctctgtctacatagttcagagagactccttatgttgttcaatccagactctctaatcctgcctttaaggccttgaattttgttcacgacagatctagcatttcatgatcctcttcaaccaggcactgcaccaggctcctcacacagagccccggcagctgtgctgacgccatctgtctgccattcttctcatggaaaccagttttgtcttatcagcattttctaatgtgagctgctttctgcctagaaacagcttccttttcctggcaacccatgtatctcgtcttcttcaaaatgcagtggagaacccacctcttctggcgaatctgctttatacctcatagcctctgcactcctggactcacttgctcaacatcatttttcttttactaacatcttactgattttgctgtgtttctcagatataccttgttactctgcttcatacatttttagctccattaggtaaaacactgatcctacttttcctgaaactttaggtaccaattctcagcaaatggtaataactcatttatccatttattgcacaaatatttattgaaaatccaccatgtttcatgcactatcctaggcactgggaatacaggggggaaaataagacatagatcccccatccccacccaaagagcttgggtccaggtcccaggaaatttattaactgactgcctgaaaaaccaagtgagcttaactgtcaaggataaattataatcatgcaaaaacaacaaaaaatttctccccatagtaatttgtcctagattatcaggaaaatcatggctgacctgagtagtttcccttataaataaagcattgcttttgctaatgcagatattctcccatacaaatgtaggaaacagatttttcttacacaccatggagatacctacaaaaggctgtgtttgcactatgggaagtcaggagcaagtagagggcagtggactgtcatcaacactcctgggagagccaccttttccagagcatctgcacagggatgggtattctgctttgagtttctgacatcattgtccattttagtaaattttgtatcatagtgagctttctggtatttatgacaaatggaaatgcatagaagtagaaaagccaaacataacggaatttaacaatgtataataattttatatgactttgcatagatgtgtaaataagtaattccaggatctcaaagtataattttcaaaataatattgtgttatttaaataaactaataaattgacattaacgtaattgaaaataggtcaaagaaattcagtctgtttatagcctttagcattagataaaccaccaacagcaaaggagaggataaatattctaaaccacagccagagaagccataaatggaaatgtagttagtagctgcctcctggtcacagaggtcacttttttgacaattttatgagtcccagtaagtaaaatgtgtaatcaccagtcagtcctaggtgaggcaagtcttgttgcagctttgtttgggtgttggtggagaaagggaaggaaagtagtggcagtgagcacagtggtatttgttttttgttgttgtttgtttttattaatttaactcacctaatatttttattaaataacccactcagaaggtaaacagacctcattcttaagaaggagtagcacaggtttttgtgtttaaaatctacttaatgatacattaattccactggaaatgttagcctatttatcagacactaagaaatgagcaacaagaaagtaggaaggaagtcatagggcatcagttgtaggaatgcagcggggtggaggcagtttgcagatagatgtcaaaaagaaaagcctcagtcactgctgaggcctcccttagaaaatgcagcagccagcccagggccttgatctgctgccagaggaaacttgccacatctgaatctaacattgccgtatctctcaggactgttatcactgcaaatgctggcaaatgttcttgacataaaacaatagatactctgctgtcatttctgcattaacgagtcataaagctctgaagaaaccccagtaaaaaggttttcatcaagtgcatctgagaaaataataaaagacacaaaaaacagcagataatttcaaagcaggattgttgcaccatcgcatagtacctaaaaaggacagtttgtaatcactgacttgaaaataatactagtagtaattataataaatttcaaaacaaaacaaaataacaaaaaccttagccaaaactttaaaaccaagttcaaagaattacgtaagtggatgctttatagattattatccaataaatagccatacatcactcaagtatttttcatctcccctccctctttcttatcgaaagaatctctcttatcatttccacacccagctaagtgaagctgatttctgaggacaacccttttacaatctcaacttcatatattattatactgcatagtgtaaatgcgcagtcctccttgaaaatacagaaaagtgaaaggcaaaccaacctcagggtctactctcagagattcttagagggaagacagaaattgggtgaattttttattattgattctttccctactttttcttccaacatactaccatgagtctgccacagtgatgatctaagacctctgaaatctgcctcaggggtcttaaatcatcactgtggtagacccagggtagtattttggtttttatacaaaaattgtcatctaggaatcacaagttttatgatattgttaatgaagcttagagtggttgttgaagaatgatgaaattatatgatccttttttgtgtactacttaacttcatgatataggagagccgaatgaatataaaagtgatacagataaggcaaaattagattttacttataaattactgtaaatatgaatgtacacacacaaatttatatcaccttttgatctgaaagaaatttcttataactagttcattatgctatcactgagcattttttacttttctagaactgtaacctgcatactcattaaggcacatttagtaaattattccaagaagtacactgctttgagaaaatatggatttttaaactacacaggctagaggaatatgatcaaattgaatcctttgcattctgaaatttgcaatgaaagatttatacatacatgttgccctgctgtttgcaaaaacaaacagctacagggaacgtataatattaaaggttgattacacccagttattggttagatttttagaaatttgtcaatggaaattatctcaaatacaatatattggatggaaaagcaagtatcatacaatctattaaaatttttaacatacaaaacaataccatatgttctaatggatgcatccctgtctaacaaaagtacaaaaacatctcagggaaggattcattcctaccgagacagtggtagctgatgggtcaagggatgaggatggtgtgaggctttagctgtatctgaaatgtttcttaacaaaacaaaatgagccaagaccaacatgacaaaatgttagcatttgttaaatctgagcagtactcactggtatttgcaaaattattttctgaacacttgaaataatttataattttaaacatttccaatgcaagaacattataaacttttaagaataaagtaaaaatttagcttaagaagtggcaaaatggaggaaatatcaacatcttcacaactgacaattctttctgtgttgcatgtctctgacagacatagacgagtgcactgcagggacgcacaactgtagagcagaccaagtgtgcatcaatttacggggatcctttgcatgtcagtgccctcctggatatcagaagcgaggggagcagtgcgtaggtaagtaccacagtgcagtgagcacggtcctgtcttgagtaccttaactgtttcaacctcaagcattccaatcaaagcattcatgtttctttggagagtggtagccaataattccttatttttttatagactaccaatccattttccacaataacaagaaacaaccttaaaggttgagctattctggataacaaagtgttggttaaatgttagacgaagcaagagcagaaatttggggtatgaatgggacaataaaaacaaccacaaaaaaatttaaatttgctgttttgggggccatcgcgctaacacactggtactgtgggcttcattcaccattcactgctgcagagcatagcatagcacagcacatagagcaaatggtggagttgcattccaagcaccaaccccagctcgctttgagaccttgagcaagttacttaaatcctgtgtctcactatgttcacttgtactgtggagatgatactaggccctacctccagagctcatgtagggaatgcttagaatagtgcctgtccctgtgcagtaaagctgtttgctatcgttgtattctgagtcaacagatgggtattaaaggctctttatactgcaagcctttgtagggtaccatgagtacaaagccaagttcagcacgtgcctctgctggagggcctaagagcgtgagctccctgacagcaagaccaggtcatcttgtgtcactgtggtctccccagtccctgaagtgtgcccaccatgtgatggaggctctatgcgtgtgttttgagtgaatggaagatcaaagtatgaggaagccaactggcagatagtgaagtaaaatacagtactctgggctcaatcatgaggcccagcactaggcatgaaactctgactgtccatttatttacataccccttcttaccacagatcagtgaaaaagccttatttcctcttaggaacagagggtgaggatgtggggacagacaaccagcgtcagttttcgcctgagaatgtgagctgttgatgttcacatgtcaacactgagttccatgtgggccccagcccagttctgtctgccatagggctgtgcctagatgctggggttagtgcccagcctctgaggaaggcccagggtttgctataaatgaagctgtgatttaaaagaagagtgtgtagaaaactccagagataacaaagtttggccattgtattagacaggaaaataaatatttgagggcataaaaagtacagaaaaaagaactaatccaacttagtgtggggtgaatcaaagataatggaacatacggtcacagcccttttaatgtggtaggaggaaatattcctaaactcagatctaatcatgtgtcttcccctcctgcttccctcactgagagaatcaagtctacattcctcgacagagcatgaaaggtcttgctcaatctgatcattgtccagttctgttgcataaacacctctcccccaccacaaaatattacaccccagctttattccaccagttccccacacacgtcacacagtgttacttacactttggtgcctctatacaagctctttacacaacaaaaacattccctcctggcaaattcttatttcactgtcaaatcctagcttaggatcacttcctctgggaagcctgctatgatttacccaaatataattagttgctcctcccctgtgccagtacttctcaaattatgatgaaggatacttttttgtaaatttccaatctacggcagaccaatacttctgtaaagcacaataaaaataatgttgcactaatgtcaaattgctatttctaaacatgtactctcagtttctgtatttattcattgcagactggtccaaatagcccatgaaccagcagcagtcagcaggccacacttcaagtagcatggtgctccctgtgtcccatacactcctttctattgttgatcttctcattccatggaataatttgtttcatgcctgtctttcataccagacaaggcagaacacatgtatactgattatcattataaacttggggtgccaaacacagtaccagcaaataagaatggttcaatgaatgtttattagttaagaagacatgcgtcacatattcaccaaatagttattgagggcttactgtgtaacaagcattgttctaggaactgggataatagtaaacaaattttacaaattcatagccctcgtggagctattagaaagtataataccattcatacaaattagctatcaatactagcacctgatgatagtactgaggactaggaagcactatgctaaaattgctcttaattagtgtgaagtttcgatttattcgaataatgtttattgaacacctactactatgccaggccctattccagatctaacaatgaacagacaaaaaaccctctacctccacctcaaggggagaatgtcatgcactatagtgagggaacacacaagaagcaaataaacacataacacaatgtcgagtactgttaaggactacaaagaagtctaaagcaaggtaagggaatagatagggcagaagaacctatttgatattggtgggaaaggtggccaccctgaggaggtgacatttgaatggacacctgaaccaaagtaaggggaaaagccatgtgaatatcttcttactatttatttcagtattcaagttaaatcaaatatatcttgcagcttattagctcccatttatgtttacttgctttgtgccagtaactttgcctacattatgtcttgtaaccctcccaataattctactcacagaagaggaaatgcaagctcgagaagttaagaccaagctagtaattgccagaacaaagattcagactcaggttatcctgaggccacttgagcacactacttaattttagttattaaagtaccaaaagagcccagcataaaggtttgttttgttttgttttgttttaccacaaggcagtgtcactatatagcattacattgtatatgcataatggttgttttaaattacacatgccatgttgaagttgtcacaaagtgtagaatcatgaattaatgaaattttattatgcttctaagatgttagtcctacttagcaagttcttagttgagcattttatagttgaaaatatttatatgagaaggacacaggctggaacacttcatcaaagtgtcaaaagagcactctcaagaggtaacttatttagcatccaattcttccacagtgttcttttatttgatacacaaaaacgtcctaagatacacatggcaagccttgctatccacatcttatagaagaaaaaccaagatactgaaggcgtaagtgacttagccaaggtcaccagttgagcacagcccacaactctttcttctttgttttgtgctgcaccatgcacttcagtagttcttttttacttctgtaattatatataagcttttagctccccaaactgacatcttatatatatatgcaatagtctcaattattttgttttctttaaatctcaatccacccaccaagtttatttaccactgaatggcatgaacattgagtctttgttcttaacttcttaactcagaatacaaagtatatttaaaatacatataccctaattttaacaaaataggaaattattacttttaaaaagagattttctctacataggttttctagataatgcttttcagagaatgctaattcaataatttggttctctttgtgtgtgtgcctgataacctagacatagatgaatgtaccatccctccatattgccaccaaagatgcgtgaatacaccaggctcattttattgccagtgcagtcctgggtttcaattggcagcaaacaactatacctgcgtaggtaagccttttgagaacttgctgatttctgtcttcacaaaaggaaaccccatgccatgttgcagtatttccagttttctatgttcttgagtaaatagtttccatcgacttcccttcagcaatcataaagcttaaaagataataaccaatctgtgtcttaaaacacatcaagatgtgaacagaaaactttttaactttggttttagttctcctctgtggatagatcaacaaatttaaaactacaaatcaattgatatacatacaccagtcaatcagcagtgtgtgatataatgctgaaagtgccaaaggggttactacaagttcaagtatataaactttccactgaaagtgcatctgatttttacatgcctcttctcccctttcagaatgcaatgtcacggcacacaattaaaagattggcatgacatggaaaaaatctagtgtaggaaaaatgccttttcacaatattttcagtgctttagagcattgcaaaactccgtatgggtctcaaaggcttatgttataattgtaatggaatttaacagaacccatttaaaaagtaataaatagcacagataaatcttcagtacagcatgctgagagaccatatcagtataagtgtcttatatcaattatttatagaattggcattttgtatctgaacaacaaaagaaaatcgataccggagtgtatatttattagaagcattaaattcctttggaaagattcatcaaacatcaaactaactgtcattcctagaaaaaatatttcggtatttccaaaagaagtatatgacagacgtttgtagttgttccaacaaatatgaaacctaaatggatgttctccagtgagcttctgcagggcaaataattcagctagggaattactcacttgtcagcagatgacgtaggtacaaaagagtaaggatatgtttaaagtctatatatatatgtgtgtgtatatatatacatatacatatatatatatataaaactttttttcagatataaatgaatgtgatgccagcaatcaatgtgctcagcagtgctacaacattcttggttcattcatctgtcagtgcaatcaaggatatgagctaagcagtgacaggctcaactgtgaaggtaaaactcttcccagatagtatggaataaagtccaattcctgtgactgctgttgttttatctgattatgtacccatttatgaaaacaaacgcttacccatgggaattctgttctaaaatccagttaatgtagttcagttgttacattgcctttttagtgtgttaccaagaaaaaggaaaagaaataaaaataactgaaatattaggtgcaggctggctctaataattagaaagggtgctctagcatgttgcgtctcagtgtgttatccagtgaccaggtatgtcagcacctcctgggagcttatgagaaatgcagaatctcaggctgcaacccagacctcctgagtctgaatctacattcaacaaaaactgcaggtgactggtgtgcacatttaagtttcagaatagccaagtgcatgtcaaaacattaaaataaaaatcaggagatctggtttctggttctattcctgctactgtgtgacttgggcacatttcttgagttgcctgggtttcactttccacatgaacaagaggagggccatttaactagattcatgaccttcagggtccattgcatgtgcacatttcgttatataattcaaaaggcattagacatcctgagggggatgccacagacacttgatgtccctgacctcctcacggttcactcagctttacacaaagctcaaaccccaccgagagaggcctcacatcatgccattacactcaaaactgaaagaggctacctcaggacagctgcctctgcccttctgagtaaactgtagggacatcactattcagaaatgcaaagcattcttcccctgaaagtcagatcctgccaagctgtcattctggaagcttgcacaggttaggggacttggcattcaaagctcaaatgaacttggcttcaaagtcacccaatttctgagaagacaaacatgaactctacatcctggatgggtctgcagagtccaaaatgaaggccgtcaaccacaagccaattcattcagtagtgtagttaggtccaggattagccaaattgtcagcaatgattcagtaaaagtcatgataagaaaaactttttgtgctatgaagtcatagagggaaataagctgatattgttagaatttgccttttagctgcttataaagttttgtatttctatttcagaatttgcaatatttttactctctttagctcacctcaaaagtgtattacttcctctggactgttgagcagaacaaaaaaaatatatatgtgtgtgtgtgtgtgtgtgtgtgtgtgtgtatatatgaaacccaggcaacttaagaaatgtgcccaagtcacacagtagcaggaataggacaagaagccagatctctttatatatatataggtagatataatttttcctccttaaaatataaataattttaattatatataattattttaatatagatattttaaatcttataatttatatatatatataatttatatatatatatatatccaaagtagtggtgcacaaacttttcaactctgtgtcctttctcttgtctaattcaacagacattgatgaatgcagaacctcaagctacctgtgtcaatatcaatgtgtcaatgaacctgggaaattctcatgtatgtgcccccagggataccaagtggtgagaagtagaacatgtcaaggtaagtttattttttttttcatatgttaggtatttagttttagccaggaagagacaagaggaagttataggattctcctatagactttcatttttcccactttcaatatacaatttaagctcttttttcccctgttcatcataaaatatatacatctcataaagaggtgattctatgctaatgccgacatttttcgtccttaaaagataaataattttaataaaatattgatatgtattctatgtaacctacatcatctctttgagatacatcttcaaatcatccactggaaaagattcagttattaaaatgtttcacctgtgagtttgagtttagagcataagctcaatatgtgagttaaacatacctccatccagtcttagccctctaaaacacaaggattataaattgcgtaagaatgtaggtgctgagaaaagtcagcctaatatgttgtaaaatatagttgaatattttagagaaaactactagccccaaaatagctaatgaccttgggtccagtttcaaaataaacattcagatgatcttcacacctatacgtaagtggaagaggcagctccccacaatggtatgatttcagagtttctcaggaagatctaaaaaaaaaaaggaccctacctccaatgttgcatgtagttgaaaattttcttaacagggaaaggactgtcagataaaaccaaaaacgtagaaaatcctggaaaagctagtacaaacacttaaatttacacaaagcaacaaaagaatgaaaaaatgaccaaacttgacagaaaacctgtttgaatcccagctccactgtattcagtctgcacaatcttgaacaaattatcaaactactctgagcctcagcttcctcatttggaaaagggagttgtgggaatttagtggaataacatacataaaaataatttgtaaactataaagcttgtacaggtcaaggtgtttttatgaaatttacttaccaatgtaagtgaccagtagtacgtcttctgtagagagtcctttttaatcagagttggagtgaaggcacacaaggacaataaagatcctgttaagaaaagaaagatcaaggaaaggagacactggggattctcagtctatatcatgattttacaggaaaatattaacttagaggaaatccattacctgggattttataataggcacacaatttttcgactagactccaaccactgagtatgagcataatcagaatgtagttcattgcacaatgaacatctttataaccctttccaggttactagagactttataaatgttaattatgggaaaacattgcattccaatgattttacttactgaaccctaattgagactttcaacatgcatattacatgcaagaaaatgttagctagtggaatgtcttaacaaatttctctggagtccttcaaacaaatatctatgtgtttctgatcaaaaattgatttgatgctcagcaaaagacagaagcagattaatgcacggtgggatccgacctgcctagcctatctatgtggaaacatttatatctattgtaattaaaggtggaaaatgcaccaaaattgtaagtgggggattcctaaatgttatatattgaagatatgcagcttcagaatgtttggttaagccaaaacattttttgtgaaaaagacttagcattcttctaaagtataaagcaattgctttctcctacggaaatcgttccttctgagccttgtccacaggaataaaatgaaattgaaagttttggattcttaactttctctaaaagacttattttgtggatgaaataactgttctcatttcacaggcctatacaaatgaaaactgtgtgtgtgtgtgtgtgtgtgtgtgtgtgtgtgtggagagagagacagagagacaaaagaatacacatacacatagacacacactcatcaaatattttgagagtattaatttctgaaaaatcttccagaatgattaaggtgatgattatgctaggctctacattaatggaagtaataaatgaaattataaggttgtcttttgcttctgttggactccatataacaaataagtattagttttccctgtacctaaacagcatctttattcttcaaaaaagtggaaaatactgaaaggataagtcaattgtgatttcatttgaagaatctaagttttctttcttcagccatagccagcccaagaagacactttttgtaactgtctcttggagactacctagctttcccagtctgttcttgagttccagataactttagccagtttggaagctaaaatacttttttttcctccaaagtcaaggcatgaattatttagagtatatgaacttgaatgagccactaaacccttatttgtttttcatccatatcaagtggaaatatctttctcacctacctccacacagtttgtgtgaagagcaacttagttcaatttaatatttcttaaaagccagatgctctattgcattaatgctaggtgatgaaaggattaaaagatgggtacaataacccttgccctcaaggagtttacaagctaatagaagggttaagctagacatgcagattgcaataatgcaaagcagaaagcaataaaggcccttaaaaaagaacaccgggtatgagaattcaaaagagatcatatcccagcacctagcccatgcttggcttacagcaaggattcagtaaattacttatggaatgagtaaattcatgaataaaaatatctcattgtggagaaggaatgattcagaaaaagtttacattgaataaaatataaatcactattcaaatgtaaagggagacagacatagagatgtagatattaattttatttttattgttgttgttgttgttgttataaatgtaatggctctctagtaaaactgttctctcagatgtcatctggaggcttctgattcccaaatttaaagtcaatctttgtccagcctgaggtaaacacaacccttcttcccaggattctctctccctctgacttctttggcattgccttttcctgggttgtctccctgcactgacagcctcttccttaacttcctctttttccttacagtcctaaaattgctatgctctatgaggtggaacacttcatagtttcacttcctgtgctgtgcttcctctggacagtataatccactcccagcatgcttcagcttactgaaaccagatttctagcctttacctttctcccaagttcctgaaagagatgataagctgccctccatagtttatgcttcctgatttctcagcttggaaagccttccctgccccagccatgaaaactccatctaaccaccacccttcaaggccacgttgagatgcctcttccttccttcagccttccctaatccccctggcaaaattacccaactctgctccacatgccccagtatacttatctatctcttacttaattccattttactttctaagtaatcatatacacattccctcaattataatgtccctgatgacaagaactggtgtttaacttttatataggcagagtcagtggttaacattggggtttgaattcaacagatgaacaataggtgcttgataaaatatcatgaaatgacacatattaatctgcctagaatgtctcagctctgtctgtcctgaattcaatacaatgaacacccagtcttgtgtctaaaagcaggttgaacacagtccagatgctctcacacctccttccttgcaaacagaatctgccagttatatgatttaattagatcagttcattagtttagttagtaaactctttgaccctacatctctacagatataaatgagtgtgagaccacaaatgaatgccgggaggatgaaatgtgttggaattatcatggcggcttccgttgttatccacgaaatccttgtcaagatccctacattctaacaccagagaagtaagaaaaatcagaacttttgaaagtgaggattttctggtcttaccaagccaaactgctgaatacttttgtttgtctctgcagccgatgtgtttgcccagtctcaaatgccatgtgccgagaactgccccagtcaatagtctacaaatacatgagcatccgatctgataggtctgtgccatcagacatcttccagatacaggccacaactatttatgccaacaccatcaatacttttcggattaaatctggaaatgaaaatggagagttctacctacgagtaagtatcctgaaggcagccttaactattgagaaagatgggagtttgttgttgttgttgttgttgttgttgttgtgtggtatccacatgtggaaggaaagcaaacatttaaagtgtcttatgtgtaggcattgtgtaaggccttccagctacattatttcatttattcctcttggtaacactgccagatagatattaatattcatctccattttttacagaggagaaaagtgagatgcagaaagattaagtagcatccctgaaatcactcaaatattaagtttggcagactctgatagagttgtgtgtgaccacgaaaatacaagcctcccatccccccgcctctgcccccacccaacataccccccaagtaggtatcactaatcattgatggttaattaattatacatagacatacatataattcaaacccaaaataattcctggagctcctaaagagtttttcagacatcatgaattcatcattgttacattcacaagacagtttgtgttcacaccgaaactaaaacctataagtatgtgagaagtgaccccacctccccgcacagtatgtgtcagtagttgtaccattcttgccaacttctgggctggcagtatggagtcatctccctatctttcattgcctgtgtgaaatctactttctgaattctgccatttccctcttcacactgtctcctgggttatctttgcttcctcacatccctatctctcttcctataaactggctcccgtcacttccatgatcccttcagtggcttctgagctggtctccctgaccccaaagcctcagccttccagtctccctacaaaatctcagcaagttcattttaggttaaaatttggacatattttaaatacggctcaccacttcatgtgaaaatgatggcaccctaccaagcagtttgcagagttacggtaactgtttcatgctaatgatgttattcatccagttacaattttctcaaaactcctttgggcactctttatttttaatcaaattttaaagccaatatttcattttgagaatatgaattaaattgggaaattcatccttgtggtacagtttacagatttttaatgtttacccatttatcctgttttttgatatattaatttcccatatagctccagagttatgtgatattatttctttgccagtatattagaaaatgattaatttctcatgaccaacttctgaaaagaaagacccaatgcaaaatgcaatctattacaattatttttttgaataaaaaagaatatattatagttctttaacatttgatattttaaatttgacatattcttgatatttgtaagaaatttccactgaatgaattttacacaattcagatactaccaattaactaattctagcctaaacaaataacattatttttaaataacaaaatctttaaaaataattttctattttgaacttttagccataatgtaagaaaataaaattttctagcagaataatcaaagagtgaaacaaagttccaacatgttttttctttgcaattaaacatggcacttttacagttatttattattcatatcagtgcacttaccgacttcatattttcaaatcaaaatacagtgtttttctccagtgaaatccttattctcatgactgatagaaaacattgccaattttgatatttccagagttaatgttaaattatttgaaagaaaattatttaaaataataaaaatagacatttcaagactatttcttatcacataattcaaaaagtacttggatcaaatcctacagagtttctccactaaaattctacttgtgcagagggcattgaaacgcatgaaaatcaacagcaggttagttaggttaattaattcggttaattaagcacctactacatgctcagctctatgctaggtgtcatgaggaattaaaaggacatgtaatgcacattttctgatttcaaggagctttaaatattattgtgtagaaaaagttaacatctatgaaaatagaagtggggcaattttgtgcttaattccatggtccagatacatcaaaaaatcaatgtgggctgtcaaagaaggtttcttgatagtcatgagtcagcctgattcttgaaaggatatgtggaatataaaattttatttatattccttttgagaaaatactgagaaaaccatcttccctggaaaagagaacgtattgtaaagaaagtacatgaaattgaaggttgaatatccaacatcccccacactgccccagtgtctctgctcccttactgagccttactattattcttcatagccctatcactacctagtctagtattcactgaactgtgtcatccactagaatatgagcataatgagagcagagactacacctgtcggttcagtattctatcctcagcacatagaatggtacctggcacatagcagatgctaaaataaaatttaaatgaataaattaattcaatcaacaccttcaaggtgttattattacctacaactattgtttacaagaggtatgcaccgtggaagatcctggagacacaacaatgaataaagccaagccagttcctgcccccgtggagcttgtagtcaagacattgaacaagtgatcagaaagatgttgactgctgcagcagagggttgcaagctgctcatgagtatataacaagtagccctaaccaaagcattctctcccttggtttaatgtccacccattgaggtgactgctaaatactaatccatgactctatcccttggcattcaaactcacacatccacttacctgcctctccaacctcatctccctccactcacaagagcccatcatattattcatcaaaatgaaactgcacccagttcttctgaacatattactttacaaaactttcatttatgcctggtgactctcatcaggcattcaaaagctttccctcagtgcttcagggctcttccttttcttccctttatacatacacctttatgtatcttcatacgtaccctgcataacctcatatatcttagcatttaccatattctgttgaaaaactgtttccatttctctttacttactagaatgtaaacagatgcacaatgttgagaaaatgaaaagtgacaactttgtttacaagtttagaaattatcagattctcacttaagctctagtctctgtaaagtccacaactactcaataaaagtgaagaaaaatgttaacagagagggaggaatcaaaaacaaagaactatttaaaaaaaaaaaaaagcaagtccttgaaacttggagctaatgactgtattagacaagggataagagccaagaagagttgaaaccaagaagggaccaagtagtggctcttttataccaccttcaaaattctccccctaattcttataggaggtatactaacaaagcatagaaactccaatccaagaaaattattctcttcctttctctattttcttttattttagcaaacaagtcctgtaagtgcaatgcttgtgctcgtgaagtcattatcaggaccaagagaacatatcgtggacctggagatgctgacagtcagcagtatagggaccttccgcacaagctctgtgttaagattgacaataatagtggggccattttcattttagtcttttctaagagtcaaccacaggcatttaagtcagccaaagaatattgttaccttaaagcactattttatttatagatatatctagtgcatctacatctctatactgtacactcacccataattcaaacaattacaccatggtataaagtgggcatttaatatgtaaagattcaaagtttgtctttattactatatgtaaattagacattaatccactaaactggtcttcttcaagagagctaagtatacactatctggtgaaacttggattctttcctataaaagtgggaccaagcaatgatgatcttctgtggtgcttaaggaaacttactagagctccactaacagtctcataaggaggcagccatcataaccattgaatagcatgcaagggtaagaatgagtttttaactgctttgtaagaaaatggaaaaggtcaataaagatatatttctttagaaaatggggatctgccatatttgtgttggtttttattttcatatccagcctaaaggtggttgtttattatatagtaataaatcattgctgtacaatatgctggtttctgtagggtatttttaattttgtcagaaattttagattgtgaatattttgtaaaaaacagtaagcaaaattttccagaattcccaaaatgaaccagatatcccctagaaaattatactattgagaaatctatggggaggatatgagaaaataaattccttctaaaccacattggaactgacctgaagaagcaaactcggaaaatataataacatccctgaattcaggacttccacaagatgcagaacaaaatggataaaaggtatttcactggagaagttttaatttctaagtaaaatttaaatcctaacacttcactaatttataactaaaatttctcatcttcgtacttgatgctcacagaggaagaaaatgatgatggtttttattcctggcatccagagtgacagtgaacttaagcaaattaccctcctacccaattctatggaatattttatacgtctccttgtttaaaatgtcactgctttactttgatgtatcatatttttaaataaaaataaatattcctttagaagatcactcta

SEQ ID NO: 35994 - DNA, 57826 bp, Homo sapiens; identical to SEQ ID NO: 35993

SEQ ID NO: 35995 - DNA, 15930 bp, Homo sapiens
ctgaatggagaacatggctttccttgctggtctcagactcagagatgccctccctgatttgccttggctgtgacctgcagcgggctgaggccactgtggtggggctgtgtggacctccagcctccctgtgtgcccctctgaggagacggcctggcatacccactgcccaccccagtgactgctcttctgcttcaggcctgctggcctcccagcactgcctgcccctccctgtcgggggacatcgcctccacaccggctggggaaggagcccaggggtggggctggtgggtggggctggtggttggggcagccagagaagtaagagggaagtgagaagccgggtggggcaggctggaaggaagacgaacctacgaagcagaggtaggaggaagaaaggaaagtaggagtgttgaaaggtgaaggtggcagggtggctgccagcgcggctggctggtaccctcctgggtgggcaggcgagggctggctgtggtggcctgggaacagagacccacatttctggataccacattgtgccagggtggagttcccccagcctgctgtcctgccagccttatgccaggctccaggcacctgatctgatggcagctgtgaagctgcccgggaggatgggtgggctgtgcccatgctgcacatggaggaactcttgggtcagggcttgtcccagctgtgccagacctcctgacggaggccaccacactgctcctgaaggccctcagccagactggaggtgaaatcagattagaagctgcctgtccccaagacaggactgtggtgtgatgctatttgggtgggagtggcttggggagggggcagggcagtcctagccatttgaattcaaatgcaagtggcacatttgattattttgcaaactctggaagaccttggctgagggtctaggtggactgtctgaggtaggaggtggggagggaggaagtggttgaccctggggaagggtaggagacctatttggtatcaggggaaaaaccatttggaatccccaaatgaggcctctggacctagattctgagaatgccatgtcccaggctgggagattcagtttggtttcgagggtgggcacctacctccaccaggagaagtggaggtgctgtttcatttcacacctaggggcaagcagggactgtgaagggaagagacctattgggggtcagtggaatcagggtctgaggaaggcaaaggtaccactggaccccggcaggatttttgtccctctgatggctgtcaagtctttccttaaaggtgtgtgtaacggtgacctcctctccgaggtcccccagtgtgtcctcaaagacagcctaagtcaggaccatgggacagccagcaggacttgcgtcctcccctcccccagccccatggcagtctgggacccctagcccctgctctctgcctcctggggctgctccagcctgtcccagccttttgaaatcctgggctatcccttaggtgccaccccagtctaataatcagagcccagcaggtccagttaatcaaatgcattctttgagcacctgcatgaggttccagctagatccagaggcaaaatacacttcctgccctaaaggaccctacagtgtagtagtggaggtaggcgggtccataactcaccacactatggcagagtggggaaaagtaaaggctttaagaggtgtagaagaggctgtttggtaaggtggtgagtttcccatcactggaagccttcaagaagaggatggtaagggatgctatagaagagatttctgcactatgcgtgtatgggtatgtgtagggcggtgcaggcagagcaggactagataagaactttagcgctttcttttttttgttttattcctcccccccggccccagctcccctcttcaactttagcactttctaatgctgacatctgtgattctgtgacattccccacttagaggaagttcgtctgcggtttcactgggtatggtggctcccttgttcactgcaccctgcagctaaaccataaaacatgggctattctttgtctctgtgcatgtcacccccagtgccaagcccccagcacagacgttgagtggaatggaatagactctttgctgggctgcttgaggaacagaggcatcaggtgtgtccttgctccagttgagatgtgaagcagccagtttatgctataaaacaggctaaagtatgtgctcccaggggagagggctgggagaactcccagagaaggcggaggccacttaatgtcctggaagtttccttggacagctggggcttgatacgggcctggaaggataagggggcttgtgtgtgtgtgtgtgtgtgtgtgtgtgtgtgtgtgtgtgtgacagattcttcctctgttgcccaggctagagtgcagtagtgccatctcggctcactgcaacctctgcctcccgggttccagcaattctcctgcctcagcctcctaagtagctgggactacaggcacgcaccaccatgcctggctaattttgtatttttagcagagatggagtttcaccatgttggccaggctggtcttgaactcctaatctcaagtgatccacccgcctcagccttccaaagttctgggattacaggcatgagccactgtgcccagcctaggatgagggggctttaatggatgtaagggtgaacatggacactgaggaagctcaaggagctgtgggcttggacagagggctgggataggggaaagaatgaaaggccagaggtcagggtggacccttccccaggagagactggaacaaaaggtctcgggacagagatctaatgaggcagcaggagtttcaaccctgaccaagcattagagtcatctggagcttctcaaacactgacatccaggctccacctagagagtctggttttaatgagtccaatatggaagctagtcactggggtttttctttcttatttttctgtaaattacttttttttttttttttttttgagacagagtctcactctgtcacccaggctggagtgcagtggtgtgatctcggcttactgcaacctccacctcccaggttcaagcaattcttgtgctgcagcctcccaagtagctaggatgacaggtgtgcgccaccacgcccagctaatttttgtatattttgtagagacaggatttcaccatgttgcccaggctggtcttgaactcctaagctcaagcattccacctacctcagtctcccagtgtgctgggattacaggcatgagccaccatgcctggctggcactggggtttttcaaaagcccccaaatgattctaatgtgcaggtgagcatttgacactgttctggacagaattcactggcactactaccatcactttgaacatatgttcaaaatatgggtgatcaagccccattccagacctgtggaatcagaatccccagaccaggggcttgggcactgttaaagaaaaaaaatatggcccaggcgcagtgcctcacgcctgtaatcctagcactttgggaagccaaggtgggcaatcactggaggtcaggagttcaagaccagcctgactgacatggtgaaacctcacctctactaaaagtacaaaaaattagccagatgtggtggtgcacgcctctaatcccactacacaggaggctgaggcaggagaattgcttcaactcaggaggcagaggttgcaatgagctgagactgtgccactgcgctccagcctgggcagcagagtgaaactctgtctcaaaaaaaaaaaaaagaaaattactaagaggaaacatcaagggtaaagagattctggctagactgagctaacaggattcctttttttttttgagacggagtttcgctcttgttgcccaggttggagtgcaatggcatgatctcagctcactgcaacctctgccttccgggttcaagtgattctcctgcctcagcctcccgaatagctgggattacaggcatgagccacgaagcccagctaattttgtatttttagtagagatggggtttctccatgttggtcaggctggtctcgaactcccgacctcaggtgatctgcccgccttggcctcccaaagtgctgggattacaggcatgagccactgtgcccggcccctaacaggattcttgctgaatacaggccagagtgatcagacatcactggggcggcgggggcagggtgttgaggaacccaatcagatatccacgattatcagatcgaccagatatcaagggtagggggttctaggtaaatggccttagcagggttcttttgctaaaaccggattttacaagcacacagatgggcctacggggtggttcagaagcctagttaaagtttggccaagcaaagaatctttgtcagtaccgacattttaataaggtcccaaggtcattctaatgagcagccaaactcctttcttttctttttttttttttgaaaccgagtctcactccattgcccaggctggagtgcagtggcatggatcttggctcactgcaacctccgcctcccaggttcaagtgatttccggataatttttgtgcttttagtagagacggggtttcaccatgttggccaggctggtttcgaactcctgacctcaagtgaactgctcaccacggcctcccaaagtgctaggattacaggcgtgagccaccgcacccggcctgccaaacccctttcatccaaaccctgatgtggctctctggcatgtaggctgcctgattttgagttaaacacagaatgaaaaatagtaaaggtgacaattggcgcactccgtgtctcattcttgagcgctccctgatggcttgagcttggggcagccacttcaccagctcaggcctgagtcacaggctgggctgcctgttgcaggggatgtgggcacagcatgtgatcctctgtgggatggagaaacgttaaagtttccctccgcaaacctctgctctctgcatgtcctcttccggaatcgtggtgccaaaatatgccttccactattttgtaggttgggaaaggaaaaggaaagtcataattcacacagcatttcacatccattatcactgcccttgacctgtccctctttgtttcctactcagacttaataccttctgctctgtcatctgccttccccctacccctgacttccctggcccctgcgaaatattgcacttcctgatcctgctgccccagcccccaagaatctcctaatggtgccagcttgcatttttaccctccaattccccaagcccttaccctgtgccactggggctcatcttacacaaactctgtccaaatggatgcacagcatgaattgtattatgtacgaagtgcatgctggctctgtgatctctgcattttgagccaaaaaaagaaatcctctagtgatgggaacctatgaaagcgacagtgagtggagccgtagctgttgcattttctgaattttttaaaaagataatatctttttaaaaaatacttgcgtttagcattttttcccttgaatgacttttgtccagaaaaagtgttcatcattctggcatttgagggaagctgggcatacagaattgatagctgatgcctgggagtgggtgaaatttctcagggagggagtttagaattagagcagccattaaatataatgttaggtgaagggtttttgtttgtttgttgtattttaatagatgcctttttaacaggttaaggaaatttctttctattcctagtttgtgggtaaaaaaaaaattttttttttttttttgagagggggttttactctgtcatccaggttgcagttcagtggcatgatcttggcttactgcagcctctatctcctgggctcaagcgatactcactcctcagcctcctgagtagctgggatctggaattacaggcttgcactaccacatttggctgatttttatttattttattttattttatttttttgagacagagtcttgctctgtcacccaggctggagtgcagtggcacaatctcagctcactgcaacctctgcctcctgggttcaagcaattctcctgcctcagcctcccaagtagctgggattacagacgcatgccaccatgcccagctaatttttgtattttagtagagacagggtttcaccatgttggccaggctggtctcgaactcctgacctcgtgatccacccacctcggcctcccaaagtgctggaattacaggtgtgagccactgcacctggccttggctgatttttaaaatttttgtagggttgtggtctccttatattgcccaggcttgaaaaaattttaaactaggaatgaatgtagaattttgctaaatgctgtttctgcatctattgaggtgattacacatacatgtttgttaatagggtgtatagcattgattttcaaattttggcctgttttttttttttttgcgttgtgagcggctttatttatttattttaaatttataattgacagataataattgcacatacttagcaggagcagtgtgatgtttcattgtacatatgcaatgtatgtgtatatattgtataatgatcaaatcaaggtaattagcatatccatcactttaaacatttatcatttctttgtgatgataacattcaaatcctctcttctggctatcttgaaatatacactgcattattattagctatcatcaccctgattttcagatattaaaccaaccttgcattcctgggataaacctcatttggtcatcatggtttattttttatatattatttgatttcatttgctaaaattttgttaattttttttttttttttttttttttgagatggagtctcactctgtcacccaggctggagtacaatggcatgggcttagctcactgcagcctctgcctcttgggttcaagcaattttcccgcctcagcctcctgagtagctgggactataggcacgtgccaccacacccagcaaatttttgtatttttagtagagatagggtttcaccatgttggccaggctggtctcgaactcctgacctcatgatccacccaccttggcctcccaaagtgctgggattacaggcgtgagccaccgtgtccagccaaattgtgttaatttttgtatgtgtatgttcatgagagatactgatctgtaattttctttttgcataatatatttatctggttttgttatcaggagaatgttggcagcataggatgaattgagaagtgttctgtcatctctttttttgaagattttgtgtacaattggtattatgtcctttttaaatttttggtagaaattaccagggaagccatctgggcttgggttttttggcgggggaacgagttttttactacaaatttattttctttaatagatatggccactgttcagataatctgtgtcttcttgaatgagctttcataatttgtgtctttgaaggaatttgcccattttatataagtggttgaatatattggcataaagtttttataatattccctttatccttttaatatctgtaaaatctatggtgatctcacatctctcatttctgtattgatatttgtgttttctctttctgttaatcagtttgtctaaagatttatcaattttatcggtttaaaaaaacaacttgccaggcacggtggctcacgcctgtaataccaacactttgggaggctgaggcgcgtgaatcacctgaggtcaggagtttaagaccagcctggccaacatggtgaaaccctgtctctactaaaaatacaaaaattagccaggcgtggtggtgtgggcctgtaatcccagctacttgggaagctgaggcacaagaatcacttgaactcatgaggcagaggtcgcagtgagctgagatcacgccactgcactccagcctgagtgacagagtgagactctgtctccaaaaaaaaaaaagccaacttgaggccaggcatggtggctcatgcctatactctcggcactttgggaggctgagatgggcaaatcacttgaggttaggagttcaacaccagcctgggcaacatggcaaaaccccatctctactaaaaatacaaaaattagccaggtgtgatggtgttgcctgtaatcccagctgcttgggtggctgagaccggaggattacttgaacccgggaggcggaggttgcagtgaggcgagatcgcaccactgcactccagcctgggcaacagagtgagactcagtctcaaaaaaaaaattcattgctcttctctcttgtttctgttttctgttaatttctgcttttattttaatttctgtgagatctcagcagacggaagaccctggcccaggggtcagagaccttatttccatgaaccactcactagctgtgtggccttggactcatttctgagactcattttctttgtctgcataatggaactagggctcctagaggtggagtagttgatgaatatgaaagtacttggccactggaaagggcctctccagccccacgtgagaggtcctttttgtggcatttgtaataataatggcttcttctttctttccagatctgaagacagcatgtacacagccattccccagaggtaagctgcatgccccatctcctttcacaacttccccttctttacctccaagggctgcccctccccactgctctcctcatccccagactgcagtcgccaggcctgcccagggctgtgcttgggcaagtgggtccaggctgctgtcaaccctctctcttctcgcagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggtaaggggatctggatgggggaaggttgggcccaggaaggggagggagggggctggtatggatcacaagggccttgccctgccctctcccacttgtcccaggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggtcagagcccacctctaggcacccccaccctgcagcttccctcagagccagccctgcttctggctggttctcaccctgcagaagacccgggtgcctttggagccgggtccccacctttctgcccgtcttccagtgggatggggtgcagagggctctgggtctcctgtcagtccactcagatgggccgtctgggctgcaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccaggtgggtaggctggccagactgagcactccgtattggcaccatcctttataaggacggaggggcaggaggccaggaaagagggagagaagctgagaagccgtaaacccattccaagtgagatcactctgaccattggagaatgtccctatatttgtaaggactgatgccagcctccttctgccatctagacattgcctctgatgctctggagctttttccctcctcttggaagcctctgagttcactgcctgccagaccattcattaattcagtcatttatctcttcgttcagtgaatctatgatgctctctctgagccagcacagggaccataaaagctcgctctggggaggcagccaagatgggccagtcacttgccataacctgaggcaggatgtgatgagggctttaagggggacagctgccatgtgctgggggggtcttggggcagggaggggccctctagcctgagccgaagccagttgtcccaggaaggtgacattggactagacctataggaggggagatgccactccaggcaaagggagaaggtgagctgagccaccaaggtggggaagggtgcagacatgcacacaccaggggtctagtgagactgggacccgggctgggggacaggagcagggggagggaaattcctaagcaaggtggaaggtgagccctaggtcatgaggagattggctggctgaggagtatgggctgcgtcttgtggcgctgaagatttggggcagggagatcaatccaggagctcttggtgaggactacacgtgctgagacaaggaaggggacaggtgaacagacctcgccattaccagaaaaggagaggtgacaggggctctgcctggcagggcggtgggtagaagtgtgagatgctgcgctcaaggagccattcagccattcacccatccagtccttcactcagtcagtcaatatttattttgcgcctaaatccatgccgggctctgttttagcagtgggcccacagtggtgagcaaagccaaacaaaaccttcatgtcctaatgaagctcactttctagtaggtggagataggtggttaagagacgtttaaacataggagatatgtgatgggaagaaaaataaagaggtgctgggcgtggctgctcacgcctgtaatcccagcactttgggaggccgaggtgggcagatcacctgaggtcgggagttcgagaccagcctgaccaacatggagaaaccccatctctactaaaaatataaaattagccgggcctggtggcacatgcctgtaatcccagctactcggcaggctgatgcaggaggatctcttgaacccaggaggtggaggttgcggtgagctgagattgtaccattgcactccagcctgggcaacaagagcgaaactccatctcaaaaaaaaaaaaaaaaaagaaaaagaaagaggcttgagcccagcggtttgtaaccagcctgggcaacatagtgggaccccatttctacaaaaaattaagaaattagccaggcatggtggcaagtgcttatagtctcagctgcttagaagctaaggtgcaacgattgcttgagcccatgacgtcaaggctgcagtgagccatgatcacgtctttgcactccagcctggatgacagagtgagaccctgtctcgaaaaaaagaaaggaagacagatggcaggtgggcagagaaacagttgcagtgggtggtcgtgggcattttcagagagccctctgtgctgtgctctgccttcctggttgtcctgcctcagggacagttcagagaggagagagggagagctgtgcgcccttctctgagctggggagcaggacacaggcatctggctctgacccggactttcctgcttccttgcagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggttgggggacattggagtgggtggctgggagcctctgcttgaaagtggccaagagaggtggtgatgagctgagggctgagagtggccggtggagggtggcaggggccatctggtgtactgcctagggctgtggccagctcacagggtgcccctctgggtagatgctcgtcctcgaggctgagcagcctggctggtggggtgggctggactcagccctcactcacctcacctctgctgggtgccctagtgcagggcgcagtttgccccaccagaagcagtggccctgggcatgatgggctgggaagttccagggcaggggtccctataaacctggcctgccctggcccctgcaggtcctgggccccaagcctgctctgaaggagggcaaccctgaggaagacctcacagctgacaaggcaaatgcccaggccgcagctctgtataaggtgggccccccaagcctgccctgggacccggcagcagggagggtgggagcctgcacagcacagctgcatgcaagcagggtggaggggagaaggcagggggaaggtggggctggaaccgaggtgggaggtggggagttatacagggctgggagtgagacaaggatggggagtgggcggaaggcaggccctcctgaggagatgagtgcacctcacttccagcctatgcttggtgaaggcttgaagccaatgctgagcttttctttcttgaattctgtgcatttctttgtaatttggaatccacctaatttccaaatgggttcggggcccctgtgctgcagggattggggtgatgagagggagtggggctgcctggaatttgcttttcaggtcttcactctcttgtctgctcctgggacctgggcagtgggcagcgaggcacagtgggagggacctagggaggaccagcctccccctcctcaggctgaggtgagggctggtgtgtggggggtgagatcaggcactgtccctcctccccaggtctctgatgccactggacagatgaacctgaccaaggtggctgactccagcccatttgcccttgaactgctgatatctgatgactgctttgtgctggacaacgggctctgtggcaagatctatatctggaagggtacgtggctcctctgtaacagcctgagatgcctgtagctgctctgacccgggcaggcttccctttgcaggactcagcctgtctagctgcttgtaaaagacagcctcaggaagcctgcatgcttctggctgaccattttctctctttaaaaattttttttaaaagatagagatgggttctttctatgttgcccaggatggtatcaaactctcagcctccagtgatcttcaccttggcctcccaaagtgctgggattacaggcgtgagccatggcataggccttgctattttctttctttctttctttctttctttttgagaaggaatcttgctctgttacccaggctggagtgcagtggcacgatcttggctcactgcaacctctgcctcctgggttcaagcaattctcctgccttagcctcccgagtagctgggagtacaggtgcgtgccaccacacctggctaatttttgtatttttagtagagatggggtttcactaccaggctggtctcgaacttctgacctcaagtgatgcaccggcctcggcctcccaaagtgctgggattacagatgtgagccactgcctcgccattttctctttgctgttcccacctcctaaattctagacaatggctctgaaactacagcaagcctcagaatcaccccacggcctgtttagatggctgggctccacccccatagattctgattcactaggtctggagtggggcagaacatgcatctctaacaaggttatgggttatgtctgtgctgctggttccagggatcacactttgagaaccactgccctagcccagctctagacctttggggcttctgggacccctgatcctgggattctgtctcaaggtttgacagaaatgaattttagacaaattaaacatcattttatgcagtgagtggtgaacctgtagaacttgtttttccaaaagattctatcttctggaaatagaaacactgttgggcagagcctgttctgcttggtttgactgaaaatgaaacaaacttgttctcagtctctgcctggggtctgagaattttcagcaatagcatttgctcaacacccagttgtggggtcaaccaaggtggagaaaatgccagcccctagcctggtcaggaaggcagacaagtaggtgggtatctacagatagctgctaccaggcatttcatagtattgcttctgaaactcagcagggatagaagtgaaagggaggagctgggagcagcaaaagagtggaaagcgagaggcgtgtgctgcagggctgccttttctctcctgccagagggcacatatcccatggaaccaatgccaagcagaggggggttcacagaggcccacagaagcatgtataaaccggagcaaggaacccaacaactatggaaagagaaatcagaggaaaaacaggaaacttgggaggccaggaagagaaggatctcatgggtaggggggcagctggtcagttgacagaggaaggaatccagcatattaatttcagatacattgtagttcatggcattttatagcctgcctagagagccaaccacatcacggcatcgtttcggtatcatttccttggaaaaatgtctggcagcctgggcaacatggcgaaatatcacttctctacaaaaaaaaaaccccccaaaattagctgagtgtggtggcgtgcacctgtggtcccagctacacgagaggctgaggtgggcagattgcttgagcctgggaggttgaggctgtagtgagccgtgttggtgccgctgcactccagcccgggcgacagaacgagactgcgtctcagaaaaaataaaaataaaaaagcctggaatgagcagtttgagttctcaggactgctagcagaaatgactggattacgtggggtcttcatttttgtaagtgcttagttagcataactgttaggccagtgtagccctgctggcattatgggagtaaatcacctctataataaattgtaccctttgtcttatttagtttttcagaaaaggcttgatgaattcaagaggtgaggggtcctagaggaaaaggagacctgcggcctcacagtctgatgctagggtgaacacctgttcccctccctgaaatattccaggggcccaggtcagagcagagttttgcatgatcagacccgggcagacgaggggttttcatctaccttggtgctgccggtttgggaaaattcttaagggactgactccacatctccaaagagcccctcggcattcttgggacccctggtccatttattgtaaaaattgctggctcttctgtggactcccttaaatttcctcaagaaaaatgggatggcagctaaagagggtccctgctctttttaaaaatctccttcctatgatctagggcgaaaagcgaatgagaaggagcggcaggcagccctgcaggtggccgagggcttcatctcgcgcatgcagtacgccccgaacactcaggtgaggagatgcgcacaaccacagccctcttcctagggctcttcctgtggcccctgacccctcaaattggccaggaagggcaggagagccttgggcactgtcaggaacaaccaggcctccctcttagacccatccagtgggaaagcccatctcaatccttcaaaatgtcaaaatacttattattttcaaagaggatgttgggcagcactctcctgggtgcccagagaactgggtactcctcctctgggccgttgtccctggctggtgccacccctcctgccgcagcacagtgtccacaagtcatcccgtggggagctgacagggctcagctaccgttggtggcatttattaaactgtgcacccacgcccttgaagcagtctgttgcctctgtctgtgtccctgaaatcttggttctcatctcatggctcatccaggggagctttcccagcctggactgcacatggattcaggccaggcgcccacaccctcctccctggctctggccccctcctgtcctcctgggcagaggcagaggtggcaactttgtgaaccagacttctcccccgctgtccctgcaggtggagattctgcctcagggccatgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttccc

SEQ ID NO: 35996 - DNA, 38374 bp, Homo sapiens
ggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaaggtgagtaggtactgatttcaagaaactttatgggatttttgtctttcttctcctcacaaagaggggtgtaaaggggaaaatcagttgcctgattcaagataatttcctctataagctccagattgtgaaacgttgaactgaccatggctgtgctttttacattacttgaaaaataatcgcgttatgtgtgtttttaagagttctgtggttaagataagatgttcttgtactaacttgttttcatgttaaaggcactggaaacttttaaaaatggctttaaaatttttccctcctggattgttaacatcttggaatacttccccaggcagtctggaagttattggtctcttgcaataattttatgttcctctttgtctgctggattctttgtaaggttagaatattgagcattgttttctgaataagaatgcctttcaaatatcatggattaagaacagtctaaaggaagattctacgcattatcagaatcattgaatatatttctgtaaaatggctacaagatacctataaacattcttcaaagggatcaaactgctaaaatattttattattcctgtttttattttgtttcaagaatgattgattaattcatcttttctagtagcttgatattaagggactaatattttccacatattctacgttttaaccacattcgcattaatgaagaaaatattttttaaaatgtttcaacaggaggtttgactttgctgcaaacaaggtaaagatactagtactgtttgacttcagaaagctgttttgctatattttctaataattgcatgtaatgtttttcatattctaatttcccctaaaaacacatttgtctcattatttatgtgaaaatattcttttatttaccatagtcatgaaaatgctgaacaaattggaatacaaacttccatagaaataaatatttaagtgctaaatgtaaagatagctaggagaaattattagacaatttttattgcacataactaaacatggttacatttaaacatatagattttgcaaaggacactgcatgaaaatttggtttttgtttgtaatatcaaatgtatttgttgtcctcatagctaatacatgtaaatgtgtgtatgaggggaggggtagatatacaatgaaatgtcttcagttatattcagcccatggacacaaaagaaaagaaacacccattttccttgttcccttaatttcctctcctccttacccctcctctccttcgctttgccctcctccttatctctctccaccccttttggctcctttagacttctcttcactcatcaccccaccccttcctaggcaagcccatatctactcctctctcctcctctgtcttccctgcctgttactccctccctactccccatgtggcctccttatgcctccatttcttttttttagttctctctctccttgcctcctcaccctttctttcccctgaactctcaatccttcttcctttctcattcctctccccttttcctccctatcctgctcttcccaggagatgctacaactcacagtccttttttaggataccaaatgactactatcccccaccaaccatttattgaaaagactacaaacttaggggttttagctcaaaaaattgcaacatatttgtagttgcctcgtggttgcaagctttttataagcactgtggctatttttcttcccaatccaactttagtgggggggtgtttgccacttacagtaccttgacatcacattaagttctgtttatttccctctttctctttagatgcaaaaaataatcaataagtataaaattttgctgatatgtgtttgtgtgttcttaagctcaaaaagagttgaaagagaactgttcagcctattttttttgtcatgagtaaaagtaaagttgaagtgacttaagacagtacatcttatgttccctgtgggttttacaaggaaattctgctattagataagctttggaaaagttacaggaggtatctgaatatacagcacactgagagctgtcataaagttctggggtggggtttcttatatatgccctcataacttcagagacggcacagctctaatgaacactcacttctagttcactcacaggcattttctggatacaaacaagtcctcaaaaagaattttggtcgtcttacaaatttgtgaacattgtatttaattcatgtgttttaatccaccaatggagaaacatagtctgttttatatttcctgtagattataaacatgccaagttttaagtacaaagatgcgtcacctagtggctgacaagccaggttaccatttacataacgaatgccaatattaatgttatgtagctggctttggtagtttataatgagctttaaaaaattcatatgcgtgaattttaaatgttaacactgctctcctaaggaaattagtatgttacggataaatattgcaaacacatatactgacacgaaaacacaatggtaacaatattcagagtctttttggaaattagcttaaatgttacggccacttaaaaattctacatatgactattgtttaaatacatttttcatgtctctgatgtagtccttatttgacataagtattttattcactgcttaattgttagatagattatagacagctgttactaagtaatactgctccattagggcagaaacagaaactttattttaattaaatgtgtactaatgtttgagtttctatattttgctacagtgataattccagtaaaataaactgtaggcctctagttgttttagaattttaaaactgtaaatggactcagagaatcagtttcttattagacgtcatgagagtatatttttttcattatgctttaagagggaatttgtaacttgctcaggtaacattcaagttttctggtttgtgtttgtccctacaattaaacacactgaactaacaggaaaaggttacatacatttaggaacaattgcacttttaaagggagagaatgcatagttgctcacatatctcagtgtcagtcacctaacatggatcagtgctttatttgagattacaaaactagaaaatgacggagtcaaggctaggaccaatattctgttcagtcttagataattatagaatacacattaaaatcagatatttgaattttcttaattttgtaactatttgtcattgaaaggagatactaaaaaaattatatatcgtcctagaaagtacatgaactaataatgcatttctaaaggtgaaaaaagaataggtatttttctgtttaatattcaattttatagagagtagtacgttaatttttttaaaccccagaagctcaggatcttatcattttaaaagaaattatcaccagttctgtgtgagtaaataaagtattataacactttgtgtttttcatccatgataccttgtatttacttacctgagctttttttctagggaaagaaaaatgctcaggtaataacagagccttgaaaaatttggattttcaaaactacctatttatgtataggcctttagatcatctgatgttgaatactctttaagtgatctaaaggcctacatataaaaaggtatttttattaaattctggaattaaacatttcagcattacaagaaaagaaagcaaatccactggaacaattctgggaaagaaggaaagactgtgattaaatgcctcttaactacttcagattcctggattgatgtcttatctacaggcttctttttaaaaatcaagaatgattggctgtgagtttaccaggattatagttgaggctaaaggacagctcctcaggaaagcccctgttctacatctacggtcacatgctggaccttgagttgtcactcagagaaaagagtgccatctaccgaaactccacagtttccattgtgaatggcttctttggtgcagagttccaaaaattatgtagcccagctctttaattttgtaacatctaatgatatcaccgccttgaagtgattaaagtagattgcttaaagaattaaagctttaaagatgaaagatgttattgcttttgctggacatgaggaacagttgtaaagtttccaggtctacaataactttctggaaccctctcagtgaactgtttcttgtaaaagttttccctaagataaaagctcaatcccattgtttccacactcaaaaaaaaaaaaaaaaaaaagatcatatagtgtaaaaaaaaactctccagacttttcaaaggggaaactttgcctgtttcatgtcaagatgacaacggaaaaaatgagatagctattcttacataaatcatttgtgaactgcagttgggggagttacattaaccaccagagtttcagtctgtgtctaatgaaaacacagcagaagtggattcctttcagattaactaataaaacccttgtttttttccatgactgaggtcaagcactgctgtttaaaatgtagtcttaatgaacaaaatgaaacgttgaaagaggacgagtcaaaatgcccaaaagatgtaaacatcaaagagaaaagatccagaaattattaaaagttaaacttcccttgaattctagtattaagaaagtactgcttcagtaaaatggcatatatttttctgaaactgtttttctatagtattttgtgtggaggatgacagagactgcatttctcaagtaaattaaaatcacagaaatactctttggagttgcatagcatgttcacaacgttccagtttcattcagtgaaaacttctgatgaacttagatgtatattaacatgaatcatttagtaactatattttctgaaaaacagtgtgttaatgagacatcttaaacatatttttgcattggatgcagaagtcttttctgtctggtactattgttgttagaaccctacttttttgtatatagcaaaatgtatgcagggtttctgagtcacacatttattctgttggtggtctggatgtcatcagggtagctttagagatataacccttcttcataaggtcaagagaaaataaacaggagaatttaactccagatggcatcttcctgttttgaggccagatagaaaaatattttgcaaagaactgttgtccttcaaaatatacctatctagattcagattttaaccttgcagggataaaaaatcatatgggacagagctttggagttggcttctttaatcgtactcagttttgaaatagcagaaagaaaatagaatgcagtaattaagagtatcaaatttagagaaagccttcttacactcagatcttctttttcaccctgactgtgtaaccttgggaaaattacttaatgtttctgcagttaagattcctcatctgtaaaattaggattatgacagctgtaagctcataaggcctttgggagtatgaagcaaaatagatattcaaactactcagagcagtccctacaagataggaggtactatagcactagttttactaacgctggcaaataaaattactctaaggaagaaattaaagtacttagtaacttagtgataaggatggtgaaatgtaaaattttatttataagactatacaatttaaagttgtttgccaaatgtaataagacaagtagaatatattctcttcaatgtttttataatttgacactaagaagattttattatatatgcaattgctggtggttagatatatgatacttaaaattttctaattatctaattatttttatttttaacaggataaaatattaatcaacttaaaggacatttctaaggagattgaattctaaaagattaatcttttagacaattctaaaagattaatcttttagacaattctaaaagattaatcttttagacaattctaaaagattaatcttttagacaattctaaaagattaattgaattctaaaagattaatcaacttaaaggacatttctaaggagattgaaaaagcatatatctataaaatatgaaacaagaaaatatctacaaatgataatttatcaactttttttcctggaggtagcaagaataaataaaatcttattttctatgcaaaacagtgcttttaaattaaaattattcacctagaatgtctacagatactttcttcagagtcctttttgttaagtaatctaacatattttaagatactctgataaatacataagcagcagaaaaaatattttattaaaatttatgttttccaaacaatatcatttaaaaggcaaaccaaacattatttcaattggaaactatatgaatgccaaatacccacatgtacaaaatattcagctttctaaagtaatgaaaataattatgataatttatatatcatatctgtgattcttagattttcagattatacaacatcttttcccagataaggatttagtaagaagagaaaaggaaaaaacattcacttttcattcaagccaaattaattaatttaattaggtgctttagggaataatattattgctccaaaaatagtattaagacaaacataacattcattttttgtccaaacaatatgatttcttcaagtcagcatgatttaacatgaagaatggaaacaaaaaaatcacaaaatagtaagctttatgcacatctaaaaatataaaattatgttatttggctttatttttctctaaaattccaaaatagaaaactaggaaagaagcagctaagagtggtttaagacatgtgttagcttcaatatgttttatattatagatcccagcaaggagatgattgagtttaatacattgcttgtgtgatcacaagtaaatttctttcagaattgtacttcgtagtaaggaacagaaacaccaaatgacatgggagatggaatttaaaattaattataaattggaacagagagatttagtttaaacaactaaaataatggaaataattggaaagtccattacttttcaatagtagaatgaaattatttgccttttatttaatatttttggaaaaaattaacttatttttttaaccgaagctactctgaatgcagatatctaagaaatgaagagaataatatgagatgacttacttctaaatcccattttctattctatttctaaatgttgcaaatggctaactagagcatttttattcctctagaaacaaaacattcttttccttgactttgccatgattttcgcacatattactaggtattaaatgaaggtccatgaaacatcaatctaagagctttaactttcagtagaatatattgctaactatattttgtcatgcatggaataataaaggaagctatacaaaactatttttttcagcaaaggtaactaaggtagaaaaacagagaaagggctaattttcagccacaagtttttacaggaactgacttctcaggagagccaaatttatttcaagtggatgtgaaataagttatggcaataaataaagttgcattaattcttattttttaaacattccaactctcttttttttacttaaaacaatatgactttctaaagtaaaacaaaacatacatgcaccatgttgactgtcatgtgcaggtgagaagagaaaaatattttaagaatatgataatttttaaaattgcactaaaataatctttatattgaggcctccgtgttttaaaaagtactataatatgtttctaataaaatttagaaacaataagctaaataacaacgttaatacttataacattgcatttgacccaattttaacaaactcatttacaattttaataagtcaatattgtgctcatttatttaataattagcagaacaaatggaaagtactgtatttctaatgatgtgaggacacccttaatgagacataaacataggaggatgaatacacaggagggaaaagtatttatgttaatttctaggcagatcaagaacatatagaagatacttaaaataggaaatgtttgagcctagctttaactattatcttcatttgtctttaatatgcctttagtattcaatggctgtttttcataatccacgtgctgtattaagtgtgaaaagatatgcctgatccagaggcaatgagctaaaagaatcatctgtacaatctaacaatgcttttgaggatggatctggagggcttaaaatacacattattaatgggaaaatcttgggctgaaactaatctgtaggaatatttcatataaagttgatttggagaaaatttttaagtggttcattttgagaaaaggaaccaatgtaattacagtgttccatgtaattttactgcacaatcttccaaacccaaattttcggaccttttctgcagactggtgaacttagtacttaaatatgaaacgccagttctgtctagagaacaaaatgagtttaatgcatagactcacctgttattactcttcacaccaatgtgtaaatgactgtttgctcttctattaaatatattttccgtaacaccattcaaataggcctacttcatttccactgagataagcattttggtattcagcttttatattcactaagaattaagaaatgctgttttaaaagcttaggaaatgtatatagaaaatatatcccatgttctcatatatgtgtttcagacataggggaggaattagaataaattttctaaataaacaaattatttgcctacttaaaattgcaattaaaaaatgaagctttccttcgttagctgtaaactacattgagaaattgtaacataaaaaagaatggatttttaaaacttcttgagtagatcaagtgtcttgtacaatatcattaaatttgtatcagaacacataaatggaaatgaggtggggaagcaattgcagtactttctagagtctaggttttgaaattctttttggtgaacatttactaaatcagctaaacatttcaactcatttaaacacaaacctaaattattattaccctagacagagagatgatatagcaacgggacctcgaaaaggtgatcttttgtggctgcatgtagtgcccagatggaaaaatcttaggaccactaaaaggcctcttgaccactaggcggcaaaaactaattttgaactacttgcctactcggtagcaggcctctttcaatagacattttaaatatcttggctttgagaaaataaaaatttcaccatctcacaaaaatataaattactgaacagtacatcatttgttgtttgcaaaaatttttgcagatgcttagaaacttattatttatttactcaattactggcaaactatcatactaattgtcaagaactaaagttgtatttaaccacaatacacagctaatgccttaagaattgagaccaggttttgttttggcaattcctaagctgattcatagttaatagctgctgaaatttcagtaccttgtatataattatgaagcaagtctaaaattttggttgaagcaattttttttaccattttaagccacaaatacagatggttatgattcatattttccctattatttttacttattccttgccaatgtttattttaaaaacatctttttcttttctttttggtgatttggaaatgtctttacatccatatgggatatacaatatattatgtcatatcatgttgagctactaatgccaaatagagctaacagtgacattcaatacacataataagttctgttaaaactttcccaggaaaatctggtagagttttatgctgccaagattagctcagttttcccctgaatttctcaactaggttgataaaatccagaaagtcttcagagttagtgacaaaatcatctctttagtttaatgctcccatctgctgttaaggcaaagaatagcaattgggtagaagagcttattttcaatgttcctttaataaataaatgtttaaatgcttgtgtgatatacattgatgttaattcttactataaatgaaattaaaatatctgctggtcttaaggaaaattgactatggtgtgccaattttatgttaacaagcagatatgatattttaattaatttcttgctacttagcaaattacatagggcaagtataattttctaatgaaaggaagaaattatttgtttcaaaccttttcaactttggctattgttaatagtcctaacagagtaacaaaaatcacctttcagcaaaacctaaggaaacttcacgtcatctaacttgtttttcagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctgtgagtttaaagataaactgtacatcttcaatattcatatttagacacatgaatagctcctatatcataggagcctaaaagggaatgaaagtcatgttcatcaaatagccatgtttgtattacgagtaaaaagtgaccgtttcaatttaaagataaggattggttagaatctgggttactaaataatatgcaaattctgtgtcttgtttaacttgtttcttttccatttattagcctactcgccctcctaatggtcaaggacctcaaggccccaagggagatccagtaagtaaacattcttcagtagaataaaattaatactaatgataattctagtaagagtttgctttttctagatttgagctttcatcatacattctcttcattaccacatatttgaataatggcaccaaacaacagactgagaatccataattgtacgtgtaaagatttcaatttcccaaacttcatattatgtcttcacccccatgatcagtttaaagaaaatgtgtaggtcaatatacaaaggaatacattatacttaaattattcacaagattttgattaaaaagtatgtgttataaagaaaatatattacttatattgtttcctaatattataaagtagagaaacaacaatctgataatgattgtgaatcaccaggatttttcactatttaatttatttttatctcttttttagggccctcctggtattcctgggagaaatggtgaccctggtattccaggacaaccagggtcccctggttctcctggcccccctggaatctgtgaatcatgccctactggtcctcaggtataacaattacggtacttaaaaaattccctcataaaactatctagttcatcttctttctttactcgatattacgtctcactattatgagttctttgtatctgttctctgattcagtgtatttaataaatccttatttagtgcttctatgtattaggcactattctaagtactttataagtattcatttttcctcataatgctaatgtcattgctactatatccttggaaaatttgctaatttctcagcagatatatagcatacacattatgtttaagaagtgaactatgaacttaacaaaaaaaattaacctaaataatttagttagtactgtatccatactttattctcctactaataccaatgtcaaagcctctaaaagtttagacaaaaagaagttgaagaactgttagtattcctattgaacaggattatttctgcctatgaaactgctcttgctaatacttcagagcacaccttgcttctcctgaagcatggcagccaaataaatctgcaggtaaaacaaccaaacaaataaatatgacaaaatttctgttgcatggaattaggtgaaacgagaaaatatattacacaaatttttgtgaggttaaaaagtgcatttcaaaaagcaattcaacaagaaccaaagtatattgtctaagttattcttattctagtaaccaaacagaacctaactctagacctggaacttagaatttaaaaaaagcttcaaagaaatctaataagcatatgagcctttctactattttttggtttattttctatggagatgtttatttttgagtgaatcttttagtcatattaaccagaatccaggggatatgaattttacttgtatcattaagtgtttgaaaaataatttgacttcatttttttgctcaaaatgagaaggtgtattatatgatctcgagactcttttggcctcaaacagcctatgatcctatgtttgtaatgatgtagctactgcttagaaataatagcttaagtaagcgcataataggaaaaattggggggaactaacattgaacacagtggaaagatttgtgcatcccacaagaaaatgcttctgtaggatatctaacgtctaaatctacagaaagacacgataaacaagataattagtgaatacataccacatcttttggcacacaaaaacctatcagtagacagtagatgttgcatgcacttctaaatgctttttaaaagaattatgaactgtctgttaaaatgatcatatctatttgtctccttgccacagaactattctccccagtatgattcatatgatgtcaagtctggagtagcagtaggaggactcgcaggctatcctggaccagctgtacgtacaaatgtttctcagcattttggagctttattatctttctggtttgtaaaatcttgaatggttgctcttctaggaattcagtatttttatggaattgtacaaaatagcttacccctactaaggttggaaaagaaaatggtagcattatcatgttctttctatcttattcatattattaaacctatttttaatcacatataaatttttactaaaaaaaaaaaccaaagtcaacacttattaacatctcagaaaagtgtttataagagaaaatggaaatatacaaactattgttttataaatttactatcagtatttagaaacagcatgttacaaaactgaagcatactgttttcagcttgctgaaggttttctagtttaatctgtatttctgaacaatgataaatcaattgtcctatgtatgatgattcttgcatgatcatataaatctctatgtcaattaactctgtgatagatatatcaacataattatgggacttttgggttgatttacattattattttagatacttgattataggatttctagtgtgccaataaatgtttttctgcactgagtttggctgccaagcgagaaattgcttcttcaccagtgcaatataaccctaacattgcagggattttcatagcattatgtactagtttttccagatttttaattcccttccttaagagttcaggacaacattttataacatttattaataatttatatagaatctgtgagaatttcattacagtaatgtttgcttgctaagatcttcattatagatctcatgaatagttatcaaaaagttatcaaaagatgagatatagttgttcatagttttaacaatgcgagtgtcattgctttgaagcatggataaagtgtattttgcattcatttattttgtttttcattcaaattcacattccagggccccccaggccctcccggtccccctggtacatctggtcatcctggttcccctgtaagtatagccattggtggtgttttcttcctcatttttagaaaaatcaaattaatatatattctgctataattcagccattccagcatgcataatcccagttaactagagaaatcataaccaagaaactgattaaggcttcaaagatggaattccatatttaattcctttccaccaacagttattagcaattgaaatcttggtaaaattaaaccacattaatttgcatgtaatatgacttttagttcaaaaccattcagttttgatggattgcaatgaatggaatgaaatacattaacttcattctgatctaaaaataatttggtctcaatatttataaactggagtaaaatttgctgattacattcacaatcctgatttcttactgtcaagatgtaaatgaattatatgaagattttgttactttaaaattatttacatattctactcactagggatctccaggataccaaggaccccctggtgaacctgggcaagctggtccttcagtaagtaacaattaaatttatatttagtaagtcgataattccatatggaacctacctttgttttctaaaacaagtataggtctttacagaatgaagattaaatttacccttaagtttgtaaataacgaatagcattttattgagtcttttggactctttcaattgttagctatcttagagacactagttaataaaggaattccctcatcattagccatcaaaatagtccacttcccagagctgataaaaattctgtatatattaaatatagatttcatttttctgtaaacactcagttcactcatatctaatctactgataaatatagttatatatttacatatgtaaatatacatatacatatatcttagacagtagaaataaacataatcttagagagtcctttagaaggatatgctctgtaaataagcaagtaaaatagtttaaatacaacatttcatgacatttagaaatacctttatatttagatatatttaatattcctaaacgtgtagaaatgcatttggatttataaatacacatacgtaatatatgatgcttttaatttttattaacagtaagttgatataatagaggtataatattaactcagtaagtatcattttcattatcagaaacattaaaagtattttctaaaaggaggttccttccaggaatacatacactgtgtaataataaattgtaacagaaaaatttacaaatctattcattttttatttccttattttcagggccctccaggacctcctggtgctataggtccatctggtcctgctggaaaagatgtaagtttttaaaacttaaataagaatacagcaaaatttaacttggtgtattctaaacagtatatgctttatgtcagaatcccagaagaaaaaaaaatgttattcaaaatattgttgtcttaacaacattttagttaatactaatttttgagtagctatacagtatttgcgtttctatatatatcatttgttgaattccaaaataaaatccttaaagtgctttttgactgcggagaagactcatccattgaatatattatttaactggaggagaaataggtgtctctgcctgcctcttttaatgatgaaattgataccactatttaatgaacttgagaagttatagataccttcaattcaatggcattccttctttccctcttaatctccaatggcaaattcttttcactggcttatgttatttcagtgattagaagcacctgcattatctctttataagcttatatcaaagtgggaaaggtcttcctcatgccttctaccaagaaagctgatctcaactatacattttgtggaaccattttaatgagtcctttgtgagaaaaatgcaaagtaaccattttgcttattggctacaatgtattttctcatacatgagcacctacgtattctttatttctctacctagggagaatcaggtagacccggacgacctggagagcgaggattgcctggacctccagtgagtcttcagcatctaataaattaattggaataatcttagcttgaaaactattatgtaattcaatggaattaaacttaaaaacagaaagtgttttactactagattgtgattctatttgaaggttcattaatattttttcattcattatttttagggtatcaaaggtccagctgggatacctggattccctggtatgaaaggacacagagtaagtagagtttctaagttgtttacaaggtattccactgggctatgtttacttgcctaaccaattttactggacaattatgtgccaaaaaatatgattctgacaattaattaatttgatatttttaagtctactaagtttgtttgttgaccaaactagtcattttttgcaaaataaaggagttgatttctagtgtataaagtactcttgaaaaatatcgttttcttactaccactatcagaaaaataaaaacattttgtgaattatgttttttattgacttaatatgatttatagattgagttgaacaactttattctatgcaaaatatttcgtacattcaaccaactgtgcctacaacctatcaactgaattataataaaatctatgaaactcatgtttgctactctatagttaaggcaactttcttatcagactaaattgcactttctagttttcatgttttcctgttgtaaaatcagtatgaaatatcttcaacccctttaaacaagttttaaattatttaagctaattttgcaagtagtgttatgaagaccaattagaaaaataccatgtaaactttatcaatcattctagattattaacagattttaataattttgctggttttatacatttcctagggcttcgatggacgaaatggagaaaagggtgaaacaggtgctcctggattaaaggtaaatcacaacaaaaatcatattttcataagtaaattcattaaatattaaagctacatataagattcatattgtgagccttaacttgttttctgaaatttacctgaattttacctattaggtgtgaataatggtaaccaattcagatattctattaacgcttccatgaaaaatgacaacttgaagagtctagattagaaatagttgagcatcttagtataacttatcaattacttcactttagtctttaagtttttaaatacagaaattgagatttctggtaaataaaatactaacagaaaattaatattgttaaaatgtatatctttttctaggctctataaacttttccataatattctgtatttaaaaatatataatattttcttcctcttttgtaaaatagtaacatattttatatgtatctagggtgaaaatggtcttccaggcgaaaatggagctcctggacccatggtaattatgtttcttatgtataattttcagttttattattaacctcattgttacctaaaactggctttgctcccaccccaactgttcttacacatgtcaagattagagtaaaaccatatttcaattttactctgtagggtccaagaggggctcctggtgagcgaggacggccaggacttcctggggctgcagtgagtatagctgctaacatcacacaattacaacccaaagtgacagatttttacagcctcagtaaagtttcaggctgtaaaaatatgttaggaaaaagaccttcctacaaaattatactcaatgatactgtgataaagttttggctatagttaaaaggaaatgaataattgttttacaattattatctctattgagaatttttgtgttaacttttcatatgtcatttgagccattatatctgcattcagtcctgaaaacacagactccaatccttctacatttgattgttgctgtatatatcagaattgtaataattgactttaaaatacataattattaagcagattttaatgtacttgaagaaaactcaactcacttgagtcagaattttggtcaaaatattactcatgaccagccattcagaattaaaaggatatttgatgtaaacttctctttttagggtgctcggggtaatgacggtgctcgaggcagtgatggtcaaccagtaagtaactttctatctcttatgtgttgtagggtaatgagaagttatggattgtggattatttaatattttatatatgtatatactcttaggtatatatatatgcatatgtatatctctaatatacacattagcatctctgttgaccatttttacaatttaaaaagtgaaaaaatattgtagccccaatacttaatattgtatatacactcctgtgattaaaactgacactgagcccataaacaaaatctaggttctgacactcattctgcttgatcaactgctaacatttgaatggtgctcccaatgttagttaatatcctatgtaagacatggcactttaaagagtcctacaaaatggataaaatagatgttacctccattttgtagactggagtacaaaagcccagggaaaagtagcctgcactaagtcacagaattcatggcaaagtagggagaaaccaagaatttctaactttagatttcactcttttcttattttaccacattgtttctctacataatatccataaaatatgaatatcatttttatctgcataaatatcttctttactttatatgtgctcacttatttactagtatgtcagctttcatttagttgaaaaagagctcttgaaattgtatttaattttttcagggccctcctggtcctcctggaactgccggattccctggatcccctggtgctaaggtaaacatgtgtttctatagaagggtataaaaatatcttggaggcaagagaaaagcattagattgcttcttgcaactgatttttttaatcagtcaaatggatagcttttatctatacatgtctttaaagccctattcttgattctaaaagaggtgttgtccctagtattcaactatcttgatatttcttctgctaccttctttttttccccagactctttctaggaaactgataatgcaatcacacacacatagttacatttttctctgcctttacgattaatgattccttgctttacctgcagtatagagtcccactactccaacttttgggagatgtgtttaaacaggactgaagggtgaagtggctaagtgagtagaagtggtaagagaaactgactacacaaggttttaccattagggtgaagttggacctgcagggtctcctggttcaaatggtgcccctggacaaagaggagaacctggacctcagggacacgctggtgctcaaggtcctcctgtaagtatcatagttgagagggagtaagcatagtttcatgcttactccatgaaagcatagtttcatgcttactccatgaaagcatgtgcttcaatatggctatcagtgaaaattactttgaaaaaattgttgcttagtgctctaaaatgatcctcctgtgacacatactgatttgattagtagtaaaaatgatagtttttgactgttgcactattccagaattcatgattttttatgtttatataaaagaatagaggatagactagttttctgatgctttcaagaatgtgccccaagctaatcaccaatcataaaaattcagagaagaaccaaattcaaaatctcttctatttatgtatcatttaataatttatacgaagtacatattatctctaatttatttagataatgatgattcttttgaccacatttcatatgttgtgttatagttggaggattcacttaatctctacaaagcataacactcatcgatacatttattttcacacaaacaacttcaaatatatacgaactatttgcattactattaatacattatctgttttttgtatacttagggccctcctgggattaatggtagtcctggtggtaaaggcgaaatggtaagctgtccccactcctcagccttatctcatccacacattactggcttcttttgcattttgcatgacaatagatttgtgatatttaagtgagatattcataaaagaacattcaagttcggctaatatagtgtctttggtttgttcttagggtcccgctggcattcctggagctcctggactgatgggagcccggggtcctccaggaccagccggtgctaatggtgctcctggactgcgaggtggtgcagtaagttgccttgttttttctctgttgactgaaaggtatagtttaattccatcaacaaaaaattaatagcaaaattttgctcctgttcagttgaatttatattgacttcactcttgtcttataacttataactgaattatgtgttactggtgatgatttgttagtcgaatcctccctgtgtttcaaccaagactttgttatactttagggtgagcctggtaagaatggtgccaaaggagagcccggaccacgtggtgaacgcgtaagttttactgcaacagatctggttatttcttgaaaaaatgcaacataattagaaagtaaacaggtaaaaactttgaactaaattcagtcataatttctttattttaccatcttttttttttttcagggtgaggctggtattccaggtgttccaggagctaaaggcgaagatggcaaggatggatcacctggagaacctggtgcaaatgggcttccaggagctgcaggagaaagggtacgttttccatggggcatctaaaagaaaagcagcatcactgtcatctaaataaaactaccttcagggtgagacagccaatttttcttaagttgagtgttcagtgaaaatattgtttaaagcattctatgacataaaaatatttgccactcaagaattatgaaaaagaattgaaatcctttggactgaaatacttgtctttcattattttcagggtgcccctgggttccgaggacctgctggaccaaatggcatcccaggagaaaaggtagataactttagtttctatgttcctaaatgctagcaccacaaatgggcagttcttgtatacaatttctcattcatgaaaacctaaatatctgaagaatatatattagagttaagaaaaattcctaatataatgcatcctctgttcaacaactttcctggctttgtaactaaagccacttacttaccctctatgagaatcctttacttatctgttaattggaaagcatttatctgagcatcgttgcaagagtacagtaaactaaaatgcctgaaaagtctttgaaaactctaaggttacatcaaatatgatttcatagcattaagatatttgattttagctgcacataattatatttttaagcacagtgaatactgttttattaagcatgtgatgttcacaaagttgctttaaaattttttcaatatggcaatccaagctaagataactgattttatgtataaatgtttcagcaacacacgaaccctttttaaaagttcaaatgacgtcctctctttgtaaccaaaatattgttgctatctaggttagtgaaggctattttaatttttttaaaatttctttcactacttagggtcctgctggagagcgtggtgctccaggccctgcagggcccagaggagctgctggagaacctggcagagatggcgtccctggaggtccaggaatgagggtacagagaaacatttgtttgaatgacactttaatttagacagaagaaaggcaagacaaatgaagacagatcaaaagcaacttaaatcaatcagattacatattttgtaaggcaccaaacaaaacaaaattcttttaagtaaacttaagccgagatagttcaaggagaagagaagatagaacacttgccttagatactttatagacaggaaaaaagatgtgcaaatctgaggcttcacatgtaagtgaaaatatcaaaatcatacaaatagtgtatgtagtaattttttattatttcattttaaatcacctaacaactgacttctttacttcagggcatgcccggaagtccaggaggaccaggaagtgatgggaaaccagggcctcccgtatgtacatttttaaaatctcattttaaaaggccagttaaaatggaatgtatatgttggcctatccttgagtgtgtgtgtgtgtgtgtgtgtatatatatatatgtatatgtatatctatatatatacacacacacacacacacacacatactatatatatagcatgctttaatcttctctttatcaaacctttattaatgtaattttttcttattagggaagtcaaggagaaagtggtcgaccaggtcctcctgggccatctggtccccgaggtcagcctggtgtcatgggcttccccggtcctaaaggaaatgatgtgagttccttcattaatttcttcaataaatatttgactggaaggcttttattttccatatggagtaaagaaatggtcaaaactcagtctcctcttcaaagcatggaggagtatatgaaaatcaaattgcatgtaggaagggagctaaatatataattggttatggttgtatgtgtgtgtatggagcaggcagataaaaaatatgaaacaggctgggtgcgctggctcacgcctgtaatcccagcactctgggaggccaaggcaggcagatcacctgaggtcaggagttctaggccagccttgccaacatggtgaaaccctgtctccactaaaaatacaaaaattagccaggcatggtggcatgtgcctgtaatcctagctacccaggaggctgaggcaagagaatcactagaacccggggggcagaggctacagtgagccaagattgcgccactgcactccagcctgggcgacagagcaagactcagtctcaaaaatatgtatgtgtgtgtgtgtatatatatatatgagacatatatatatgagacatatatatatgagacatatatatatgagacatatatatatgagacatatatatatgagacaataatatgattagttattgccctttgaggattagtaaataccgaccacttcttctttagggtgctcctggtaagaatggagaacgaggtggccctggaggacctggccctcaggtacgtagctttcctcaatttatttctagccttctaatagatgcgttcatctccaaccttctgacttctctctgtaatctgtattatttctacttccctaactgttcttgtttttagggtcctcctggaaagaatggtgaaactggacctcagggacccccagggcctactgtaagttcactcatataaaattggagatgaaaatagggtggaggtggggcaggaagaatgcttcaaaaattacataatctctgacaccatgttgttacagtttaccaaagcaatgatgaaacttgctgacctagttatctagctaaatgctagcattgagtttagagtgtacatgtgtgctttgggtccaggtcctcccttttcttcacatcactacttttataattaagcaacaggcctgttgaaatggatactgtagactaaatataaaaggatgtttacaacagagtgtatcattatacttttctaggggcctggtggtgacaaaggagacacaggaccccctggtccacaaggattacaagtaagaacttgttatttaaatgtcacggcatatctgactgtcaaatttttttgtgtccctaatagattataatttatctgaagcttaacttgtgattctgtctttcatctggaaataaaattttaggcaatgttaataggtaggcatatcttccatgtccgttccagagcacattaataagttatttaaaagaattaatgaaactcaaataattctatttggttacacttatttttattataacataaatccatatagccaagtctatcctgccatgctggtcaatacatttttacgtgtagcaattgaaagaacagagagagatgaaaatgggtttgtaaaatatgattatcacgtatgtgtcactggattttgagtggcacaacgtttctacccctacaagaccactggaacttttttttaatatcttgcagaaacatgtgtacatatgagaagcttttctataagccatgtttgaggtaattacctaatacaaatatgattctttctagggcttgcctggtacaggtggtcctccaggagaaaatggaaaacctggggaaccagtaagttacgtttcattattcaaaactcagaaacaaaaagaatacacactgtttgtttgtcaactattaacttcttaattttcttatgccatgatatttgagatttaacatttagttttgaaatattatcaaaacaaagacaaattatttaaaagataactattatatagagtttgaattttaccataaaatagagagttcatagtttcaagatttgaaaaattatacagtatgccaacatgacaaatgtgtattttgcttatatttacatatttgcttatatttacatatttgcttatatttacataaaatgcactctgatatgggcctaatcatataatgccaatctcccagggtccaaagggtgatgccggtgcacctggagctccaggaggcaaggtagtatttcaatttattctctaccttcttcagcaggttatagagcaattgattagtagtatatttttagtatatcaagccaaaatactctttctttaaaagagcatcattgcaaatgtttggtaagtacacttagagaaactcaagacactttcaatacattaaatttgctttaatctggaaggtccaattctctgacattcataatcactacagaatcaaatacgggcttaaaatttcaaacggaaaaatattgccaatatgttgattctatgtaggaaaactgttttggtaaaaagaactttaaaatgttgctcttgtgaataaaataataagtatttcaatgacagctcacacttaaccagactaagtatccaagttttattttagacactcttttaagcttctagttcccacccagctgttcaactatttttaagtatacaaatttctagattgttcacaatataataacctagtggcctgattcaaaatgatgcaagttaaggtgctttgtttttagctttgggttgtctaatatggttatttacatatttttgtcacagggtgatgctggtgcccctggtgaacgtggacctcctggattggcaggggccccaggacttagaggtggagctggtccccctggtcccgaaggaggaaaggtaactccacagcattccattcacctaggtttaaaaaatgcatttgatttccttctgatcatttattatttctcacttattttcagggtgctgctggtcctcctgggccacctggtgctgctggtactcctggtctgcaaggaatgcctggagaaagaggaggtcttggaagtcctggtccaaagggtgacaaggtgttgacttgttttctcttaattgttcaataaatcagtcattgtaggttttaaaaaaagcaacactcctggaaagtaatcgactgtattttcaaaattaatgttatcattttatagtaagtgaaatttaagatggattcctaaagcaacaatgaattagaacacccaatatatatccctacaaatcctgagagttactcctcttcttggctgattttcactgaagatactttgaatctgatgacattggcttttatttgacagggtgaaccaggcggtccaggtgctgatggtgtcccagggaaagatggcccaagggtgagtattcccagtgaggagaagcaggccttatctatatgtcatatgggacagtcctgcacttcaactttaattttttccaaaaactactcaagagaaattagatattttaccacctaaagacccgaatgacttgatttataatgaaatttgtggtctatatctatggctacttgatagatctacagtgactaaagaatgaaaaagcctcaagagtacgataaaggtcacaaactagcatttgtgagtcactaaaatctgagataatcactgaaatttaggataatcaatgctgctcattaagaaactaaaagtcatcaaaattcaatatagtaagtactcctcattaatagacttaatatttaaaaattgtatagtatttagcaacaaaaaggaatgaacaattgatgctgtacacacagcaaattatacaaacctcaaggacaacatactcagtgaagaaaattcagtcaccaagggatacatactgcatgattccattcctacaatatttgcaaaataacttccttgtagagatgtagaacagattagtggttgctagcagttaagaatgagaaagagagagatggatgtggctatggagacatgacacaagggagtcttatggtgattgcacatttgagtatcttgattgaggtggtagtcaggcacatctacacatgggataaaattctatagagctacatatacacacacataaatgagtgtgtgtatcactggtgaaatctgaacatgctctatggatggtatcaatgtcaatttcctagttttgatattatattatagttgtgtaagatgttaacattaggggacgctgggagaaaagtgcacagaatttccctgtatattcctttgcagcatcctatgaatctataattcaaactaaaagtcaaaaacaaaacaaaaaacatctcctaaatatgattataattaagtcttttaataaatttatataatagttgccttaaagaaattcataaatgcttcgcttttgacagactaagtagataagccgtcattcaggtaaaaagagtgctcaatacttcagttttgtaatataagtaaaactactatttgaaaatttcaagttgaaaaatttaatatgtacaatgagactttgagaaaacatttaaattatcaagcaattgaataaagaaatgtactttaatttaaaaagacattactgtaagatcttacatgacatcctatttatcttctacaatggagataaagataaatgaatcaataaactattgctgaatcctattttctcccagagttatccccaaagaggcttgtgtttactgagctctgcagtatttacacattgagagaaaagcatagcattcaagccataaaaatttttaaaaagtatgttatctagtttattaggtatctatgtctatatactttctgtttgattaatgcaaaaaacgatatttgtatcttcaaaattaaaaaatatttttatttcctctagggtcctactggtcctattggtcctcctggcccagctggccagcctggagataaggtaacccttaatactacctggatataaaaagaaaatgtctctctcttttggatgcaagacagtgacatggcttctctttttccagggtgaaggtggtgcccccggacttccaggtatagctggacctcgtggtagccctgtaagtgttaaagacattctcaacatactttttaaccccatacagacagtagctacttatgcttccctttttggcagttttgccctcagttccctgagcctcaatttggagatattatcttcaaaaaccatataaggaaccatatagcatgcaagggaatgttaaatttcttaaatctaacattcacaggagaccattttaaatcaggatttctttcctaaataactttggaaaaaatacatgaattgcacaagtagtacatgtttgtaattaggtatttcttaagcctatagaatctttgcctgagactccttctagatttaaaagtcttgaccttcaggatttaagactctggaaagatatttagtaaatggtttttaaaaataaatcagttaatttttcagttaagcttctaccatatattgaaatacataaatatctatatatataaatgtgttaaatactttaaaattctcaaactatttttcttgcaaataatatcacagtaggaggcagaaggaatcaatggttctggtattttccactcctaattttattgagaagtggcaaagtcttcagaagtttattggctactctgcacatttcctgcttaaaggaaagaaaagataagatgataagatgacatttcctgcctaaaggagatgacgcacacttcactgtgactaaggaggatatttttctcttcagggtgagagaggtgaaactggccctccaggacctgctggtttccctggtgctcctgtaagtgtgaatatttatacatacatgtcccatagcccaggatctctatcttgctgaaaaattacaaaagtatagtcaagtttggtttctagtctcattttagctgctcattccctataggattattgtacccctattttgttttactttacccctattgtcgctctttgaaagatggaaataaaaacacctgtcctgcttttatgactgggtaatgaactaaagcagtatcatggatttaaaagcactctgaatttttgtaaattcttccattataagatggtactaattaaaattttctcttaaatccggtctttctcaaaaaaatttactggtgctgattttcaaatgtttaatccttagagacacttcctccctccctaatggcaaataatgcacagtttatgctttcttggtcatgttctttgatcatgaaaatattttgattggcttcattttgtcatgtcttcagaaagccttgtttttaaattttatttcaactccttccatctgaagaattctatattctgaagagaaataataataagccaattgtatcataaagagtgtcagctgagagattgctgttgttgttgcatgtagggacagaatggtgaacctggtggtaaaggagaaagaggggctccgggtgagaaaggtgaaggaggccctcctggagttgcaggaccccctggaggttctggacctgctgtaagttccttcctctttctctgtctatctatctatcatctatctatctattgattatctgtctatctctccctctctctctccctctcccccctctgtaagtcctaagtgttctaatggaaaaacatggaggtttatcagtaatttaatattttatactgagatagcatgtcatagtgtcaagaatataatctttatatgaatatagtccaagtatgaatctcagcaccagcaatctaaaagttattttaacctcttcatagagttcctggttttcaaaggcttaatgcttttcccaaattttgattttggtgctattcttacataatttccttccatttcatatagggtcctcctggtccccaaggtgtcaaaggtgaacgtggcagtcctggtggacctgtaagtattgatcctcttaactattattgaaaagcattaattgatatcaacctgtataaaagctgcatttgagacactagttccataaagagaatgtaaaaattgtaatcgctcattcatacatgagttatatgtaaattccaaggggaaacacaaaccataaatgactttcaggtacaatgcagatcatgccacacattatactttttgtttgttgtacagttatttgttctacttttgaaattcaaaaatatattaccatttcacagggtgctgctggcttccctggtgctcgtggtcttcctggtcctcctggtagtaatgtaagtaattgttaaagtcttttctcatcatacacttcagaaagagcattcatgtatgtataggatgagaaacttacacattgctacttatttctctagtaagtctcaaataaaattatttgaagtaagtaaaaaaagaaagaaaaaatgcactttttattataaatattcaaatttcaaacaattatttgtagggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccagtaagtaacttcatttttttaaattgattctactattttgatttttatcacaaatcgattagagaaaaacactgtcacataaagatgagctaagtcttcattatctgtattagggagctccaggcccacttgggattgctgggatcactggagcacggggtcttgcaggaccaccaggcatgccaggtcctaggggaagccctggccctcagggtgtcaaggtgagtatagtcattttccactacactcttccttcctttggtagccttcagagatcacttaaccatatcaaggatgaaaagtttttctgtcactggagtaaattagccaggagataatttttttttatttttagatttttaaaagcataaattttaataaatggctccagaacacaaaacagggcatatcatagacaaaccttgaatataaacacaaataaattaatatgatgaaaacaatattgccatctcaaacacctcttttaggaaacttgtgaatattcttcaatttgttgactgtcagttttgaagggggaaatagtgttagcttatagatcttggaaagtctttcattaatgctagttatccatccattcaagtcatcttgcactcctgactctctttcactagtattatattcctataacattctagtgcttagcatctaaaacattcgtttggtaaacaggataataaaattgcatttttattagggctcgtattatggcactttaagtacttctttcaacaaaatgttatgtaatattgtcataaaattaatatttcatatttaagtgtgttcaattgatatgatatttctggtaagtgtatattcttcagatagagacaaataacctaattttaaggatcaccatacacctctagtttcatgatggctcattattgtttttccctatactaatcatgtttatgtattcatctcagattacaatgtacagtattctgaattagataatcaatgtaactattcagccctttgccatccagagtcactgagcaagttagaaaatgcaagaagcttgctcccccatattttttcccatagcaggcatagttttaattttaaaattcaatgaagattaaataaaataagttttttacctgaaaataaagatatctgataacaccattttaattgatttcttaagttgaaacaaaatgtttttcattcctttgtatacagggtgaaagtgggaaaccaggagctaacggtctcagtggagaacgtggtccccctggaccccagggtcttcctggtctggctggtacagctggtgaacctggaagagatgtgagtagcagtttttattcaaccagccaggtagaatttgataatttatttcagcaaaggtgaaattgagctttaatgtctaagagtgtaaatatggccacatagcaaagttcttctatctctaataacagaaattctttcattacaatttaggatagacttaaaagctcttgttcattagtatttacccaatgaataatcatttgtggagaaaatattatctctaactaaattaggaaaaaagttagtggggagaaccacaattgacatgttttctgagtgaaaatattctacggttatctatggttagtcttttattatttttaaagaatttaaaattaatattatttataattaacaaatcataattgtatacatttataaggtacaatgtgatgttttaatatatgtatacaatgtggaatgattaaagcaaactaattaaactgtagatttccactaacagtttagatcactatttcttaaacttttatttattagaggtctgtaaagactctttttggatatcatttttctaatcacctctcctccatgaatacactaactatctgtctggacattgtgaccctttgaagggccacactgctttgtaatatctaagatttcttacccccaagaaccaattttaacccccttgagaattatattgccctgctgagaatgcatggatgaaatggcatttggaaggtttcaagaaattttatttcctttctcattttttaatcagggaaaccctggatcagatggtcttccaggccgagatggatctcctggtggcaaggtataataaacacatgtgcaattgatttgtgttatcaaaataagtgatcatcatgtttattttgtacctatgaatttgttcacagggtgatcgtggtgaaaatggctctcctggtgcccctggcgctcctggtcatccaggcccacctggtcctgtcggtccagctggaaagagtggtgacagaggagaaagtgtgagttcccaaaagcagcatctgtcttgtttgtctatttccttcaataaagacatttgtaggtagaaggtagaatgtcagatctgccaaccaaaatatccactgtcatttgttttacagttttaatgctagttgttccttagacaaatgtgtgaataagtcaataccagaagtacttggcagtagtcaataaagaattcattactgaaacccgaaatcatattaatcagaccaactatctatatgctgggtaaatgcaaggccaagttaacagggctcttgcccaacttttctgtctagatcccctgagaaagctataaacagggctttagcactttgaaggcaaaaacaatattaacttccaataattgcatgcatactataattctattataatgaaattatttacttttgaaaacgaaattgtgtcaacacataaaactagttccgtgtatgtcttctcaattgaatgttttcatcttagggccctgctggccctgctggtgctcccggtcctgctggttcccgaggtgctcctgtaagttttgtcattttttggttttattttgttttgttctttttttaactcattctacagtgtaggaaatattttattttccagcgtgttcaggaaaaaagaatgaatatatatatatatatatatatatatatatatatatatatatatttgttctatctatagatagatgatagatagatagatagatagatagatagatagatagatagatagatagaacaaatataaactttcctttaatgacaatgatatggaaagcagttcaggatctaaaagttctttggagccaaggatagaaacatcagttgttagggatccatgcaatgatcagtccaaaatgaaaacaaccacagaaacaaatctcatttcctatctgaagtgtctgttgatgggggattttttagctgatagaaagccataaaatagatttaattattataaattctattttatttttccaatatgtatgtgtgtatatgacttcaattcaaaatatgtttctaaagggtcctcaaggcccacgtggtgacaaaggtgaaacaggtgaacgtggagctgctggcatcaaaggacatcgaggattccctggtaatccaggtgccccaggttctccagtaagtgcattcattttgttggaaaatcccttcaatgtatacaaattttagagattaagagaagaaagctttccatctctaaaaatatgtactagaagagatgagaaatggatttgaaggctaatttgaaacaacaatcagcatgacacaatgggaagattaaagaaagaaaaaaaatttcatcatgatccccatgtttcttgatctgatcttgaatgtacagtttcccagtgctttttaaggccttcactcctatgtacacttcctttctttccagggccctgctggtcagcagggtgcaatcggcagtccaggacctgcaggccccagagtaagtagcacagaaagatattacaggtccacatgtttcagatgtctgcatttcagaaagatattctggcattgtgatgtcatgatactttcttagggacctgttggacccagtggacctcctggcaaagatggaaccagtggacatccaggtcccattggaccaccagggcctcgaggtaacagaggtgaaagaggatctgaggtaagacatcacttatacgtatgtgtatttaatttgctacaatcttccaattttcagaaacacagcgcattatgtttaaattgaaatagagagacgcaatgcatccactcaatttagaaactgaacaatgactttaagacattctccatcacattaaaaatgtttctaccacactataacaggagaaaaatacctttttaaaaatttgatcaggtatccatcgtatcagaataatgacatctgcccaattaaccaaataaaccctgtccacattgctatcccactagagatctcagaattacaacattcataattatctgcgtttatgtagtgcattttacttctcaaacagcttccatggttactattttgttaatgatactatcattcctaatactttctattccatgcctttgggtaaatgaaataaaaacaattatcccaacaaattacactcccctctgtcatgtcaatattggaattgtagctcacaggtgtttgcttacatcagtcatccagaaggaagaatgatagagaaaacttgtgctctgacactactgattcttacatagtggaacaatatctttcttgataatgaattgtagttattataaatcggtgatcacgtgaccctaaaggcacccaaataaatctttagtaaaataattctgatgacacaatgaatgaattatttttaaggcattttcttggactagcaatgtattcttagagtggcgactgaatgtgcatacctcaatgatccatgttttactcattctagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggtatgtttggtagtctttcatcttcatggcaataggattacagagaaagctgcttagattagaatgggaacgaaaaaacatctactttcaatggaaagctgaaatagtactttaagaaagttaactgaattgaaactgcttgatataaaagagtaaactttgcagatgtaaaatataacataacttcagatcatgccaaatacagaaaaatataaagacatttttgtagaagttgtagtataaattgtaagttatttgagtataaagtaacatatctttttttctcaggattaaatatacataatttgatgcagacaattataatctgattattgtaatatttacttattgcaatgaatctaattattaaaattttcaaattaaacaagtgaaaaatttcagaatactgtataaaattaaatagaatattgtaatagtttaaggttttgcatatattgggttaaatatttctgaaaagcaaaattatttcaagttttcaaatatcttgacatggaacactgcctttgctaggagtcatttctagaaattacttaaaataggagacaagcatcaatcatagggatttcagctttagaactattggaacaaatctaggttagacaaccagcttatattattaagcaagattacatataataatcatctttttttaaaggagagacttttgcaaatattatacagcaatcaaaaggtcttagcttagtgtatcatccttattagaaaccaagatgttgcattttatttcagtgctttctgtagtcatagctaactcttttacctcagcaatttcaatcaaaaagcttctctatcattctatacataaaatgcagacacattagcagtcaacattatgaatgcctttacaggtaaacaaacaaaatcactttattactggattttataaccaattcccattcttttttgtgactattcaggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcaggtaggaaaggatatacctttttttaaataagtcacctctatatcctttgtattcttcctatatgttcatcacaaagcaaagttactaggttggtacaaacataattgcagtttttgctactgaaagtgatggcatgcaataaaaatattttcacacataaaatactcgtacataaaatatataaacagcccatattacaatatgcatacacatactacatgaatccctcgcgtgcagttacaactgaaatgtttgatctgttttatttgttccctattacagtttagctacggcaatcctgaacttcctgaagatgtccttgatgtgcatctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacggtaggaaacatttttctcaatataggtcataaagcagtcagcattttagtttaatcatgcaaattattttgaatagaataaataaaattaataggatgaaataaagatagcatttggtatgaattacatacattgcatctactgattcattgcagggaatgttaaatgcaacaaaatggatcttagcctccagatgaaaaccagttgaaataaaagcatttaaaatttaaatccataatgcaaactttatcagataattgggatagttactatatgttttgaataatacctgtcacattaactcagtttgaaatatctgttttttaaaattttaaaggttaacttcaaatctctcatttgttattgttatttgtgaacaaagggaaaactcacttctaatattagcgaatttcattgtgagagacctatcctctttttaataaaccatttataaacctgttagcaatggccggaaccaggcctcctgaggatgcactggtctatagcaattgccctgctgcatttactaagaatccttacaaggcatttgtttaagaatattgtttatcaactaagaagattacagctttgaagtagagcaggtctcatatacatgaataataacatggcacgatgaatgcttctttagagtaaaaaggttttctttaacttgttaagtcagagttgtctaagtaattgtaatgtcatgatcatgtacattttgtccttttttacagaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacaggggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaatatcatattaaaattc

SEQ ID NO: 35997 - DNA, 16738 bp, Homo sapiens
attttctaaaagggacagagagcaccctgctacatttcctaatcaagaagttggcgtgcagctgggagagctagactaagttggtcatgatgcagaagctactcaaatgcagtcggcttgtcctggctcttgccctcatcctggttctggaatcctcagttcaaggtaagactcaggagtcttgttccccagccatcttctctgtaagccctgtggtccatgcaagtcattatattcattttaaggcatagaatgtataatattgtgagaaaggaggcaaagaagaaggatttggggtcgctgaaccctttaatatgagttctgttaagtttggtaccaagaaaaattaaactctgtggcgtgtgcagtcttgtaaactcttacaatgattgaaatgtgctattttgggatgaaaatgtgaggtttataaattttaaaagctcaaaaaaggaatctagaaaatgactcctgtgcctgttgcatggaggagatggcacctttgactgttggggggtgtctgcctacccctaagtgtctacatcagccccaagttttagtgcgctgtgacggtgtcattgttattttaacactgggagacgttatattccaattggggtgaatctgactgtgtgtattttcttttcttttttttttttttaaagataaacttggttcttactgaaaactcaattatggttagacatagttcatgtaaaacctctcagattttaaagagaaggccaaataatttggtatttgtgctcttgctcagagaagcatcatattcggaaatatcttcctaggtttatctaccatttagtgttgtttagtcagactgaaacaacttaaaacctgtaatgactaagacaatgaaaatgataggcttgtaagaaaaatacaatttgttattctttggcaaataaggaatcatgtctaaataagacggaggtcatggcttgatagagagatggctgaacctatagtagaaaaacactaggttccgccaaatggtaagggaaatgttgagtcacaatgacacacatgtcctagatttgtttcgtcaaagcgacttttggttgtcatgatcttacttccggtggagatgaaatcttacagatgatcgcagagacattcattttatgttggaaatttataaaatcattttcttctagttatgctaatgctgaaaaaagagcaagtaatgtttctggaacgttattaatttatgtatttttaaaatataaaacattgtcaattgtagggaacaggcttcactgggatcttttagggaatatcttcagcttgatgaaataattcccgaatagccaagtggtctgacaagatcgagagtaatgaggcccatactttagtacagtcttgaatggccagatggtgctgggcataccccaaccagagatatgtaagtctttatgttgtcaaaatttcccagaaacatgaatttcccactaagattcattaaggaaaactagaatgaaaacaaaaacgttccttgtataatattcattagaaagaaatgaagaaggccgggcatggtggctcacgcctgtaatcccagcactttgagaggccaaggtaggcagatcatgaggtcaggagtttgagaccagcctggccaacatagtgaaatcccgtctctaccaaaaatacaaaaaaattagccgggcatggtggcacacacctgtcatcccagctactcaggaggctgaggcaggagaattgcttgaacctgggaggtggaggttgcagtgagctgagattgcaccactgtactacagcctaggtgacagtgcaagactctgtcagaaagaaagaaagagagagagagagaaagaaaggaaagaaagaaagagaaggaaagaaaataattcatcatgaaattgtatagaatactagcatttatgtcatgacctcgtaggtttagctctttgttagaaaaggaaaccatagaaagagacaagggagaaactgacaaactagggtgtttccgaaaaaaggctctcagtatcgggctcaagggcttgtgcccacatctgagcatgcagggaaatagatgtcccccactggctgcacatgtgagtgactgcggcacaaggctgtgatgtgaagagtcgtgacaccatttcctcacacctccacgcaatgccagatatgattcgacaacattcttcctgtcttataaaaagtgtttatctagcccgttggtttggcagatgaaatcaactaggcttttggcttgcttttactgagcatattcaaaaccatttcaggtcactatagtggtttgctcgggttgccataacaaagtaccacggactgagtggcttaaataacagaaatgtatttcctcacagttctggagatgggagtccaagatcaaggtgctggcagggtcgatcgcattctgaggcctctctccttggcttatagatggcgccttctcccttgtctgcacatggcctttcctccatgcatccgtgtcttaataccatcttcttagagggtcaccaggcattggatcagggccaccctaatggcctcatcttaactacctatatctgcaatgaccctatttctgaacaatttcacattgtgagattctgtgggttagaactggaacatatgaatttggtggtggtatatttttattataagtcaaacccaagtaaagatgtggggtaagattgtgtttaccaagcacaaagaaatggaaatttggggatgtgtaactctggagagcacagatgactaatctatttaatgtagggctccaggggatttgatgaggcctgtgaatcttccacttttattgcctctcttttccaatgacacccataaagaaaaaaaatggaatatccatgaacaggtgcagccaaggaggccaggcccgccatgtgtccactgtatactgtctcctagctcacaggaatgatactgatccactccttgtgctgctctttgtaaagtgatttcacatccattctctggtaatcatcatcacattccctgtgatgaggaattagcaccaattatagaggagaaaactggatctgacatttctcatctcatttgctctatacattaacctcttgcaaaaaatttgtgagtcttgcccaagacccattacaactaattaacggctgaactggtcgtctgatttcaaggccagaattaactttctactgcagctcatggatcagaggttttctttatttaaacaaacaaacaaaaaatcctttgaccgtagcccttgctataacgtttcccactgagttgagggagaaattgaaagtaaacttaggagctttttatagcttgtcaaaccatgcaagagtgggggaagcttatccatcttgtggaattgatagaccaggaggaagtaactccggcttagataatgctaccattttgaataaatcaaatggtcttcttttccccttcatggtagttgctgcttaagtttctctaacatgcctgcagtaagtttccattaagaataggaaattaggctcggtacagtggctcacgtctgtagtcttagcactttgggagaccgaggagtgtggatcacttgaggtcaggagttcaagaccagcctggccaacatggtgaaacccccatctctactaaaaatacaaaaattagccaggcatagtggcatgcacctgtaatcccagctactcgagaggctgaggcaggagaatcacttgaaccagggagatggaggttgcagtgagccaagatcatgccactgcactccagcctgggcgatagactgagactctgtctcaaaaaaaaaaaaaaaaaaaaaaaaaaaaagaaaaagaaaagaaaagaaaaaaaaaagaaattagtatattgtgattatgttgagggaaaagttagtaccataatataaaaaggtatggactattggagaaagttgtttgctttggtaacatttactcatagaaagtattttggtaaagcaggactcagggtggtgggggaggtgggcagtgagggataggattcaaataaaaaccattctttcccttggaatccactacacaattaaccaacaaatcccataagtggaccttttaggaagataacatttctatccatgagcatagccactataatcacaagacatttatctcaagcaagatagagtcaagatactctcacaacctcaggggctggaactgtaaattttcacatcctgccaacacccttgaatagctatgtcaagaatttagtgtctgtaacttgttctttattttaaagtacatttaacatcatcggccccaaattagataggcttttggagtgggatcccttctacttttgatttctttataaaattttaaaatagctttgttgagatagtgttcacataccatacagttcacccattaaaagtgttcaattcagtgattaggccaggtgtggtggctcatgcctgtaatcccagcattttgggaggccaaggcaagtggatcacttgaggtcaagagtttgagactagcctggccaacatggtgagaacttgtctctactaaaaatacaaaaattaactgggcatggtggtgtgcacctgtaattccagctacttgggaggctgaggcaggagaatcacttgaacctgggaggtggaggttgcagtgagctgagattgcaccactgcactccagcctggatgacggagcaagactctgtctccaaaaaaaaaaaaaaaaaagtgttcaatgttttttagtatattcacagagtcatgcaaccatcactataattgcttctagaacattttcatcatcccccaaaagaaagccttcgttacgaattttaattagctgagattctgaactctgggggaattttgtattctagaaatattttttactaatatgctacagttgtatttgtcatgctggtgaaaagatgtggtctttcacctggatgctttctcattaagcattatttttctgtttagcttcctgtgtgagcaaacattttctcagcttgatactcagtgcatcagcggcttgcagaagagactgcctaggcctgctctgtccagtacggtagccacaagtcacttgtggctactgaacacttgaaatgtggcaaggccaaattgggacaggctgtgaatgcaaaatatacaagatttggaacccttagtatgaagaaaagaatgcaaaatatcccagtaataacttttacattgatgatatgttaaaggacaatatttgaatatgttaggttaaataaaattaatttcacctgtttctttttacttttaaaaatatggccgctggaacatttaaaactccctatgtggtttgctttgtgtttctattggacaaagttggtctagacagtacaaggtgtgaagacaccgccctctgctggagaagatgctggatttttatttcacctacaggaagagacgtctaagtagcaattagatgctaaactaatgctgcctcaggaaagaatcaaaagagaaagagtgaaaccaggccgggcgcggtggctcacgcctataatctcagcactttgggaggccaaggcgaggggatcacgaggtcaggagatcgagaccttcctggctaaccccgtctctattaaaactacaaaaaattagccgggcatggtggcacgtgcctgtaattccagctagtcgggaggctgaggcaggagaatagcttaaacccaggtggcggagggtgcagtgagctgagatgtgccacagcactccagcctgggcaacagagccagactctatctcaaaataaggaaaaataaaaaagaaaagaaagaaagtccataaattgagactcctagagatactaaatggtagaatgggaatttgaatttaaatttataagatgttcactctcggagatcataggtcattgttgtcctcctccttttcatgacaggaactagcaatgaagagctctgactatgtgctaggtactactctgagaacctaacatttgtatctccttattaactctattactgccccatcctacagatgagaaaattgaggcacaggaagtttaagttggccaagatcacacagccagtaaggggcagacattgaaaggtcattttgcctgccttatccccagcctccaggcagtggcagagttagctcattttggacaaacagctctcccagaccagacattgtaagctatactcaggaatcataggaaagattatgatagaataatatatagttacaaagaaaagaaagaaaatccaatgggagaatatttactgttttctatattaaagtgtttaatgtttatgtttttagaggaatattgtttattatagcaatttagaaaacaaaatgagaaaaaaaatcaccaaagattctacctccagttatttttgtgtatttccttccatttttccccccatgtctgtttatataattgaaactattattcatgcaaagaggtattctgattttctcagttatttttatttatttttaattttgtaaataaacttttttcttctgagacagtctcgctgtgtcacccaggctgaagtgcagccgtgcaatcttggctcactgtgacctcccagtctcaagcaatcttcctgcctcagcctcctaagtagctgggactgcagatgtgtgctaccacatccagctaatttttaaaatcttttttctcttttttggtagaaatgggagtctctctatgttgcccagcctgtattgaactcctgggctcaagtgatcctcccacctcagtctcccaaagtgctgggatttcaggcatgagctaccacacccaacctaatttttatttttattttattaaaaaaaaaagtttttgcctacccgcctctcaccctctcactcatttttaagtataggtttttctacaatgccacattgtcttttccataaaaagtactttcggccgggtgtggtggctcacacctgtaatcccagcactttgggagactgaggcgggtggatcacctgaggtcaggagttcgagaccagcctggccaacatggtgaaaccccatccctactaaaaatacaaaaattagctggatatgattgtgggcacctgtcatcccagctactcgggaggctgaggcaggagaatcgcttgaacctgggaggcagaggttgcagtgagccgagattgtgccactgcatcccagccagggcaacagagcgagacttcatctcaaaaaaaaaaaaaaaaaagtacttttcttcatttggttagtattctcttatgagttgatgccttgtaatttatctgaatgttttccattattttgtggtgagctttaaaactacccttcctgactttcaagaatcctagacatgctccttcttgctaggtaattattagttgcactcattagaataaagtatatgcttggagtggggaggagatgaactttttgaagggcggtgaagtatttctcaccaccaggcctttgtctttgctaaactgaggaaggaagattttatttcattagctaacaaagaacctcctatataggccgggcatggtggctcacgcctgtaatcctcacattttcagaggccaaggtgggtggattgcctgagctcaggagtttgagaccagcttgggcaacatggcaaaaccccatctctactaaaaatactaaaaattagctgggcgtggtggtgagtgcctgtaatcccagttactccagagggtgaggcagaaaaattgcttgaacccgggaggtggaggttgccatgagccgagatcgtgacagtgcactccagcctgggcgacacagcaagactctctctcaataaaataaaataaaataaatacataaataaatctcctatataacctcataatatcagatttggagccttttccatagaaatgaaattcagaagaagctgagactcagatattccaagctgcctggtgctctgtgaatagaggagacttgttcttgtgaaatctgagtgcaaagacacaggacaaattgttatctacttttcattcctaaggatactgtatggccctaaaacacaagaactagaattctgtgataccacgggtactccacagtgtgttccttcccctttctgaacctgatttgactcatctctatgaaaagatgtgggctttggggtcagatgtgggttggaatcctagcgcctgtgtggctgcaattttcttttgtgtaaaattgagataatagtacaaaagtaacaacagttaatattatcaagtgcttactgtgtgcctggcactgtgttaaattctctaagtgtattttctcatttaatttttgtgataggcttatgacactattagtatcttcatattacagtgagggttcagagaagttaaggttccataactagtcagcagacctgggacttcactccaggcagctgattccaaagcctattctaactttaaactgctactttttggagtgttgtaagaaggacaatttatataaaatgttggcacatagtgggtgctgctgttatatgaatgggcacaaaatctgtctacattttgccttttaccaaatttagaatctatttagttaaaaccttcttagggcgggtggggtgcagttgctcattcctgtaatctcagcacactgggaggccaaggcaggaggactgcttgagcccaggtgtttgagaccagcctgggcacatagtgagacccccatctctccaaaaaacaaacaaacaaacaaaaacaaaacaaaactagctgggcgttgtggtgcccctgtattcccagctactcaagaggctggggtgggagaatggcttgagcccaggagttcaaggttgcagtgagctatgatcacagtactgcactccagcttgggcagccgactgagaccctgtctcgaaaaaaaaataaaaataaaaacttcttaggacagagtgattagaagctgtgtagtagatacttagtaacaatgtgggttcctcgggcaggttatcctacgcggagagccaggtaccaatgggtgcgctgcaatccagacagtaattctgcaaactgccttgaagaaaaaggaccaatgttcgaactacttccaggtgaatccaacaagatcccccgtctgaggactgacctttttccgtaagtggacttttctctaattaattaattaattacttatttatttgagacggagtttcacttttcttgcccaggctggagtgcaatggcgcaatcttagctcactgcaacctccgcctcctgggttcaagcgattctcctgcttcagcctctggagcagctgggatttcaggcgcctgccaccatgcccagctaatttttttttttttttttgagacggagtctcagtctgtcgctcaggctggagtgcagtggcgcaatctcggctcactgcaagctccacctcctgggttcacgccattctcccgcctcagcctcccgagtagctgggactacaggcacccgccaccacgcccggctaatttttttgtatttttagtagagacggggtttcaccttattagccaggatggtctcgatctcctgacctagtgatccgcccgccttgacctcccaaaatgctgggattacaggcgtgagccactgcgcctggcctaattttttgtattattagtagagacgggctttcatcatcttggccaggctggtctcaaactcctgacctcaggtgatccacccaccttggcctcccaaagtgttgggattacaagcatgagccactgtacccggccttttctctaattttaaagtgtctgtaatttcacaacctcttggcacagatgtgggagtgtttttcttcaagctgtccagagtgttttgcttcgagctcttgctttggtagtttggctcttactctgcagtacatggtaaaagtgtactgtatatactggcatatgacatgtgcgagtatacatgattcacctatgtttttgaaattttttttgtggatggtagagaggagcattgaggacttttcatcaacaggtattgaaaatgattgaacattgttttatttgtgtaaacagaacacactatatataaaaatccaataattaactgaatggataagcaaaatgtggtataagcatacaaaggaatattattgggtcataaaaagaatgaagtactgatacatgctacaacatagataaaccttggaaacattatgcagagtgaaggaaggccagacaccaaaagccacatattgtatgattccatttagatgaaatgtccagaataggcaaatccctagaggcagaaagtagattagtgggttacaggggctggggaaagggaggaataaggagtgactgctaatgggtatgagggttttttttggaggaggtgattaaaatgttcttctgccaggtgtggtggctcatgcctgtaatcccagcactttgggaggccgaggcgggaggattgtttgagcccaggagtttgaggccagcctgggcaacatagtgagaccctatctctatttcaaatacattttttatattaaaaaaatgttcttcaagtagttggtaattatttttaaaaatggccaggtgcagaggctcatgcctgtaatcccagcaccttgggaggctgaggtgggaggatcccttgagcccaggaggtttgggaccagcctgggccatacagcaagaccctgtctctacaaaaaatacaaaaattagctaggcatagtgatgtgcacctgtggtcccagctactcgggaggctgaggtaggagaatctcttgagcctatgttgagcctgcagtgaaccctatttatgccattgcactccagcctaggcaacagagtaagactctgtctcaaaaaaagaaaaaaaaaattagggaaaggaagaataattagccaagacttgtaaaacaaaaatcaaatctcttcttttgatcacataaaacttgctttaaacttgcaaaaaagacctgatataaattcataagtaacaaaaaattgaattatattagaaaccattaattcaatgaatactaaagctatgtaggatgtagcaaaatatacatattaagaaaaggattatcataaaagttttaatctccaggctcaaacctagaaaatcactctcctcaaagccagggttaatcatcatgctccaaaccaggtacatttcacatcactttgggatcctggcaactttctcttttgtttttttttttttttgagacagggtctcctctgtcacccaggatggagtgcagtggtgtgatcatagctcactgcagcctcgaactcctcaagtgatcttcctgcctcagcctcccaagtagcgggaccacaggcacacagcaccatgcccatctaattaaaaaaatttttttttgtagagacaggggtctctgtacatttcccaggctggtcatgtactcctaaactcaagcagtcctcccacctcagcctcccaaagtgccggaattacagtcatgagccaccattcccagcgctggtgactttctccatcactggtgactttctccatcactggtattcactgcattagtgatgacatcattacaatcttcaatatgcaactttgtagtcctactcttgcattcttactttaaagcctcagcattaagtttgaatgtaatattacagcatccttcattactttaaatcattggtttcaatagtaattcatttaaatctaaaatgttaggctgcagtggctcatgcctgtaatccccccagtttgggagactgaggtgggagaatcacttgaggccaagaatttgagaccagcctgggcaacacggcaagaccccatctctaaaaattagtggcccggcgctgtgcctcacgcctgtaatcccaacactttgggaggccgaggcggatagcttgaggtcaggagttcaagatcagcctggccaacatggcggaaacccatttctactaaaaatacaaaaattagctgggcatggtggcacgcctgtaatcccagctattgagaggccgaggcaggcagactgggaggccaaggcaggcagattgctttgagacctgcctgggtaacatggagaaatcctgtctctacagaaaaatacaaaaattagccaagcatggagaaacctcgtctctatagaaagacacaaaaactagccatgcatgcctgtggtccagctactcgaaaggctgaggtgggaggattgcttgatcctgagaggtcaaggctgaagtgagccatggtgtggcactgcactccagccagggtgacagactaaaaccttgtctcaaaataaataaacacatttaaaataaataaatacaattaaaactaaaattaaaaaataaaataaaatgttaagagaatagctcaaattctccaaaagaactcttgcacaccattcctcctcttctcaaatctctattttccttccccaaagccagtaactgcttctcaccctgaccctgtgctttctttcccgtcattgcgaaagaatggtccttgcttctgtgctgatcccaaacccttttgccctcagatcctcctgtccttccctggccctgctctgtattggctgtggggtgggggtggcggtggaactgacccctggcgtctgcatttctcaggctcccagggctgtggctgactttggccaatgggaggcaaggacgggagactgagagcttgggaggaagggagagaggtatgtttcttctccttactccctgcctgggatggcaccttgggcaggactctgttttgcccatggcctcagctcccaccagatgcctctagtccctgggctcaggaaatagacaacctccttccactatcgctgtagcccaaggagggaagtatttttttctttctttctttctttttttttttttttttacagagtctcactcttgttgcccaggctggagtgcagtggtgcgatctcagctcactgccacctctgcctcccgggttcaagtgattctcctgcctcagcctccagggtgtgccactatgcccagctaatttttgtatttttggtagagacggggttttgccatgttgaccaggctggtcttgaacttctgaccccaaatgatctgcctgcctcgtcctcccaaagtgctgggattacaggcatgagccactgtgcctggccgaaggaaatattttcttgctattgctaatctctgggttacctcgctatcccccatttagcttcacttctcctccatcacctgtatgaggaattccctctgtgttaaatatctggagaagtttcctgattggaccctggctgttgcagcttccaaggccacctctctttgtggctggtatccttttcccatgcatcttctccaggacttccattctgcagttatctctctgaactcagtgtcttcttcccatcagtataggggtggactttagtatctcctatgtttaggcaacatctctcctttgactctgcgtcttctccagtggttgcccttctctgctcctcttcacaataacacctcctgaaagggccacccatgcctgccccctcctttcctcaccccctctgtggctggacttctgttcctacactccaccctggttgacaaagtcactgattacttctctattttcagcttacttgatccttaattgccttcaaaaacagctaactgggccatgcatgtaatcccagcacttcgggaggccaaggcaggaggatcacttgagcccaggagttcaggaccagcctgcctgggcaacatagtgagaccctatctacaaaaaatagaaaaattagccgggcgttgtgactcatgcttgtggtcccagctacaaaggaagctgaggtgggaggatggcttgagtccgggagggtgaggctgcagtgagccatgatcacgccactgcactccagcctgcacaacagaaggaggccctttctgtaaaaaaaaaaatggttgaccactccttccttgaaatgcttttttcttgaggcttccatgccctgccttatcctgtttcttcctacttctctggttgtgctttttcctctgctcagtatttaacatgttggtgtgaccctggctctggcctgggcccccttctctatctacatgctttctctcgacgacctccatcggttgcatgggtttaactaccaaatctgtgattctagctccgacaccccaggctaaagtagccacctggtcactccctattacattggtcaatttcatttctctgtgccacctatgattttcctgatttatttattcacttttcattgtctgtcttccccactaaaataaaaacttcttgagaaggggcttcatcgatctgcctctgttctatcccaggccctcaaaacaaggaccagatattcaacaaatatttattgaatgcgtacatgaattaaaactctaattggttgtatgctggtggtttattattttcatggaggaaatgacttgtaggctgtgacactcagcttttgtctctgatgctttgttgccctgttctgtcaccgagggctgtcgtcattgctctggccattttgtgctctttgaatttctaatcatcacactcaacccagaaggcagccttacctttcagcactcttcagctgaatgagtgcaagttggaggcagggtcattttttgataggaaattgaatgtttatatgctggtaaatataaagcttagctttttacaaagaatttctcaaaagtgagctttgttgaagccctgtaaattgttagaacttttatggaaattttaatttaggaaaaaatgtcatctgtttgggctgacttagttgttagttgtttgtcctttcttttttttggtggagggtatggagttttgctcttgtaacccaggctggagtgcagtggcgcgatctcggctcactgcaacctccgcctcctgggttcaagcgattctctcacctcagccttccgagtagctgggattacaggcatgcaccaccacacttggctaatttttgtattttaagtagagaccgggtttcactatgttggtcaggctggtttcgaactcctgacctcaagtgatcacccaccttggcctcccaaagtgcttggattacagacatgagccaccacacccggccaagaggacttcttttaaaaatgatttcttgggccgggtgcagtggctcacacctgtaatcccagcactttgggaggtgggtggttcacaaggtcaggagtttgagatcagcctggccaatatggtgaaactccatctctactaaaaatacaaaaattagccaggcatggtggcgcacccctgttgtcccagctactcgggaggctgaggcaggagaatcacttgaacctgggaggtggaggttgcagtgagccgagatggcaccactgcactccagcctgggcaacagagcaagactctgcctccaaaaataaaaattaaaatgatttcttaagtaaatttcaaatatagaatgtatatgctagtgataacaaaattaacactgtttatgcaagtctgcaataggtagatgtgaagttgataggtgcaataagtataggcaaacacataggaacatttgacctgtttttttgttgattttaaaacattgaataattgggaagcttttaaatctcttaatttgagcaactagatggctgtatttatctccttatattaaaaaaactattataattatctttcccacatatcaaactccactggtttttttcccatttttctttcatacttcagaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctattttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaaataatgaaacacagtgaatttgtagagtgggggtatttgacatattttacagggtggagtgtactatatactattacctttgaatgtgtttgcagagctagtggatgtgtttgtctacaagtatgattgctgttacataacaccccaaattaactcccaaattaaaacacagttgtgctgtcaatacctcatactgctttacctttttttcctggatatctgtgtattttcaaatgttactatatattaaagcagaaatataaccaaaggtt

SEQ ID NO: 35998 - DNA, 125181 bp, Homo sapiens
gcagactcggggaagagggtgggggacggtcggggcgcgggggagggtgggttctgctttgcaacttctctcccagtgcgagagcgcggcggcggcagctgaagacccggccgcccagatgatgcggtggtgggggacctgccggcacgcgactccccccgggcccaaagtacgtatgcgccgacccccgctatcccgtcccttccctgaagcctccccagagggcgtgtcaggccgcccggccccgagcgcggccgagacgctgcggcaccgtttccgtgcaaccccgtagcccctttcgaagtgacacacttcacgcaactcggcccggcggcggcggcgcgggccactcacgcagctcagccgcgggaggcgccccggctcttgtggcccgcccgctgtcacccgcaggggcactggcggcgcttgccgccaaggggcagagcgagctcccgagtgggtctggagccgcggagctgggcgggggcgggaaggaggtagcgagaaaagaaactggagaaactcggtggccctcttaacgccgccccagagagaccaggtcggcccccgccgctgccgccgccaccctttttcctggggagttgggggcggggggcgaagcgcggcgcaccgggcggggcggccacgccaggggacgcgggcgtgcaggcgccgtcggggccggggtggcggggcccgcgcggagggcgtgggggcagggaccgcgggcgcccctgcagttgccaagcgtcaccaacaggttgcatcgttccccgcggccgccgcgcggcccctcgggcggggagcggccgggggtggagtgggagcgcgtgtgtgcgagtgtgtgcgcgccgtggcgccgcctccacccgctccccgctcggtcccgctcgctcgcccaggccgggctgccctttcgcgtgtccgcgctctcttccctccgccgccgcctcctccattttgcgagctcgtgtctgtgacgggagcccgagtcaccgcctgcccgtcggggacggattctgtgggtggaaggagacgccgcagccggagcggccgaagcagctgggaccgggacggggcacgcgcgcccggaacctcgacccgcggagcccggcgcggggcggagggctggcttgtcagctgggcaatgggagactttcttaaataggggctctccccccacccatggagaaaggggcggctgtttacttcctttttttagaaaaaaaaaatatatttccctcctgctccttctgcgttcacaagctaagttgtttatctcggctgcggcgggaactgcggacggtggcgggcgagcggctcctctgccagaggtaagaagcgaggcgggagggggccggggcgcgctcgctcccccgaggtgccgctgggaccggagacaactcgggggccgccgcgggagcctacaaacttttattagcctcggggagtgggggtggggggctggcaagggccgggcgacggtgacgaaagggcagcgcgcgggtgacagcgctggcctcttcctctccctccgcaggcgtcccctggccgggccgagggggaggaacctgacctcggacggcgagcggagccctgtcgaactgccgggggcttcgagcctctcattcctcgcgggaatcctggcctcttttctccccctagtgtcccctttccctccaagggggtcgcccgacacccgttttcgtggtgaacgctaagccgcgtctgaattttactcgcccgaatatttgcacgccaccccggcgcgcccgagcgcgagcccgggctccggggaggccccggcggcgcctggcttgaggagggcgtgcggggcgcgtgagggtgcacacgcggggggctgacagcccgcaacttggagactgcggccggggccggcgttatctgttagaagtgggcgtgtcggagagagaactcaacaggtctggacgtacttctcttttaacctcgcacttttttctcttctccacccccgccccgcaagggcttgctctttagcgtttgttgttaattcgcgcctgaggtttctaagtggccccttttagaaaaagaccccctgtaaccgtaatggttttgtgctgcgatttttacaagtgctagtttgacgtttggggttgcagacttgataattgcaaccttgtaataccacttaagaccctctggcatggttcattagggccaattaatgtggctgggttatttgcaacttaaactgggggataatgtcgcttgagggagcgttttcgttttaggaaatattgttttggtttcgggtttgaaggcagctgtcaaaaaagcggcatggaaattcattgggctccattcgatacctcgtgtttagagatcgttatcgcctcagataaacggggcagagaggtggggagataagcagtttaccctcaagatttgtagtggcaagtccacacccctctctctaccttcatattcacttttcagtgagggccagtgacatttatgctgcctaacgtcatcgcataggaaaagttaccttttattggacgggatttgactatagtgtcccaaatgcgcttctccgtcttagcccatctcttaaaacaccctgattaacgatatactaacagtcttactctcttgagaataggctgagaattgggataggtgaaggtttggataggtgaaggcagagaaaattattttgaacattttactggatacagttgtacctgaatttatatgaatgtgattttacggttctgtgtttttccatttttcagtacttcgatatttgtttggaaaggaaagaacttagagatgtaatagcatttcatattgaggatctcaagcaatgtaaacaaatgtagcttaatctagatgtttttgtgagttatgataagggtcagctatatttaagttatgtaagctaacaacgtagtgagaaactactacaccttctcttctgctctttaaaatctaaattttagttggcctatataaagtgtatctcatttcatatatccaaaatttggaggtaggcacatccagtcagaagtatgggttaaaaagccttttcccagcctgtcggaagataagcagatcagcattgtttatttttcaaagaaaacgtgcatggttcaccagttggttgtactcaaaggtttggatgtgtgactagctggtaggagggaaatttggaagtaattagggattgagaattctagcatagtatttatcaaatgttatatgtattggttctcagaaaagcaaacagccgtgattgaaaagaggtaggaattttaatgatcacacttcctttttttgaaattaaatactttgacatcaacttgaaccttcagaataatcagatgtaatgaattataatgtctgtgattaacaaagctacacgttcagtgagcggcaggatgaatagccaagcttagttcgatacacttttgccctcagctgtgcaaatggattgcattgtacttttaaatgtggcatgctgaatgggagcaggggacatggctttttattctggaagatagaaactactcttctggtaacaaagaatttgattcggagttaactaaaaggttcatttaacaagctgcctcttactaatcggatcaggaagataatgtgactttagagcttatgatgttttccccccgtttttgttttttgttttgtagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaaggtaagatcagtgtttttctgtttcttaagaatggtacatttaaggtagattaatagatgtaaatcttcattgatttatatgtgttctctaaagattcatgtgcttttttatatgaataagtttaagtggccttttgaaagtaggaaaggtagacaacctaagtgacatctgtacgtaaccatttcaggttttttccttaaatagtggttttcagtatcccattggccaacggtgaggattttatttaacatttttaaaataatgttgctcattaacagatatcttaacgaaaaattatataaattcaggagagtataatgtctcataatatcatattgtgttgtgcatggtcattcagctgttttagaatatgttcttatattacaataaatgatacccttacttacatagtcaaaagttgtgctgccttatttgtaaattcgttaagtgttagcttgagattaaagagttaaaagcagaagtactaacaaagagccctattcttcaaactgaatcttctgttaaagaatttgagttttgaagttgctaaagcaatgcagtgaacagtgtaccagaccatagtattagacacaggtcttgctcacagggttcttgccataaagtagacaagttatgtctgctgatcaatctctttaagagaggaattggtgtcaacatggtgcaaaacaaaattttacgttcaaatgttcctgcaagttctcaagtagataactgatggccaaaattgttaagcttcaattttcagctttcgtttgatttttctcttttttttactcagtcgtttataagcatactgatatttttgtctgacccaaaaaggtcagaaaatggaattatcagaaaaaagttctaaatgtagatatacgtgttggtaggggtgaatttctctaccccgtaacctcatccccaattcagataaatgctaggttttatatccattttagttgtgaaggaaaatataaaaatgtggattgtagtgacacaagattgattaatcagcgggtttttttaaaagaagacatggtagacagtgatttatttgtatgtaactattgaagttttttcttaaatgttagtgatattcatcgttcccattaactagttattcagatttttgaaaatcctttttctgtgaaagctatcctaacctggaggatgtctcttttctttcctctgtacttaagaagcttttcttgttagggaaataatttagaattagatttaggctatgttctgttcttctaaaaggcttagttgtcaaaaaaaaaaaaaaaaaaaccaaaaaaccttggttcttacatgtcttaatgtgaactacctcctaatctattgtttaaataattatcctttatttagaagaacactacttcaacctgagttgaaggtttaaaatcttttcagtaaggagatttgagatctttattattgcataagctgttgtgttttaaatgctaaaagacatgctgtgttttaaaattttcaattgcaaatttttggcaatagaattcgcatacttggttttcttaaaagagttaagtacggttgatttgactaagctatctgtaggaaactcttaaattgatttataaaacatgtaattatacaaagaaaaataaaacatcttaggaaactcttggggattattaatggattttgccctgataatcatcatggcatggttttcattttccttactataaagaaaaggcaagggacaaaacttattttccatttgctatgaacttttaaaccctataaaatctgggatatagagtataagtagatgaacatagttactcttaaatcactaaaggtgattttaatgctttaacttttatagtacttcatgacataaagtatctttacgtatttttaatttgggtcccataaccttatggaggtagtaggcaaggcaatgatgatgcggctctttagaagttctttaatatcaaatgaaattattatttttatgccaatctgtgattgggaaatataatcagtagtctgtgtcctaacaagaaggtataatactttatacagggtattttgttaatatttgaagattttataccttatggcattaacttagcactgggaactatgattacccaaaacaaagcttcatccaaataaattgaaacagtgtttcttttaaaccatcattgaattagtctattgtttccaaacaacagccctgatatagctaaaattagttgctttctcttctctatatgttacatgactgtagccaaacatttgctatgaccagtgaccctgagtgatcagcaaataatcaacacattgagaccacaacttgaatactgaccttctgactttacgaagaaaaatattaaatgccactaataacttgaattccttttaaattaaaaaaagttataaattgcaatttgactttttaaaatgccacctaaaattgtttttatcagaatacttaaaaaaaaatcctcactttattctctgggggtgggaagaggcaattccttccttccaccacaacattgaattatcacataaaattgtaaaattatgaatattatgattgagcttagtaaagcattttctaagttcatttatagtaaaacaagagaaaccttattctcaaaatctattctttaagtaaaacaaactagtcattctaacttaatatgcttttaaaaatactgaagttcagtacatttagcataaacttattgacgaaggcacatttctgcattatttgattttcagccttgtttcatttaagcattaatgacagaggtagagaacagaaatggttttaggtggtattagagcttttattgggattatgttgaaattttagtgttaaaaaattgttcgtatcctgaagggagggattattggagagaatgaatgatgtaggatgaacttgtaaattcagttttcggcagagtctaaaattaagtgatgattggcacttaatgaagctactaaaatttatgtagattttaatgtctcattagtaatcgcatctgtatctggttttataaaagtaatgaaattgaagacctgtacaaatacagaatgaatgaagcaaattctgctaacatcatgttgaatgttttctcagaaaaagaggaaatacgaagagaagagatttgttttgactgtgatttaccctcacccccatggatactttctttacttcctaccttttttctttttcttttccttctaaagattctggcaatgggtgtttcagtgttttttaagcttaatatttctggtactcatttatgtaaagtgatttctgaatgttaaaggagatttctttttaaatatattttcacttatttttagctttatgatgagaatcttattttttaaatctgtaacttgttatggctacatgattagtaaaaaaagtttttaaaacacactgtgtattcaggtgtgtcattttagtgtgaaatgactaatgcagaaatatgtgactagcatgtggtcagattttattgaaattacttacgatgtttctatggctagtccccttgtatttttataattggtaacataattcatatgttattttggtcttgtctatttgtgttacatgtattttagtctgaccacttttgctacttatttaatgtttatacattttatgaaagacttattctgaaatataccttgcataaatgtaggttaaatgcaaattgtattaatagtgaaatggatatgtgggtagagatcactttaggggccttttgagatttagtgaaggaaagattggatcaaaagggtttactttaatgtgactgcctaatgtgaaagtcggaacatctgcattaattggttagttacataaatcttagtctactctggcctgcaggtgactgaaacagcccaggaaatcttaatttacattaagcttagacaaggtctgaggcttaggcttagttcttaaagcacattcttttttactttaatgattattcctaattttaatgagcagtgggttctcattgtgtactagtacttaggtgggcaaattaaataagcaaaataggtttgtgctgaatagcatttacccttctgaggacatcctggtaatattttcatcaagagtaattgtgtaatgcaatatttacaggtatttgccagattaatgggcacttgttttcatatttctgagtcatggaaaatatacattgatgattcctgttgcataaagagttttcaagaaaattttgttgaattaagctataactacaaaaaaaaatccattacatattgacctttagaaaggatttttaaaagcccatgctgtccttatttctgcagcttcagagagccgactgctcttattttcttctggcatattctattaatacttgggttttgtatttttcaagtaaataaaatattcctattgagaatttcaattttaaaaaagaaaaggtctactaagtgttcctttccctgttgaattatgtgtgatcatttctatgctaaactagattagggtgtgacttgtgatggtgatttttgttcattttacatattaagaaagaaatagaattttattgcagttcaaaattatttgtagacagtggttttaacccccagacacctaattgtgacaggttgctttccttagtgctcaatactgttgtaaatgtctctaaatacagaatttccagtggagttcatgaattaattgggggtggagggtgaagagggaggagcaacagagatgtgggatgctatagataagtttaggaatatccagatcagttctgaaaactaacagtttggatcaactgtcatgaattagaggtttaagaaaagaaaaatttaggactataggtacaagggaatgcatcaatcagaattacaatttaatttcttttatttcaggtagaaatctaaaactgaccatggctatataatactaatttttgagttatgttgtttcttactatgctttattatcaaaaaaggataaaatgcacattttacttgaagattattttagctaagattaagttcatatttttctcatttttatttaagctgctgtttaataaatgaaaatctaatgacttgaatgtagtcgacctaatgtcttaatgttgatataatcatttcatatatcatagtgcccttttacagccattgtcaactgactggagagcaacccttttctttggtaatatatttctatgggttatgtatttttctgctggaatattgagaaaattaatttttcataatatgcagaataaattatggggttctgcaagtgctagacagtcacttaaaccatttatattgcaatacattccttaaattcagtattttgaatgaaagtgtgttatccccgaattttatcacttgtccaatttaaatattaattacatcccaatagagctgcatgcttaaacatgctttttcagagtaacccaagtattaatttcgagtgcttttaaatattttttctttttagcaagtttcaacaacattaatcctgtctataatgcagcaagttcagtgaaagtacctgttgttttataatttttttttcattctcactgtagggcaccaaaaatatatataaggggaaaaaagttttaatgatatgattagttgtaaatgtttacgcattatcttaccttgaatttttatttttgtaactaataatttgagagttcaataagtatgcagtgtttaagacatagtttgttgcaaaaagtgttaacttactatttctttttacaataaaattagcctttattctagttgatttcataactgtccataatatttagctgtggctattatgaaagtatatttgatagccaaattttgaaagctattatgaaatgatacaattcactacatgatttattatttcatgctggttggggcagtgctgtgacttatgaccttatgattgtcacatgctgaacactaaagctctaccagtttgttatggacactgttttactttatgttatcgttttaatgttttcttttataattattgaggataagagcttccttaattttaagactatttaaattgcagattttgcttttttatttttttaaccatcccttccaaagaatttgatttagatattcagtagtagaaacagaagaaaaatactcaactaaaagtccaaagacctagtttctaatgctaagggagacagtccatggcctccaactaggtactttggagtcaaaaatactttctttacaactgtgtttgaattgttttcaaaacacctgtgtgtgtgtttctaaaattccacaatccttttaacccgtcaatttgatgagggaagtaattagggtagggaatggtataacaaagttggttctttgacattttctttatagattatcgaatgtaagacaaatagatgtgaatgcagatttggtgtttttataagataaggatttaaaataatgtagttggtgatatataaaaataaactattgctgctgttagcacccgagaggtggggctcttgggttctcagagcttgttttctatgttcgttacagttattttagattagaacttaaaagaacttgagagtttccctaattctaccccctaattttttcgaatgagaaattgagatccatagaaagtgttgaggtaaagatcacaaaacacttaatgagcggtgttgccagtttgaatatctcaattcttagttatctaagttccctggtaggcttctttaattatctgggtctcttctagacatctggaacaaatagttgattgacataatacagactagccacatattttataagagttacttttgactcatttagatttttaaaatatacagtgtctgtattcttctctattcattttgttaatttttttttacctaataatgattaagcaccaattatgtgacagcactatgctaagcactttgcatgcattcatctcatttaaatctcaactctgtgaaagtttttattctagttactgtattaagtctcaattctgtcaatatccatgaagcacagaaggcagctgttatttaccttaattttacagatgtgaaaactaaaggcatttaaagagaaaaagaaaaaaaaaaccaggaaaccttaacacttatctgaagggaaatatttaatattgggtatgttagttcctcatgtatctttaataatttttgtcaacagcgaatctttaaataaaatataaaggatcaggcctctgctctcctgcatatatttgtaaagtcacttactgctttttgtcacagtttcaatttctgtaaaatagtgagagggtttttacctgacaggatttgtgcatgtacgtttactttgaaaattaaaaagcattaggccaggcgcggtggctcacgcctgtaatcccagcactttgggaggccgaggcgggcagatcatgaggtcaggagattgagaccatcctggctaacacggtgaaaccctgtctctactaaaaatacagaaaattagccgggcatggtggctggtgcctgtagtcccagctactcgggagcctgaggcaggagaatggtgtgaacctgggaggcggagcttgcagtgagccgaggttgcaccactgcactccagcctgggcgacagagcgagtctccgtctcaaaaaaaagaaaaaaaaaagaaaagaaaattaaaaagcattataaaaatgcaaggtggaatttttaaagctctgccaagtccacttagcttaaaccagcatgactctcattggctaagtacgttatgacatctgtgactgtggtgtaggtattgcctataatcaagaatcttttagggtctgctatgtgcaatccctgaagggtcatggatcgcagtttcataaagactgctgtattttaaagccttcaaatgccaacgtagtatcttcacaatgattttttttttcagttttattattttttgaaagcgccttcgacaaagttttcagtggattttgttgagggatattaagtatgccatctacataatagccatagtgataactccaaccacattgttatatttttattaataaatgctagagtattctctttctggtatttcctattctgatatttttatataatcaagtatgcaaagattctttgtcattggaaaccttaatttgcctgaaaatgggaatgaaattttcaggtttaaaatttttttacatttattacatttattgaagctgtctgaaaaagctcttgagtatattgaataccaaaatttatcctaactgcataaagttgggaggattgtgaaacttgactgcactgacttgttttctttattgatcaaatggttgaaaaaaacttcagttaaacaaatttgatctattaaaccaaagttataaaagcagaggaaagcatagaattattaaacggcagtttaaattggtaaacataccgatgtagaacctaagtttgtaggcagctttcttagatggaaacttaaaaaaattttaatcagaacattatgtgaaatttgtcatctggaattcagctgggtttattaaggacaaagtgtatggctataaaatagattgagttttttttttaaaacagaaaacccaaaataaatgttctaagtttccaccttaggaggctatgtatattgctcctctttgaaactgccttcagaaccaccttgtaagccataaaagaaaatcggactcattgcactatagtaacacctaactgttcttgctcaaagaaaatgtatttatcccttagctttatttgtgtgactccaaatcatatgagtattgccagatatttagaaatttaatcctctctcgaatgataacatttattttctttgagggtttttaaaagagcccacatagatatttctacagaaaatgtttaattctgttttgaatatgcctggaataagtgaatagcttcccagggtgactattctgaaatgggtgatgcttagtggttaagttctgatttgtgttttcttgaagttattaaggaactttatgataacagtttatatattccctcttcttggcatagtaatgaagtaatagagactattcacctctaagcctgattttttaaataagtgtttattttatgtttaagtaaggtaggtctgcttttggcttggacttgaatttggcaatagcagatataaagtaaacataatgtgaattcctacaacagtctcccaaacagtttaatttctcattcatacacatttcccttagtgtatcagggaattaagtatctgattatcagtatagcaagaacaactcaagtatactgaagttatttatactcataaaatagtttgagttatagctacaatataaaattaatatatttttgacttttattcctcacaacctgaaaaaaacctctgcgattactgatagtacttttaaaaactaaatgaattttgttactactatttgctaaatttagtcatgtttactgttcaaaaaatgctaggttaaaatggatcctaatctttgaaatgatgaagacatgtgtagtggtgtcaaaaataggatattcattttgtaactattctgttagtgccgaagttcttagaatttctttgtgacaacagcctgcttaagaactttagattttttagaattgtactaaaagcaaactgttttcttggatatttgttctttctccccaaaagatgatttataagttttcagagctaagaaatgggaaggaagagccatcctagcatggcaggtaatgttttactgctaacaggttttctctgcactgctttatttgccttgaacctcttactttgttctgtcagctgggaggctggtagattttctattaggtagcaaatgcttctcatcactaaacacatatcatgggctggtgttagtgcagtctgtggatgggcactacatttttaatcaagaaatgtttttaaaggaaagacaaattggtgaagtaatttctaattcagtattttagggatgagtgaccttttaattgataatgatatttaacagagctgtacagtgctttgggggtcccacagacatgtttaaacaagaaaacagtaaataaggaagccagaaggaaaagttataaaactattaagaaagaaaatgaaaattctaaacttcaattctggtgcctggctaaatttgatttttgtatgcctcagtgtttctctatggacactgggaaatcaataagcaacctagctacgttattatgttcgtaagtggaagaactaaagaactacaaagacatgttctaggccaagaattctggtggtaggtagagtgggaggttaactagatgatctccaaggtccttctaattgcacttggcagcagcaagcatttatcaagctagacactgggcatatggagatgaagaagatgaatatccccagcagcatggagagcactctgatgatagtcatccctgcctccccctccctcagtttgctttttgaaatgtgagcttgaaagatctcaaactccttcctgggaagacataactgaaacttcatggaggaaagtgcatgaatgaatgggaaacaagatttgattcaactatttggaataagaaaaggggcaacaaggagtctgaaacaaatgaaagaaaagatggaaagaattagttgactagatgaggactgagtacataggaatgagccaacaggagacttcagcaactaatggatgaaagtattatgtgcatgcatgttgtcatcaaatatcacatgatacaagacaaggagaaaacatgactttcaccataacctcagtttgtgtaccctagttgcaagatatttttttcttctagtcacttaagaatatccttattgtctaggagaaataatcctctttctgggctccccagtgtataagcccaaatctgaggaaaatttacctgaaatgttctttccccagatacccacatggtttactctctcatttaaatgtcagctctgtaaaagagatctctgactgctctatctgaaatagtagaatctttcacagtctttccttcttcttgacatcatctatttgtgtcttatctgctcacctgctacaatgtaagctccatgagagcagtgatactgtctgccttgcttactcctgtatgccagcgtctagaatagtgtctagcacatagtaagacctctacaaatacatgttgaatacctaaataaacaaaatttaacatataaaccaaaaagatatataggaatggattatatttctaatctttctcgagtgaggaaaatgtcagcagatagtgaatatcactgagagagagatgatagcccaggttatcttccccagatagaaataagccttaagactgacaggtgtatatgaatacagagagtatacataaagaagatgtattttcaattgacagtctctaaatttgctttaagacttcgaaatggattgcttttcataatttcttagaataactctggtctgtttaccattgaaaaattagagtagccaatgtttgtaaatgaagggttagagggttttttcctttggtggtttgttaaaagcttgctcaaggcagtaacatagtaaattgtcaatataggaacttttgtagcagaagctttatgcttttcacttttataagaattgagattatttaagcagatgagtctaatgtatatgtttgtactgacttacctagaaggtcaggcaagaaatcggtttcctcatttttcagataagtgtgtgtgtaatcactgagtaccttaagagaggaggggtgttttatttttgcctgaattttcaaaatatctttcttcagcttatttatattttagatttgacttattctgtctatagtatataacagtcaggaggttggtaggataagttcatctcttctactaagagttataggagagttcaacctaatatggcaatgacagtcgcagaaaagagaaaatgcaagttaagtaggtgttagccatagcaagaaaatcagatgaggtcatttaagaatgaactgctctaatgttcaggaaaaaagaggggagggacaaggacagggctctagaaggcaaccaaagagagcagccacaaaataaatgaatagctgaagaattaggagacaacaatcttaaaatgtggcagggagagggtagttgtcacattaactagcatagaagagacagaatagaataacataaatatatgagtgattattgttcttgaaaccagtctttaaaacatgggaacattcccaaaaatcaaagccagataaattagggaaatcttaaatggcacaatataactagtgatttcgtttataatttttttaaaaaggagacttaaatttgaaatttagatgtaattaaagcagataataagaaacatacttctgagaccacaaagaccctgagattcagttaagagtaaggtagaaaggctggaagccagaagggaattaagtttctgttccctgagaagccaacacaacaggaaaaaactggccacaccctagttcaaactcttattactcttatcaatagtctcctaattgtttctctagttttctcctctcccttcttaattcattctgcagtctactgccagattaatcttcctagaacaccactttcagtattattcccctgatcaaaaaatgtctgtggttttgttgctcatagcatagtggttctccttctttgtaccacagcccatatgcacgatgatagatggtgggtagccacatgaactctccataacctttggaggatttgggttatacacagtctgttatccaagaaagcatatctgagtgtaagtgagcattatagggatagtcttataattgactccttttaaaatttgttcttctttttgcaaatgccccttcagaatttacagaaatagtgtgttcattccatcagtaaaattataccccaaaatgttaataagcttatttccatcacgtctcctttcctatttctttctttcctctttcttcctgcacatctccccttatcctccacatttctctgtaattacataagcataaacagacacatatgagattttctgggttgcttgcctttaaataaaagaatgggattatcttatacccctttgtctgcagcttgcttttctcacctaacaagtacaccctgaacatccttccaggttaacagatgcggatcccattcttttaaatagacaatattctattcatgtggtttcgtgatttttgccactacaagcaagtttctaataaacacccttttctatgtaccctttacaaatagcaactttttttctaaatataaatgctatggtttggctctgtatccccacccaaatctcatcttgaattataatcctcacatatcaggggaggggcctggtgaaaggtgattgaatcctggaggcagacttctcctctgctgttctcatgatagtgagttctcatgagatctggttgcttgaaaatgtatggcacttccctcttcactcactgtctctcctgctctgccatgtgaaaacatggtttctttgccttccactgtgagtgtaagtttcctgaggcctcccagtaatgcttcctgttaagcctgtggaactatgagtcagttgaacctcttttctttgtaagttacccagtctcagttagttctttatagcactgtgaaaatggactagtacagaaacttggtaccaggacagtggggcattgctataaagatacatgaaaatgcggaagcaactttgtaactggataatgggcagaggttgcaacagtttggaggactcagaagaagacaggaagatgagggaatgtttggaacttcctagagacatgttgaatggttttgaccaaaatgctgatagttatatggacaataaagtccaggctgaggtggtctcaggtggagatgaggcacttattgggaactggagcaaagttcacttttgctttgctttagcaaatagactgacagcattttgcccctgccctagagatctgtggatctttgaacttgagagagatgatttagagttcgtggcagaagaaatttctaagtagcaaagcattcaatatgtggcctggctgctcctaacaacatacagtcatatgtgttcacaaagagatggtctgaagttggaacttaggtttaaaagagaagcagagcataaaagtttggaaaatttgcagcctgaccttgtggtagaaaagaaaaacctattttctggggagcaattcaagtgagctgcagaaatatgcatagatgaagagtagcctaatgttaatagccagtagaatagggaaaatgtttccagggcatgtcagagaccttcatggcagcccttcctatcacaggcctggaggtctaggaggaaaaaatggtttcgtgggccaggcccagggttgcgctgctctctgcagcctcaggacatggtgccctgcatcccagctgctctagctccagctgtggctaaaaggggccaggagataatcttgggctgttgcttcagagggggtaagcctcaaaccttggcagccttcatgtggtgttgggcctatgggtgtgcagaaggcaagagttgaggcttgaaagcctctgccttgatttcaggatgtatggaaatgcctggatgtccatgcattctgcaggggcagagccctcatggagatcctctgctagggcagtgcagaggagatacatggggttagagcccccacacagagaccccactggggcactgcctagtggagccgtgagaagagggataccatcctccagactccagagtggtagatccactgacagctttcaccatgtgcctggaaaagctgtaggcactcaatgctagcctgtgaaagcagctgcagggtctgtacccagcagagccaccagggcagagctgtccaaggccttgggagctcaccccttgtgtcagcgtggcttggacatgagacgtggagtcaaaggagatcattttggatttttaagatttaatgactgtcctgcaggtttttggacatgcatggggcctgtagcctctttgtcttaaccaatttctctagtttggaatgggggaatttacccaatgcctgtatcccaattttttcttggaagtaactagtttttgattttacagtctcataagcagagtggacttgccttgacccaagaagactttgtacttggacttttgagttaatgctggaaggagttaagacttccggggactattgagaatgcaagattgtgttttgaaatgtaagaacatgagatttaggaggggccgggggcagaataatatggcttggctgtgtgtccccacccaaatctcaatcacttgtaatccccacatgtcaggggaggggcctagtgggaggtgactgaatcacaagggtggacttccctcttgttgttctcatgatcgtgagttctcatgagacctggttgtttgaaagtgtgtggcacttcccccttctctctctgtctcctcctctgccatgtgaacatgtgcttgcttctccttcaacttccaccaggattctaagtttcctgaggcctctcagtcatgcttcctttgaagcctgtggaactgtaagtcaattaagtctctgttcttcataaattatccagacacaggtagttctttattgcagtgtgaaaacggaataatacaatagatttccccaaagttgggttcctgagtcaggggtatgtgtatttaaaattttaacagatatttccaaattacttttttcgaggattatggcaagtcacagttccccctggcagtgtttatacttttctttataataaaaatacataaatcattattactaacaaattccttgccatgagtcctaaattgataacaacataccagtgtgccatataacatagctgaggactgttgcagtctagaattcaggctccttctctctgcttttaacaatatgtgtaatgttcaagaccaatttagtgccacttattttgtatgctttcctttatgtagtccaggccatagccccccacctcatctgatggtatcctctggcagccacagaccacacagttctttctacctaaattagtcattagcacatagtaggtacccagtaaatgtttgttgaattaatactgtttatatatttctaatttatctccaagtaaatccagtctccttaaggacaaggaacgttttcactataacacctagcacttaaggtactcaatttaggtagggctgtttgaacaaagaaccacagaggaagcaaatagcatggccttgcctttaatacatatattttactttctcttagggaaaactggaactgtaagaatctagtaacaataataagaacagcacttttattgagcagttactatatgtgaggcacagttcaaactgcagaggatacaacagtggacaaagctttagttgtttctgcctttctgaagcttatggtttatgggtgttacattcaagacatttgtaggacacattctaaaatgccatccaatttcaggctctttccagcagaaactgtggaatatttttccgttcattcagcatttacttagtgcctgctctgccaggaattgaagagaaagcccaaagacaggcagaccttacctgagaggtagtgaactgaccaggatgactgtgggcagtagacttgtttcccaaactagcctcaccatttctgtatttgcatatacgaggaaaggattagatatagggattcatgtcagcatacaccccagggacatttgtttttagtgaaaggtgccagtcttcatccctgtacccagtacacaaaccacgaagaagtatgctcccgtcattgtcaaagaatcatagaattccaaatggagctagttttgatatccagatctcacttcatatgaggaaactaggtccagtattgtgagtaagaattaggactcttcagattccctgggtatgaatctgactaacaactgtgtgaacttgaccaaattcataaccctgtaaactctgtttcctcacttttaaaatgggcacaacaaagtgatgcatgtaaactgcatagcacagtgtctggcacttaaaaagcactcctgaagttatttttagtgatgtgttttaagattagacaactccttaatgccaaaggtttttacttgagaactctgtctgttgtgccatactacacgctgttcataagataagcctttttcattaattgatctcaaactggcttcattatgatcttaactttatttcagttttatttttaaaatttatttttaatttttatgggtatatagtaggcatatatatttatggggtacaggtcatgttttaatgcaagcatgcaattgtgggggtgatatataattgactggggtgagatatctcattgtagttttgatttgcatttctctgatgattaaggatgttgaacatttcttcatacacctgttggccatttgtatgtcttttgagaaatgtctattcagatcttttgtccattttttaagttggattgtttgattttttcctgttgtctgaactctttatatattctagttattaatcccttctcagatgggtagcttgcaaatattttcttccattttgtgggttgcttctttgttgtttccgttgctgtgcagaagttttttagcttgatgtgatcccatttgtccatttttgcattggttgcctgtgcatttgaggtattactaaagaaatctttgcccataccagtgtcctggagagcttcccaaatgttttcttttagtatcctagtttcaggtcttagatttagggctttagtccatttttatttgatttttatatgtggtgagagataggggtctagtttcattctgcctatggatatccagttttcccagcaccatttattgaagagactgtcctttccctagtgtatgttcttggcacctttgctgaaaatgagttcactgtaggtgtatgaatttgtttctgggttctctaggtctgtgtatctgtttttatgctagaactatgttgtttgggttattatagttttgtagcataatttgaagtcagataatgtaattcctccagttttattttttttgttcaggatggctttggctattccggggcttttgtggttccatataaatcctatgattttttttttctatttctgtgaagaatgtcattgatatttattaataaagattgcattgaatctgtagattgctttgggtagtatggacattttaacaatattgattcttccaatccatgagcatggactatctttctttttttgtgtgtcctcttcaatatttttcctcagtgttttattgttttcattgtagagctctttcacttctttcgttgagtttattcctaggtgttttattttatctgtagctattgtaaatgagattactttctgatttcttttttagattgtcctctgttggcatctagaaatgccacagatttttgtatgttgattttgtatcctgtaactgtactgaatttatctgttctaatatttttttggtggagtctttaggcttttccaataagatcatacagtctgcaaacaagaataatttgacttcttccattccattttggattccctttatatctttctcttgtctgattactctaggtaggtcttccagtacttccagttgaataacagtgggcactcttgtcttgttgtagatcttagaagaaaggctttcagtttttccccattcagtatgatactagctgtcagtttgttgcagatggcataactttcaaactaattgattatagttaggaagtggatactttaacttgtggtaccattatcagatttatatttcggccataagcttgaagaggagctgaaaaatgcatatgtgatgcatatgcttcctatttggctctcttctcccacccccctgccctataatccacacaagttcctctctcagtcactcatcaactacttgaacctctgaggaacttggggttaaggtaaattagaataaaactgtctgaagaagagcaagcctttcatgtcttgagaaattcttggggttttagaaataacttcattgctttttttctccagttactttggcttcttcttaaagagaatactaacactttgaacgtcataatactaaggttctgcctcttcaaataaagactttaaaaaaaaatggtttttgtatgattcagtgtgaattaaatcccacagtgtaaaggactttactttcttaatgtagattttcaaatacacaattactgatgtttataagtagatttattacaccaaagcacctagcaaattcttgaatggatcaggtcttatttttcagtcttactttgcaaatttaagtcaaataattaaggatttgttaaatatttgtcttaatatcaagcttttgcatatcggggccctcttttataagctttataagcaatcttttgttttctctgcttgctcaaagtagctatgtttgttgtatctgttagtatttgctctataacaaacatactgggtgccttcccacttagatttggcaattatcactcctgtaaatgagatattacataagataggaaaaagaacagtatctttccaagaagaatagtatccttccatattaacagtttagagctgactgcttttaaaatttagtggctttaaaataacaaccatttattattcttcatgagtctacaaatgaggtgggcagttctgctgatctggccaagctgaacttatctcagctgggcacattcagcgtatctgctgtcagttggctggttggctgtagcaatgaatggtgaaagtaggctgcccttaactttttcacacagtagcattagagttacaaaagaaccagcagaaccatgcaaaactctttaagacctaggcttggaacaactatatttctaccacattctattggtcaaagcaaatcacggggctagtctagattcaagtgggtggaggagctgcaattacactgcaaaggagtgtgactgtagggagaggtgtttttttatttttatttttttgcgatttgtcacagtagttgtaggaatcaggtgtatttaaaattctgatccttctgtgatatccgaattgttcatgaaccttgcctctggtggaaaggcagaatcattgtgacagaaggataaaatcttggaatttagagactaacaaaggttcagattccagctccatcacttatttctgcaatcctgcagaagttaatcttcctgataggcattcagtaatgattgattcacctgaacctcagattctttatgtattttaaagaaagggctaggtaaatgcaaagcacttatgtaactgcttttattattgcaaacctggctcccacactccattcaaggtgtaagactcagtgtcttccttgaattaaaaaggaagagaaagtgtgttagggaaaggaagagaaatatttgactaattgtggccccaataaagtgaccactcactgggggtattttcctgtaagaaaagaatggttgaggctcagagttaagagatacaaatccaaaagtctccttggggtaggattccctgtgattcatgggttgagaggtgtaacattagacacagtcccagtctagattttttttttaaagaattgtagtccatcctatacacactgggtgccttaatactatatgtggcaattatcactcctataaatcaggttttacataagataggaaaaagaacagtatcattccacattaacaattgaaagatgactgcttttaaaaaattaaaagggccatatagaaataaaatcacataaatttcttgtgttaaacatagttgtcatattggatgaggactaaacacctaaattcatccaactagtagtaatagaaaagatgaaacacacacacagtaaaactagattaatttaatttatacaaagggccagatatctcagaattcagacagtcagagatgttgactagagttaatgcctcttttaggagaggtaccaggtaagtgttctcaaagaactggaaactgagaccaccacctctggcattatctatttgtgaacacaagcaagtctgaatttttccgcaccatagctacctttcatgtaagcttcttttcttagaagaaaagaaggtaacatttgggtgtaattttttattaagggtgaaatttagtgtagagagtaaaggcatttggcatagaagcccttagttttttttgtttttaagttgaactgccagcctttatggattgcagtcttcgctgttttgattgacatttcccaattcattttgtattatttatttttttaagagacagggtctcactctgttacccaggctggagtgcaatggggcaaacttggatcactgcagccttgaactcctgggctcaagcaatcctcccacctcagcctcccaagtagcttggactataggtgtgcaccaccatccttggctaattttttaaatcttttgtagagacagggtagtgctctgttgcccaggctggtctcacattcctggcctcagttgatgctctggtctcagccttccaaaatgctgggattacaagtgtgagccactgcacctggcccccaatttcatcctttacaaagactactttcaaccataaatcaacggaaacttcagctccctcagacatatttgggatccaaggatattttcccaaatgattaatgctaatttcatatcaatacatttttgcaaaacctacaaaaatggactagtaaagaaagactcttaatttgggaaagacagttacttggagagaagagaaacttaagaggcaggtcgagttcagtgttcagaaatgagaggatcataaagagatagccataaaaatgtttctccctatattgcctgctgatagggtgtatcagtgaaggtcttactaaggaccttgtaccttttcagcgctgcactgcgtgctcatagggaggaaagataaatcatgtgttttttctgacctcaaaggagcctgtatctggctagagagacatgatgcagacacatgaaataattaagaaacaattaactgtagcaggtgctgaagaatataccaggaggtcagagaatggtagagctagtgtgggcgaaggtatagcccagagcatcatcagatgattcttccttatgcaaattcacatctcctctgggtcaagtatcatcctggcatgcagcagctccataggtaatgccctaaggctagcctgaggcaagttgcaaaagccatcatattgagtcatggcctttttttgtgtggggggaggggaatggcatccccttcctgtctgccaaatcaaggaatacagtgccctcctaaacctgctttgttttagtggattgttaaaaagaagtgaatgaatttatgcttcattagggaaaggttacagtggaatactgaggagtaaggggtatttctatttaacaaatgacataacttgaaggaatgaaatcataaggatggaatttcaggcattaataaaaagctgatgagagatactttgagacaaaagagccttcccagtgtaaccgagatcacagcacctacttcacatacacaggaaaccagtcctatctgtctctcccatagagcagtagctgccttgtttttcctccctcctccatcattcattctaaatctccagtcctccaccgcaccttatccaaaccctgatacccttaagtcacagatggtgaatcagtcaaaagtagtattaaaaactagtggtacacagctacacctggaatgcagtaagaaaaatacggatttctgtacatcatcttccctccctgctcttacccccatttaagagttacagggtcagaacccaagagtctgagtttttgaaagtccctaaaaattttggatgatcacctacatttagaaccactgcactaagaaggacaacaaatatgccaataaattctgttgccaaggaggtgattatgcaagctggaaccctgataacatgaggagaatcccacaatagccaaatagtccatgtactagttacattataataaagccaaaagcagcaggcctacctgactttctcctgaggtctatcatgagcttagagagaaggaacgtggacatatagaggtagctctagatggagaagggcactaggtgtcatggaaagaatcatgtgcaagaagtaaagaggtgctctgaatgtcctagccctgcttaggtgtctgtgtcctcacatgagaatttatccacagttctttcccgctgtaacaatctttggttccaactgcatttgtgagacagcaaaaagctatggtccagtctccttccattgtatcatctcatcaatgtatttctcccactacccttgtgtgaaatacaaacttttttggcttattgtgattatgcaaggtgtatgccaactttttttttttctccacatctttcagctttctgatgggtaaaaattttccttattttgctttagaaaaattctcattggcatagatctaatttcagggagcctcccttgaaagctaaataacattgagaattcatgaaaatataatgtagagcattatgcctgttagcatattagtttaaatagaagtggttcatgaaaatttttgaaatgccagaccctgtcctgtgttttgtattctcccaaatactcatccagatactgttcagaatgtaacatgattattttgaaataaagattttcccctagtttttaaaaaagttactttatacattaacccttatgttcctctttgatcaatttttccagtagtgtaaacagtcttcagggaagtagatttcttacagaaattgtcaagtggctctctgctgttagcatggttactaatcttttggttacttttcatattttttatactttctggaagtggacaacttacttgtaaataaaagtgcataatttgtattaaaaatttttagtaacaatctaatttgtaaaatagatgtgagcagcatgaatgtgtgtgatatgcgtacatacgaattatgtctcttaaaaatgtatcacagacatctttccgtgtccaaacaaatctacctcattctttctaatagccatatgggtataccataatatatttaactaggcccctattaaaagaattttgactcttttgtagctactatagtgttgcagtgtgtatctgtgtatgtatctttgtgtgtgtatctttgtacgagtgtacatatattttccccttggctatttcagatttttttttaggtttaaatcttaggaaaggttttgaaattgtcttaagtattttcagaagcattaaatcatggtttttttacatttttcttttagaagttttatgtcatctctatgagtagctttcagtaatttgttctgcataaaattcccgaaaacttccatttaaaaataggtggcatgactagactttctcagccgaaagagtgaggtcccaggaaggattttggagaagctgtgttcaaatatagctgctgacctgatgtctgcctagagtctggcaaggtgatgtgttgaatctagtgtctgcctgcatgccagcatccctttactgatgagatttgtggttttcatcacttcatggtaatcatcccaagttataagatggagtctctagaaaatcagtagagtatgaaggcccaagtaaaatacatgtgagtgcatgtatgtgtgcatacaaattacttctcttaaaaacgtatcctgggcatttaaagaatgaggacctccgaaggattttgtggaagctgtgttcaagtacagctgctgagcgtatgtcagcctggagcctggcaaggtgaagtgttgaatctagtgtctttttgactcactgttttttttgactcactgtgctttgaagcccttgtcatttgggctcataaaatagatttctgtatactgtctctcctccctgccctcgcccccatttaaaagtatagtggcagaacccaagaatcagagttactaaaaactctctagaaaatttggatgatcacccacctgatcatgtcttttttactcactatgttttttttttttttgagacagagtctcgctctgtcgcccaggctggagtgcagtggcatgatcttggctcactgcaagctccgcctccctggttcacgccattctcctgcctcagcctcccatgtagctgggactacagggcctgccaccgcgcccggctaattttttgtatttttagtagagtcggggtttcactgtgttagccaggatggtcccgatctcctgacctcgtgatccacccgcctcggcctcccaaagtgctgggattacaggcgtgagccaccacacccggccctttactcactatgtttttaagcccttgttttcatttgctccactgtaaaacattccccaagccaatctggagctgaggcaaatttttaacaatttaaaatctggggaatataaatattggataatgatcatcctgaaaaaacaatgaaggtagtagcataatactttatatatcaataaaatggcaaaataagacagttgttgaaggacagaaagagtaactgaagttaggagcttatcttaacacattttttgtgtcataccataggcatcatattttttaaattttttttatttcatacacataggaaaatatatgtgtgtaagaaataataaacacctctttgtacctaccacccaacttaaggaacagctcattgctattccctttggtgctcgctggatgccctttcccagtcacatccccctcccttcccatctgcaggactatactagtaaattttgtattttttgcattattttgctttgttttatgattttactacctatctacatatccctaaataatacattatttagtttcatatgttttaactttatgttgtggaatcacattaaatgtagtcttttttttttatattatactttaagttctagggtacatgtgcacaacgtgcaggtttgttacgtaggtatacatgcgccatgttggtttgctgcacccatcaactcgtcatttacactgggtatttctcctaatgctatccctcccctagccccccaccccccgataaatgtagtctttataacttgtttttttaactcaacattgtttgtaagattcatccatgtaagctgaagcttttttatagagatctttgttaagccttttaatgaatacagtacatacatttctctgttcccctgttagtggacacttggattgtttccagagttttgctgttttgaacaacgctgctgtgaaaatgtctcctgaaacacatttataagagtttttttttccccaagggaattatacctagaaattgaataactagatcacaaggcatacacatctacaacttctgctaggtaatgccaaattgtttccaaggagcgttagaagtgttctcatcaacttttactagtgctagtcttttacatttgtggcagtatggtgggtgtgaaatatttatgtttagtttttcttggtgccatttaataatttttataaaaaatatttagaagtcaaggcagttttttgtttttgtttttattttttgcttgttttgttttaatgcagacattgagattacgacttggaataaacattggttgcaaagttcctaaaaggaaaactttttttggtattctggagcttttctggtactgaataaaataagtatgttaaattatgcatgtgtagtttagaagtcagagcaataattgtgattgttgaacagaatggcagtaaaaagtttctaaacgattgtactgtacaagggacacttgttgtgggtcagttttagcctccccaacttttatgttaaaagttgcaacaaggtttaagggcttatgtttgataggccagatggtgaccagctgtgataaaacacagggaacccttgcaaaggatttcaaaatttatgcagtagtccgccttatctgcagttttgctttccaaggtttcagttacccgcagtcaactgtgttctgaaaatattaagtgaaaaattacagaaataaagaatcgaagagttttaaattttatgcttcccacccatcccacctgggatgtgaatcattcctttgttcagcatctccatgctgtaggtgctgcctgccccttagtcacttggtagccatccaggttatcagattgactcttctagtattacaacacttggcttcaagtaatccttattttacttcatagtggccccaaagtgcaggagtggtgatcctggcaattcagatatgtcaaagagaagctgtaaattgcttcccttaagtgaaagatgaaaattctagacttatatataaagaaaagaaatcatatgctgagactgctaagatctatgataagaatgaatcttttatacatgaaattgtgaagaatgaaaaagaaatgcgtgctggttttgctgtcatatctcagactgcaaaagtttgcagccaatgtgtatgataagtgcttagttaaaaggaaaaaggcatttaaggtaagtatatatagtgtttggtactacctgtgatttcaggcatccattgggggtctcctgagtataaggggagactactcttttagtgttaaatgaacactaaggaacagagatggggaagaggttggagaagattagttcagcagtttgagtataggtaaacagttgtttgagaaagaagaaaaatgtgattagtattttaccttagcaatagtggcatagataatgataaattatagtcacacagaactcttagtatttacagaacgttcacatttgtgatcccatttaacaataactctgaaagaaaggtatcatctaccactgctttattgataaagatataaaaggtaagagagatgaaacatattggccaatgatacccatctggtaagagacagggatggggtgggaccccaaggctcttctcgccaagcccacggtttttttgctttatacttttttgcctcctgatcaccatggctgcagtttctactgtggacaatgtctgtcagcaagcattgatcccctgccttcagcactcttacgtcttagcaaggactggaaagaaaaagccaggagtttacagtctgctggagcaacagaaaagaatgatatgaaatatgaagagaccaaaatgatttataataaggtgctagactatgtagtaaaaatctgctttagctgtaagtcaaaagcaagagcagtcttttcagaatggaatagaaatgttggaattaaaggaattttcaaagttgtgaatttttttcaagataaacatgttttattttggtaattatggtattactaatttgataaccttcagggagccacctaatattatagaagatgtacatataatgacaaaagcaaacattttatttttaaggaccacaatctaatctaaaacaaaatttcccccttttctggtctttggttaattaaggacttatttaaatatcaaagaaagacacatagaaaacatttagtatatttctatacttttattaatgtcctccataccttacacagatacttgacttggctatggtctagataatccatgaaaatttaaaggacagattttaacaactttatgctaaattgatagatctctaggatcagattgccatcactctcagatgcgaagcttccaaccacttataggttcctgatatcttgcttttatacagacctaatttctcttcctttaaactttcttttcctcagttgctatttgattgaaatattgagtcattaaaaatttccaagtgggaatttttgtgtttcttcatctatcatgaagctgctcaaataagtaggtgtttgaataggagtagaaacagtaataggctgaagccagaccaatacagcttcagctaaatgccgaccttgctaaagtctgggaggaccggtgtggtattctacaatgtacaagtctgtagccggtgcccttaatatgttggcttcatgtctcatgactctcttctgtaaatatgcagtttaaaaaatacaagttattctgctgtagaagatacatttgcaaaattgatgtatcccctctaagtaaagttggctaaacaataaggacatatttataattaatgaatttgagaagaatgctgacgatatgcattattctttgaagttaacatttttcaggtcctaaataaacaaaaagtaggttacttctgtctggagtgtatgcaaggggtaccatcttgtccttggttcctggctgctattccaaggtgctataaagtcagctaaagagagcaatcataatacattgatagcatccctcaatgtgtttctgagctacttgagaatcttatttttgaataggtagcaggaaaccatctttgcagggcagcatgggcaaagggattggagggactattattataaagatccactgaactgcttcagtatcataatatcttaaactaaaggactggaaagagccagattccaatttaatctgctcttctatgaattcttagctgggttcatttaaaaagaaaaaacttgaagattgcaagattttgaagacatcttaaaataggtgaactccaaggtgcactttaaacttgagactgataactgaatactccttcaccttttgatctgatattgtcaaaatgaatgaggacttagtgctctagtaagtttggaacagaatgatattaatttattttctcatgattgattcttttttgctttttaatagattaaacttcaccgtagaacagtttctcaacctctggactattgacatttttgattggataattctttgctgtcagggctgttctgtgtgttgcaggatagttagcaacatccctgacaatcacaaatgttactttctgtctctatggatttgcctattctggacatttcgtataaatagaatcatatatatgtggcttcttgtacctggcttatttcacttaacatgttttcaaggttcatccatattgtagcatgtaacagcacttcattttctttttatggctgagtaatattctgttatgtggatatactaccatattttgtctatccactccttagctgatggtcttttaggttgtgtccattctttggctattataaataatgctgttaagaacattcatatacaagtttctgtgtagacatatatctttatttctcttgtgtggatacctaggagtagaattactggatcatatgataactctatgtgttaccttttgaggaactgccaaacatttttctacagtggctgtatcattttacactcccatcagcaatgtataagaattccaatttctctgtccttgcctatatttattaactgtcttttcttattagccaactgctgtggttcgaatgtttgtcccctccaaaactcatgttggaacataatccccaatgtggcagtattgagatgtgaggcctttaagaagtgcttgggtcatcagaggtctgccctcatgaataggctaatccattcatgagttaatgtactaatgggttatcactggattgggactagtggctttataagaagaggaagagaactaatctagtaagctcagccttctcactatgtgattgctgccctgtgtcaccttgggactctgcagagagtcctccagcagcaagaagttcttcatcagctgtggccccttgaccttggacttcccagcctccagaaatgtaagaaatccatttcttttttttaataaattacacagtctcacgtattcagttataccaacagaacacagactaagacaccatcctattgggtatgggtatctcattgtgttttttatttgtgtctcccaaatgactaacgatgttgaacatcttttcatctgctttttggacatttgtgtattttctttgaagaaatgtctttaacattctttgcccattttaaaattaggttgtctttttattgttgagttgtcggtgtgtgtgtgtgtgtgtgtgtgtgtgtgtgtgtatctagaatatatgtgtatgtatatatgcagatatattctaaacactagacccttatgaaatatataatttgaggacaatttctcccatttaaaaggccatcttttcacttcttgatagtgtcatttgactcacaagtttttaatttttatgaagtccaatttattttttaattctttgtttttggcactgtatctttaaaaagttgcctgatctaaggtcaaactgattttcacctatgttttcatctaagaattatagttttagctcttacatttaggcctttgatccattttgaattaatttgtgtatatggtgtgaagtagggctctaacttattcttttgtgtaatgatacctagttgtcccagcaccatttgttgaaaagattattctttccccattgaatggtcttgataccttgttgaaatcaactgaccataaatatataggcttattcctggactcacaattctatgagtctgtatgtctaatcttatgccagtaccacactgttttgattattacatctttgtacaaagttttgaaattgggaaatgtgagtcttccaactttgttcttttttaagattactttgcctatattccgtgttcgttgcaaactcatatgaattttaaatcaactctccatttctggaagaaaaaaagaggcaattgaagttcagatagggattgcattgaacctgtagatcagtttggggaatattgccatcataacaattagtaggtcttccaacccatgaatacaagacttctttccatttctgtagatatttagtttctttcattaatattttgtagttttcaatataaaagtcttgtacttcgattaaatttattcttgaatattttgggttttgatgcttttatgaatttgttttcttaatttcactttaagattgttcattgctactgattagtaatgcaactgatttttgtgtgttgatttttgtatcctgcaacctagctgaaatcattgattagcataatagagtatttaatagatttaggatttctatatataagatcatgtcatctgcaattagagataattttacttcttccctttcaatctggacattttttacttctttttcttgcctagttgccctagctagaacctccagtgcagtgttgaatagcagtggtgagaatgagcatctttgtgttggtcttcatcttgtggggaaacctttcagtttaagtgtgttgttgtggggttttcatagttgtcctttatcagattgagaatgttcctttctgttcctagtttgttgagtgttttctttttgattgttttaatcaggaaagggcattagattttgtcaaatgctttttctgcagctattgagatttttgtgtgtttttctggtcttttatggtttatcacattaattgattttcatatgtcaaacaaaccctgtgttcttgggtttcatctcacttggttatggtttataatcctttttatatacttgtagattcagtttgccagtattttgttgaggatgcttgcatttatatttataagggatattggtctgttgtagctgaccagtaagtatagtaagctgtatagtttactaagtgttccctctgttttgggggagactttgagaagaaggattgttggtaattgttctttaaacatttggtaaaattcactagtgaagccatctggggtcttctttggaagttttttgattactaacttaatgtctttacttgtttgttataagtccattcagatttttttctccttgagtcatttttgacagttggttgaggaatttgttcatttcatgtagttatctaattggttagtgtataattattcatagtattcctttataatcttatttttttgctgtaaggtcagtcataatgttcactctttcatttcggattctggtaatttaagagtcttctctccttttttttcttggtcagtctagctaaagtaaagttttgtccgttttcaggggaacagctttttttttttttttgaggcagaatttccatcttgtcacccagtctagagtgcagtggtgcaatctcggctcattgcagcctccgcttcccgggttcaagagattctcctgcctcagcttgccaagtagctgggattacaagcgcccaccaccacgcctggctaattttttatatttttagtagagacggggtttcaccatgttgggcaggctggtctcgaactcctgacctcaggtgatctgcctgccttggcctcccaaagtgctgggattacaggtgtgagctaccgtgcccaacccagctttggttatttttgttgacctactctattgtttttctcttctctatttcacttatttctacactggtctttattattttcttccttatgcttgctttggacttagttcttctttttctagtctcttaaggtggataattaagttcctgatttgaattcttacttctttgtaaggtggtcatgtactgctatgaatttccttctcagaaatgtatatgctttcactgcatcccttaagatttggtatgttgtatttttgttttcatttgtctcaaggtatagtcttctgatttccattgtgatttcttccccctctaacccgtttattatttaggaacttgttgatttccacatacctgtgaactttccagatttccttctttgttaattctcagtgtcattccattctggtccgagaacatactttgtatgatttctatcttttaaaatttatttggcttgtcttatgacctaatacattgtctatcctggaggatgtttcatgtacacttgagaagaatgtgtattctgcttttgttgggtagagtgtttgacaggtgtgttggtacatagttctgttcaaatctgtttccttgcagatttctatctagttgttctgtctattggaagtaggatattgaaatctccaactaatattgctgaattgtttattgttttcttcagttctgtcactttttgctttatatattttgaaattctattgttaggtacaagtaagtttatgattattatatcttcttgatagattgattcttttatcattatacagtgccctataagaacaatttttatcttaagtctatttgtctatattagtatagccacttcagctttcttttgtttactgtttgcatggaatattttcttcttttactttctatttgtgttcttgagtctaaggtgaatctctgtagatagcaattggatctgccaatctttgctttttatttggggagtttaaaccattgacatttaatgtaattattgatgaggaagattacttctgatattttgccatttgtttcctttattttgtgtctcttgttcttaaattcttccattactaccttctttcttttgtattacatattttctagtgtaacgattttaatttctttgtcatttcttttgttgtatgtttttagttattttcttagtggttgccacggagattttattgtcattttaacagcctaggttgggcacagtggctcatgcctgtaatcccagcactttgggagactgaggcaggaggatagcttgagtccaggagttcaagaccagcctgggcaacttactgagatactgtctctacaaaaaaatacaaaaattagccaggcatggtggtgtgtgcctgtagtcccagatgcttgagaggctgagttgggaggatagcttgagcccaggaggttgaggctgcagtgaactttgatcacaccactgcactccagcctgggtaccagggcaaaactagcccaaagaaatgaaggaaaaaaaaaatctaatttagattaatatcaactcaacttcaacagtgtataaaaactttgcctctgtatacctcttctgcttccactctgtgctgttattgtcatagattttcatctttctacactgtgtgtttatcaatgtagatttaaaaatattgcttagtagttgtctttagaatccgatacggagaaaaggagatataaacaaaagatgcatttttactgtcttgtatgtttacttatgtaattccctttcctgatgttgtatttctaaaggcaaagtagggttattgtgagtgtccttttgtttcaacctgaaagactccttttagcatgtgttggagatatgctaatgatggactctcacagtttttgttatctgggaatgtgttaatttatccttcatttttgaaggatagtgttggcaggatacagaattcttggttgacatgtaattctttcagcattatgaatatgtcatcgtactgtcttctgacctccatggtttctgataaggaatcaactgttaatcttattgaggatcacttgtttgtaatgacttgcttgtcgtgctgctttcaagattcattctttgcctttagcttttggtagtttgattgtgatgcatttaggtgtgtactttattagtctgttctacttggagtttgttgagctttgtagatgtatttcatcagatgtgtcaagttcttttgccactattttttttttaaataatctttttgcccctttccgctccttctgtcactctgattatttgtgtgttgctttgtttggtggtgtcccagaagtctctgagactctgtccagttttttcctccccattcttttttctttcacttcctcagactggatgatctcaatttgacctatcttcgagttcatggattttctcttctccaagtgacatctgtgagatgaatttttttctagagaatttttcatttcagttattctacttcaaaatttctctttggttcagttttatcattgctatctttatattattctcagtttaatgagatactgttttatactttcctttagttctttagacatagtttatgtcactgaatatatttaaaatagctgattttaagtctttttttttttatttttttggagatggagtctcgctctgtcacccaggctggagtgcagtggcacgatctcagctcactgcaagctccacctcctgggttcacgcaatgattttaagtctttgtctatgaagtctagtatctgggcttcctcaggcatagtttctgttttctttctttcttttcctgtgtacttcgtttctttgtataccttgtaattgttgttgttaactggacattttgaatattatagtgtaacaactctggcagtcagactgtctcccctccccagtatttgttgttggtgagtattgtagatgtttgtttagtgacttttcatggctaattctgtaaattttatattctttgaagattgtgggcaccctgaagtctctgtttgttagtttagtggtcacctaataattaacagagatttcattaaatgcctagaagcaaaatatcttccagtctttgcccatggcctctgtgtatgcattagggcaggccttgaactcttacccagggagtttacaaccctgccttagcctttactaccagcttctgcagagcattaaggtcaacaggtggtgagagtttggagcctactccatctttcctgagcatatacacagccctactcatgcatgtggccctctagatttccaggagtatgttggaccctttcaaagcccttacagactccccagcttttcctctcaatctttagactagtgtgttgttttcttcaacagttatctgtcaggcagcagcaaattaagagattagcataaatgttttcaactcctccacccgtcatgtgccccagggaagcactaagccagttctaagttaggcaaaataaagacaatccttttgaggtggtcttccatggagtcaccagacaggtaaaccaaataattaattacaagtctttggctggatacagtggctcacacctgtaatcccggcactttgggaggctgaggcaggtggatcacaaggtcaggagattgagaccatcctggctaacacggtgaaaccctgtctctactaaaaaatacgaaaaaataggtggctgtggtggcgggcgcctgtagtcccagctactcgggaggctgaggcaggagaatggaatgaacccaggaggtggagcttgccgtgagccgagatcacactactgcactccagcctgggtgacagagcaagactccgtctcaacaaaaaaaaaaaaaaacaagtcttcatgaaagaggtccattctgctgtctttcataccaggaatgtggaatgtggactgttattttcatggctactgctaagctaggaatcaagggatagatggggactgggtaaaacaccacagagtttgctgttcttaccaagaataagctggggaagagggttgtttttgtttttcagtaaaaattccctgggctgcttcaagccgttgattaattttcaggttccgaaaaagttcagtttgacagtttttgccctttttatttgcttttatggatatgtagaacttgagttcttttttccaccagttttgctgacattgttttaaaagcactttttgtaaaacccaaatgttgtctctctcaaggctagccaataattaaaaatactgttactcccctttgattttggaaatgaattcgtattgaccaaaattcaatactagaggtctttcaagctgttttaccatttatctaaactttagaatctaatgattcctgtacattgtctagcatactggtggtcctcaattgtcataagttcaactttggaacaaatgaactttttgtgtgcaagtttccaattgtttggaaattacattgatgccccctccatcaaactgttattcgtgggacatctaggaatttcttacagcagctgacaaatatttcaagtcagtgcctggtagtactgtccaccaggcaacagcttcagtagtagagcgatctttatctataaggcagtgtttgagcaattgtttattagtgttttcctaactactcagaagaactatcaggggttatagaggtagctcagagagttgggtgcaagtagagaaatccacccggcttgcattacacatcttatttctagagaagctttcctttgaagaaggagttctaaggtttaaaaaattaccttgaatgccacttatattgcattttaattttattttagagaaatcaatggaaagtagaaaaattaaggcactgatactagtgttaagaatgttggttaaagcttctggcaattaattttttatttccttttttaattttattaaaatttaacaattttcagtttatgctgtaatccagaccaaggtttcaatctaatgaagttaatgccagtgttgctgctacctattttgtctttagtcattcagccatgcttcctacttatactgaataagctagcttaatctaacaatcaaaaaagaaagctgttgcctaagttaagaaaaacagtttgaactgttttcaaactaaatacccagtagactctctagttgttgacaggagaatgcttaattcagaattgtcctgcagtagatcattttatctcattcctgttcttctataggatagcttatttgtttgaaattgtatttaatatgttgtgatttttgtgtgcttgtttctatttttcactggatagactcaagataaaacctggtaccctgcagtgtagctatcagtttatagcagaggaaatttacattagaacttggctgtgtatttacatgtatctaacttggaggtcactctgcttactgttgatatatcagtcatattagatgagtccctaatgagataccagaaaccccggaaacatcattaggtggaacagtgtccttaatgctttattaagtgttataggtaagacaaagcctagtactatttgtggcatcaaggttaggtgtttaaagacctgtattcttctattgtcatgttgaaattgttcccttgatgtagcaatagaaaattttagattaggcttaagttaatcagcaaacaaagataaaagtctgatactatcctaaatattttgtgtttctaaataatttaacagtgatccaattagctactcctgtagaaatgtaattgataaacttttcactctcttttaaattgccatcttgaattttacctgttttttaaagctgtctcaagtcctctctaaaaaaaggcagtcatttataaatttagaaaagcttgatagcacagaaagtcacagaaaaatgtaaacatagtttaaaactgaattgtatacaagccactagaagtacttttattaagtttacaaatattagtagagtggaactcatgcatttaatatgtttgaaacttttgatcaaatactgtgctatgaaaaacattttagataattattctttaatcatgtgtgtgtaaaatgtggctttttttgacaaccaagtagcttttctgtgtgccaaactgtgactttaaaattttaaagtactcaacagagtaaacaaaccacaaataccacttaaactgtacacatttgcacatgcatttcctataaatagtacatgggtttcaagtcttcacttttgaaattcagaaatgggttttttctccttccagtagaaataaaaacttgatttattttatttatttatttattttatttttgagacggagtctcgttctgtggcccaggctatggtgcaggagggtgatctcagctcactgcaacctctgcctcctgggttcaagtgattctcctgcctcagcctgccgagtagctgggattacaggtgcctgccaccatgcccagctaatttttgtatttttagtagagatggggtttctccatgttgggcaggctggtctcgaactcctggcctcaggtgatctgtctgtctcagccttccaaagtgctggggattacaggtgtgagccaccgcatccagctaaaaacttgatttttaaaaatccaaatcgaagacagaattgtgtattttagtacatttattagcagccttgacgctataccatatggctgtttatcatttaaacagcttgtaaaagcaaacacttcaggattcatgagtggcagaaggactgagtactttgggaaataagagagaacttttgttgaggatggttgaggaagagtccaagacaataataggcagaataagcaaaaatctagagactcattgtaggcactcaagtatgtatttgttagaatgaatggctgaacttggtatattgaggaacactgagaaagccatactgactggaagatagttcctacaagaaactggtgagacatatgttacagtctagattttggtgagccttgttaaagtttgggctttatttttatacggggagaaagtttcacaggggtttggaaatgaggcttggagctgttaatggggacacagtgaggttttagggtagtggctttcaaactgtttaaatccaaactttgatgataaccctgacataactattgtttataacttccatttcagttgtattggttttatcaaaacatcttcattgatcttactgattgcttcctatgcagattaatattataaatttgaatgtacaaaggaagctttagcagtaaaatagcaacttttatctgtcttacgtattggaggttctgcataagatttaattttttttttttttgaaatggagttttgctcttgttcacggggctggagtgcaatggtgtgatctcggctcaccacaacctctgcctcccgggtttaagtgattctcctggctcagcctcccaagtagctgggattacaggcatgtgccaccatgcccggctaattttgaattttagtagagacggggtttctccatgttggtcaggctggtctcgaactcctgacctcaggtgatccgcctgcctcagcctcccaaagtgctgggattacaggcgtgagccaccgcgcccggccaagatttaattttttaaaagaaaatattttgctaagggtttggaaactcttgttttagcaagaatggattaagactgattaaaactaaaggcaaagaggaggctcttatgtttggaattctttgctaatatttacacaatataattctctccacaaatatttaatggtaccagatattagatggttataatggcaaaagtgttcaaaggatgctatcatattcatgattcatgatcaaaatgaacattataaggctatccctcttcagaattaaatacgttactcctgtggaaaacttgcttttaatgtagaagttgtcccagagcctttcttcctttctcatgtcctcttatgtccactgctgagctaacatgggtctcactgaatgattaagaaaaaacatcttaggtggggagttctgtatatagtaaatgtttaatttattggggtggtgaacgggaagtgctgctggcaagagaggatgggaagagaaatctacccaaatccttacccgctttacagaacataaacttcctattcagtagtacacaataacttaacgatcaaggcatcttaacttttctgttttcagatgaaagaactatcgtttggcttgatcaagtatttagtatttattcgttcactcaagtgcttacgtttttttgttatctcagggttttacgttagttattaaccaaaagaactagttttagttctggaagtctaaaatatataagagaaggtgaggagtaataagagaagatgaagggagactttcggaatggcctatgaacttctagtaactataccaccttaaaatagacaaattacaatgcagttatgaagatatgtatttttcagtgaagacaactaaaatgtttgcacagaattttcttttttattgagtgttagaaattctattttggagatactaccttgcacaacataaaaagaaaaagtgagtgtggaatctaggaatctacgtggctctaggaaattttttaagtgtggaaactgaaggagagcaagagaaagggagcatggcattcccctgtttgtagttcatgaggtgggtttaaattgccttttgccaatgcagctgcacactgaggattacagaattctttttaaatgtttgtagaattatttttcacttattaggtaaaacgtgtattttttgattttctccaatttcagctttctcatgttgctatgctcaattttgtataccatatatagttttgttaaattgacaaagtggtgttttttgttcttctttttcccattggttaaaatttaaagagaaagtggaagctagaaatttatctaaaaaatgtaactttccctgtaattattaaagtatcaatctaaatttgaattttctttgtgcataatcttttttcaagctatttaccatgttgacaaacttgctttcctgtggcaaatacactagcaatacgttataaatatgtaactttcaacctatttacagttgatgcttttttagccctttggatttaaaatacaagcactgaagaggtgaggaagtaccactgctgcctcagcattatttcgaaattctgtttataaactatacaatttccaaggtcatgaatccagcacctttccaggtactaactattgggacaaagatagaatttgattttatttatttacctattgactgaagtctaacttaaatcttgcacctagtaagatcttagaaataacgtgtgtactctgacctgtaaactaatcctagtattctgtgtgtatattctttctcatttgggctcttaaaaggaaaagtaacgtacatctgatgatcattagcactgagctttttcagcaaaaagtatatgtttataaagaagtataggataatttagtaatttaataatgtgacaacatttgcgtgtgtttttttttttgagaaatacaaattgtgagaaacagaaaagtaaaagaagcagcagcagaaatatcactataggatcaaaagattgcaggaaccaaaactccaaaattattgggcataatgtactaaaaacagggcagtggaggaaagggacagtccagactagctctgagggtccaaagaaagtattaaatattgttactggagtgatttgctctgctatttgggcttgggaattaagtgaaattgttgatatactagacagatacttcccacccatttttctcttgataatcagggttcattttttctattttctatttctctggatgctccatttcttaatattaatattaatattaagctctcagtctttatgctaaaaattggttatttaaaacaatttaaatcaacttcagtctaattggcttaagttcaaatccattttaagatcgatattgtgtcctttaaaaattttatttaaaagatatttaaactgatgagaggatactacccattccactgataaactattactgtaagtttgtctattgagggctagttatttggtttaaaaatgctgagattatggaaagtggattggaatattttggagcaatattaaaaacagtatctgtaacaatttaataaacttataaattcctctttctctgttgatctatcttgaaaagacactctatgtctctaggcattccttctctgtggtgtgattggtagacagggagtaaacaacttactgtaaatgggcaccatgccagttggcttcaggcagcatcaagcttgtgactcacagtcagggttaggaaaatgccttttaacttgtttgtctctgcctcttttaaacattaaaggcacaactgtactaattattaagtatttcataaggtcttttagggcttataagatcttttaggaatggcctggaagttattagtactgtttcattgaatctgaatacctttaacatgataatgagaagtttttaaagggtggttttatagttaaacggaatttctcaaattggcttgctccttatgttgatttatttaggatcacatttgggagtttctctgccctactttcaatgtatttaatttactgaccatcactatttggggggaaaatgttatatgatatttagaaaccaagagttttggagtttttcccccattagatgtatttatttatttatttattattttttaaagacagggtcttgctctgtcacccaggctggagcacagtggcatgatcctagctcactgtattcttgaactcctgggctcagactgtcctcccacctcagcccaagtggctaagtatcaagtaagaatcacctggcaaattccaaggctgtataccagatttcctaaattagaattttggggttgggtatctgaattttagtaaagccctccaaatgtttctggtattgcttctaagaacaattgataacataatagctgtggccattataggggtattctgtcatatttagatataagcataccttgttttattgtacttcccaaatattgcgtgtttattttgttttgtttcacttacaaattgaaggtttgtggcaaccctatattaagcgagtctgtcagtgccatttttccaacagcttgtgctcattttgtgtctctgtgtcacattttggtaattctctcaatatatcaaactttttcatcatttttgtatctgttacgaccagtgatcagtgatctttgattttttctttttttttttttttttgagacggacttttgctctgtcacccaggctggagtgcagtggttcaatcttggctcacagcaacctctgcctcccaggttcaagcaatcctcctgcctcagcctccccagtagccgggcctacaggcgtgtgccaccacgcctggctaatttttgtatttttagtagagatggggattccccatgttggccaggctggtctcgaactcctgacctcaggtgatccgctcaccttggcctcccaaagtgctgggattaccgtgccagcctgatgttactattttaattgttttcaggcaccataaacctcacctgtataaggcaccgtacttaattgataaatattgcgcatgatctgactgctcttccaactggccattccctgtctgtctccctcttcctgggactctcaaatccctgagagacaataatattaaaattaagctaattaataaccctacagtggcctctaagtgttgaagtgaaagagttgcatgtctctcactttaaataaaaagctagaagtggctaaacttagtgaggaaggcacatcaaaagccaagacaggccaaaagcaaggactcttgtactaaacagctaaattgtgaatgcaaaggaaaagctcttgaaggaaataactagtgctactccagcaaacatgtgaatgatcagaaagtgaaacagccttcttgctgatacgaagaaagttttagtggtctggacagaagatcaaaccattcacaacattcctttaagccaaagcttaactctcttcaattctatgaaggctgtgagaggtgagaaagctgcagaagaaaaattggaagctagcagaggtcggttgatgaggtttagggaaagaagccagcgctgtaacataaaagtgtaaggtgaagcagcaagtgctgatacagaaactgcagcaagttatgtagaagatctagctaagattactaaataatagattttccatgtagatgaaaaagccttttgttggaagaagatgccatctaggactttcatagctagaaaggagtcaatgtctggcttcagaggacaggctgacattcttgttaggggctaatgtagttggtgactttaagttgaagccaggtctcatttaccactccaaaaatccgaagacccttaagacttatgcttaatctactctgcttgtactctagaaatgaaacaacaaagcctggatgacagcacatctgtttatagtatgcttcactgaatattttaaggccactgtaaagacctgttcaactgctcagaaaaaaatgattactttcaaaatattgctgttcattgacagtgcacctgggctcacccaagagctctaatggaattgtacaacaagatggatgttgttctcatgcctgccaacacatcatccatttgtagcccatgaatcagggagtgatttcaagtttcaaatcagtacattttgtaaggctatagctgctatagacagtgattgctctggtggacctgggcaaagtaaatcaaaaaccttctgaaaaggattggccattctagatgctattaagaatttgtgattcgcaggaggaggtcaaaggatcaacattagtagcagtttgaaagaagttgattccaacagttatagatgaatttgaggggttcaacacttcagtttaggaagtcactgcagatgtggtagaaacagcaagagaactagaattagaagtggagcccgaaaatgtgacggaattgctgcaatctcatgagaaaacgtgaatggatgaggagttgcttcttatggacaaatgagcaaataaatttttttcttgagatggaatctactcctggtgaagattctgtgaaccttgttgaaataacaacaaaggatttagagtattacataaacttaattggtaaagcagcagcatggtttgagtggattcattccagttttgaaagagtttctactgtgggtaaaatgctatcaaacagcatctcgtgctacaaagaaatcttttatgaaaagaaaagtgaaacttcattgttgtctactttaagaaattgccacagccaccccaccttcagcaaccacctctctgatcagtcagcaggcatcaacactgaagcaagaccctccacaaggaaaaagattacaactcactgaaagttcaaatgattgttagcatttttaagcaatattttaagattaaggtaaatacatttttaaagacacaatgctattgcacacttaatagactacagtatagtataaatataacttttatatgtagtgggaaaccaaaaaattcgtctgacttgctttgttgcaatattcactttattgtggtctagaaccgaacctgaaatatctcagaggtatgcctgtattaatattattttgcaagtaaaaaacccagcatataaaaaaaacgtagaatatgttgagagttcagtaatatggatgaaaatgtttttctctaactgaagaacatgataaattataattagggaaggatataaaccaagaaaatatgtctgagatagccaattcttgcagttcataatatgaaaactcattataccaatctcagtaagaatacttttaatagctgttatttctttgggatatagaatttataaagtacacagtaatcttcttatgatcaatcctaggatcactttacaaccacttaccccatattacaatgtagtaccaagacaagcagaccaaattatagaaggacaaagtttttgctaagcatattttgtcatcagcataccgcattgtgtgtgcatgcatgtgtgtgtttgtgcatgtgtgtgattgtataaaatattagaaagccaccccagaaaagttaaatgactaggaatgttgtgaagggattaagctacccctaaaattatataacaaaactctcttcatctattattaggtcatctttagaacatcttctcttaaatttgttataggtctctctcatctgtttggattaaaattggtctgaaagcctaaaatggctttttacctatataattatttcccaactagcttgtagtataggtgcaaagctatcacacttgctaggttagtgaagtatgtaaaaactaccatctttcaattaggaaccatcggatagcttctacaggattgctggggagaacctttataaagaaagttatatctttataaattttttgtcattttacttagctgagaatataaaataagttagctaataatagagtagaaatgttttctgtaacagattaatattgatcaaatgtgttattaaatgctaaaacaccattttttttctctgtaagccatgtgtttcatgccacaacacaaaagggacaattgtctgtgttttatgacagttctgttctgtcagatgctgtttgttcattttggtgaataaatgaagagagccctggacacatctttttttcctcaacaaaagaggaaaattattcttgtctgtatgtctataatcctgactctttgaatggctttaatttttttaaagtcagcatttttttataaagataggtgtttggaatgtgggcgatatggctggacagttagattgggaccaaataatggaaggctttgaacatcatgctaagaggtttgggttttactctgaaggcagtagagaaccattatgtttttaagccaggattgacttgttctaagctgtaccttagaaatattactctggcagttgtacataggatgagctgtatgttgctttgttttgtttggggagacagttctcgaagagagactacatacgaaggcagttatatgagtcattactaaaggtctggcaagaagtagtaaaagcattaactggagtggtagcagtagggaaggaaataaaaggatagatgtgggagtcatttggaaagtatgaggcaattcattgaccttacagaatcactggttttctgcttccactccattcacattgacctttccaaggttatcagtgacctgcttgtccttaaattcagtgggcactttccagtaacctactgttggcaccagccctgtgctagacaccaggatcctgtttgtaaaggcatctgccagtggtttctgtgacacaattctgtttctagttttcctccttctacttctctagcctcttggcaagttcttctttcagagtttctcagagctttgtgctaggccctcttctcattttctccttctctaagtgatcccatccttttctgttgcttcagttaccatttgtccttatgcaaaggacagccatatctactgtatctccagctcagatgtatctctttgcctcctgacccatatttccaactatctaactgggtatcttttcttggatgagttataggtctctcaaacacaacatgtccagaataattcattgacttattctaaggcctgcttcctctttctcctgtagtccctatctcaggaaatatatggtgctatcaaccccaaagcagaaatctggacataatccctaactacccttttcccctctctgtgcacataatttcagtcattaggcctcatagattggactaaataaatacctcgcaaacccttctacttatattcttaactgctcctaccttaagccaggctaccataattttgtagctggatgactgcatcatcatcttgactggctcccttgtcatcttcaatctatattctatactgcagctagagctttcaaacataaacatgtgatcagattagtcccctctttagaacaccctagggttctcactgtcctgagtacagtctaagggtttaccatggcttacagggtcttttatgatttggtgagctttttattgtataacctttctaaactgcctttacttccctctttcttggctctgtgtctttgcataatgctgttccctatacttcacctcacgtctaaccttcatctccttttcacttctcctcttcctccaaaatccagctgaatatcacattgtcatgcaggcccattcttgatctcccacgtttgggttagatatccctcttcagtaccatcaccgcaccaggtgtgtcccctatcctagcatttgcctcattgtattacaactactgtgtactcgtctctacagctcctgctagtctaaaagttttgggagagcaaaggttcatgtttgtgtttttcactgtggtataccccagtgcctagtatatgataagctctcaaaatatttgttagatgtatgaagaaatgagaaagagaacaggaagagggtaagtttcaagactaggaaacaaggctatgaaagctgcaggaaagcagcaggttaaaacctagaagaagagtttgttttaggaaatactgtgttttaaaccactataactgaagcaaaaacccaaggcctgggtgtggatagagtccactatctgataacagtggatactgatgcatggcagagttggagaggaagagagccagattccaaaacagaaggggtaaagtcttctaagaagatagattatagtaagaaggattaggggatagaaatatgagcctgttccactcatagatctcaaacatgaaatgatgagtcatcatgaagagagtaggcaattgtccagtgaagaaggggatgctaacccttcttaaccttgaatctctcaggtagaagcagttagagaaggaacagccatcatcagatagtgttgtaaggaaaatgatatccttggggaaacctgcattttggtaaagcaaagcaactaagaaagaatatactaccactgtttaacaatcgccacaaaaagacagtaggatcatctttgacccccctcatcctttctcaggaacttggaggactaagaagagagaaatctgtagaagaggcttctctctctgatcctccctccacttcagttttaccacatgtaatgcaacaataattaagaatttgtgtaaaatttcaccaggttggcatgcatggagagaaaaattattcagatgttttcctttgtcaataatacaaggagcatttgtagggaaaaatatttacaaatacagtaagacctattctctttctatatttatgggaaaattttaagttgtgcccttgtttcatgtgtgtttctatttaaagataccatacttaatatatattgttgattcattaacattgaactcatggctaacagcactataaatcatgtctgatcaaaacttatgatacatgtactttcttcgtaaggtacatcatagtcttctcgtacatgggaactctaggtagtacttcaggactatgcatagaggccattttaaacagcaaaattcccaacaaaaagcacaaaactcaaaaaatgtgccactaaatttaccatgaaaaggacacttgtttacagtttgagagctaaaacaagaaggtggcgtgtcacttcgtttgacttcagctgggaacatgcatatcagtcgactcaaattttttgctattctgtgcttatccacgaatcgataggaaagcaagtgtggatttgggggttacaaataaaatgtagcaaatgtgtaaacttgcagatgtggaatctacaagtagttagaatcaactatgttagtctgatcattaaatcagttttttaaagtactattgtaacaccttataacctgccccattcactgagtgttgtagtttatagtttcattgggcattttcagtagttttatctgaagtcacatttcaaattttgtaattgaagctccaaagtatgctaccggaaacacgagctgatgctgtgagacaaaatcaacaggtaatccaccatcacaactgtgggctagaatgctcaagaaaccttggaggcccagagagctgagatgaatactgaagaatcataggcaggtttactctgtcaagctgcctgtattttgagggtgtagtcctcaaaccaaaaagacaccaaatgaacaaactcagatggcctcactggggaacagagattgaaagctgacactggaatgtgtacttaaaaaaatgagagcccgttttggaaaggcagactgggcacagaatgtggagagctatatttgctaactgaagaaatttagactttatcctctacaaaacaaagctattggtttttgaaggttgcataaaagctgcattttagcagcatatattttggtagagctgttacctgcctgaaaacatcaatgtcatttcacacaaatgatacttatcccttggtgtttgatctaaatttctacaatgagaatgtgattttatagtctttactggggaaggaagtaggtttttcaggccgaaattcttgtgtagcaaaaattaacacttaagttagcccttggcaatctccagttctataatggtaaaatggatttcccagaaagtcactctctatccctttgaatagacattagaaataacatgtactttaagtgggatttacagaggaagggggcctttaattctttactagtgtgatgccctgtaaaaaaataactaacattagagttgaggcctagaaatagcagcactgggttaaagtctgttttcaagtgcaagtttttctttttattcgtgtgtgtgtgtgtctgtgtgtgtttcacatagaaggaggaaatgccaatttcagttcttacaaatattaatgactgcaacttataaaaatgttacagactatattcttcccttttgtaacagatgagaagattttgaaatttagtctctactttttagtttggtaagacaatttgaataaactgcaataattgcaaaagaattctgaatatttgaacatttgacattttctatgtcaaatatacatttcttgtactatataaacattctagaaaagagagacaggcagggaggaaagtgctcattaaaaagagcttcaccctctctgaaaagggatttcctttacagtgctgtgtactaaagcctgtgttgtaaatcagaaagcactgagcacacatgttgctgctttggtagcatcagaagtcgattttcattagccttataccattcactatttctgccaagcaatcttaaattataaaagaatcttatttgattttgtgattctcttgttttctgctcataaagaaaatatcctaaattgaacaatggcatgctacgtttttagtttttaagacagctaatgtgtaaaaagacatttaaagtatagttgtgttaagtttttgaagtttacagttgtttcaattttgctgctatactttgttaacatattttaggaatatttcattttagtcacaactaggatataaacattattttggtggcgatctccttgtaatcacgacgtcaaccaaatttgggaaattttgatttgttagatttataaattttacagtaacacaaaagtctaatttcctatatattttcaaggcccctatacctttgtcaaaataaagtatcaatgaaaaatgaaaaaatcataaactatgttcaggccaaactgatactgactttgttaaaaggctagatagaaatctgttttcctcttctgttacatctcctcttctggagaccactctgtgtggactgaaggtttgagatcctaggacctaggctagaacagattaggagattgtgctgtatgttaagtggcagataccatggaattctaagcctgttacgaaggaggagaagaagaggcacaatgaccctgacacagcccctgggttgaccacagcagatatctcacttgagcaagtagatatcatctcaattgcttgctgattatctctaacttgtcagtaacttactttgataacctagatttaggagtctgacagcatgcagtgtatgcctcataataatctgctgtttatgaaagtcataacattgtatgtttagcataatggtgaagagcctgccatctggaatggtctacttatttgggatccacatacagtaagctctcacttaacatcatcagtaggttcttggaaactgtgaccttaagcaaaacaacctctaatgaaaccaattttaccacaggctaattgatataaacaagagttaagttcctgtggcatatttctggtcacaaaaacatcactaaacttctaaataaagacccaaaacacttataatattaaccactgaaataaatgtgagctatatatatacatttaagaataataaaaacaaaaaataattatttacccaatttttggtgaaccagtgagtgatagtgatcatagtgatggtggatgaaatcaaggaataaatatttgcaaagtgaaaattgtaagaagcaccccctgtcaccacatagctcagaaataataattagggcaggcttgctgagcatttttaaactgcactgtttattgtcatgcatttgaatgattatcgcagactttatgaattttcattttatattaatttgtaggccaggcacagtggctcacgtctgtaatcccggcactttgggaggccaaggcaggcgggtcactggaggtcaggagttcaacaccagcctgaccaacatggggaatccccatctctactaaaaatacaaaaattagccaggtgtggtggtacacacctgtaatcccagctatttgggaggctgaggcaggagaattgcttgaacctgggaggtggaggttgcagtaagccgagattgtgcccctgcactccggcctggtgacagagctagactctgtctcaaaaaacaataataataatttgtattcattcattttccaatgtgttcattccagttcagggtccagggggcctgcagcttatactcatagctcagagcaactgaccctatagacaggacgccaccccattgtagggtgcactcaaatgcacactcacactcaaactgggacccttcagacatgccagttaccgtatcacacacagcttcgggatgtgggaggaaagcgaagtatctggagaaaaactacacagacatgggaagaacgagccaactctacacagacagtggccctggacagagctgggcaggcatcagttttttttcttttttttgtggggggtgagggtggggcatggagtctcactctgtcacccaggctggattgcagtgcagtggtgtgatctcagctcactacaacctccacctcccgggttcaagagtttctcctgcctcagcctcccaagtagctgggattacaggcgcccgccaccacacctggctaatttttgtatttttagtagagacaaggtttcaccatgttggccaagctggtctggaactcctgacctcaggtgatccacccgccttggcctcccaaagtgatgggattacaggcgtgagctaccgcgcccagtcagcatcattttttttttctcatcaacgttaaaacaatgttgaacaaaacattattcaaagacctgccgtatggctattttctagttgtgtgactttctttgggaaagttagcaaccctttctgagcttaaatgtcctcattcataaaatggggctagtaataatgcataaggtttttgtaagaattagaattaataaagtacttagaccataataactaattagtattagttgttgtctttgctattattttgatgtggtggttgtttggtttcacctgtgtactatcaggacatgctgaaataaaatttaagaattggctttataatattagaaaagcaaacttttgtacgatatgggtatgaaaaattgttgggagtctactttttctctcttacctaatttgtcttagtctttttaaagcttagattttccaaatgagccatagcaaaatataatgtttaaaaatgtttaaattctaagcactatgtcatagttaaataacttaaaggtgctacatcttatacagtccaaaaggaacataattagtaaaattctacaatttagaaaaaaaaatagctgacagtgactgatttataaaagtaaaatatcttttgttaatactaatattctttttataaattaattgatgacaaaaaattgagtgaatgagatttgcagttcatttatctatgatgctggtttatttaatctctataatttgctgtatttgaaagagcatagtgatagaggtcatgataaaatctaggcccagtgccacaactaaatccctgtaggaactctcaaggttttgatttcatctctgaatgggaataacaccttccaagaatattatgaagattaaaaagttacgtatcataaatacacacagagtaacaatactgggaatattgcaacttgtaagaaagaggaagcatatggcatattctgatggttagggatatggactctgtagctgggatgcctgaaagagaactctgactccactaatggctagttatatgaaattgtgcagataatttaacttctctgagtttgcatttttctttgtctatataatggggataataatagtacctacctcacacatagtgttaatttctattagtggttctcattaagatagtattgttgttcatccctggttgttagccatcatgtatctgagttagagagtcattgattttagaaagtcccgaggagactatcaggtcaagcaacctgcctcctgctagacaattagctttatccatgagttaccaaagagggagccgaaacccagggaagctgaaagagctgttgattgtcaccctgtgagttggtgatagaaagatatctggaatcccagtagttgcccatttcctagttctgggctctgcattgcactagaatactgtgccattctaaatatgaaaaggcagtatgaccattgtgcttgtcactttccattccctagatgctatcttatatttgtccttatgaaatttaacctgtgactttcagatcacttagaaccttggttggacagtgttttctagtgttatttagtatatttttttgtcatcttctgttgtctttgggttcccctaaaagagctatactctgggtgccaggaaacttcacacatgactgtcttctcttcctcgacttccctctctacttacctttccagctcgtagcaaatcagaagacttctctgacacctctctatgtctaaaggtcctttgatattctcacatggcggcatgaatcacagtgtattttaactggccttttccttgtatgtctcctacaatgagctgttgaagcttcatgaaaacacaatctgttttactcagggcagttataattccaattacaaagcacatttcctggctcctggctaggaactcgatcatttttcgatgcttccttgctcaggactttctgattccttcttaaaacattttggggcatctccttctcctggtttttggaaacatattctcatactgctatgaaggtttttactgacatttccaacttctcttaaattgattcagcaaatgtttttccataataaatgtcattgatatgtcatcaatatggagagcaacaacagaatgcattgagtaaactcctcccctggaggtctgagaatctagattccagttctcacagagccaccaccttggtgaccttggacagtagaccttctaagcctcagtttccttatcccttaagtggggatattaatagaacccattctcagagatgttgccaagattaaaataaccaagataattcctgtagatgatttggcatagtgcctgccacgtactaagcaagagttagcctccgtcattatagtatgatcataaaaaatgaacagactaaacgaagtaaccagaaggaaagaaattttaattcttaaaatgtaatagtttcttggtttttttttttctgtgaaacacctgcatggcacctttttgttattcatactgttttgactgtggctgtcgtagattcttgttgaaagtctgagagactgagacttgtcattttgaacatggcatcagtggaacagcttatgattcaataattgcatcatcctggacaagcaccagtagaagtgagtcaggacatgtgataaaaagacattcattttgcccctcctccctctctgtattttctttgctataaaattattgatgttaagcccatagtactaatatttcagttcaattcataataaaatttgagggcatttgaatatattatctgttgtaaattataattttatatttgaccacagagtatttgaagtgggtcttttctttccccaaaattctattttaataactaaaaaatattcttaggagaagtattatttaagaacaggtttatattaaataacatcatttcactttcaactttctggtggtcaaaaaatatgctaatactaattaggatatgatacacatgttctgttagaacagttttggcagttagaagacttctcttcttgtgtttgaaagggatgttacttggggtagttatgagccatgtatccagatgtcctgaaaggaccagtggtagatgtatttctatttttgtcttttcttttttctttctggcattctagttgctgagtgactgacttttgttttcagctcttctcacaatcaccattgttctaataactttgcttaaatagaatgtctccttttgctataagccatggggccatttaccgttaattttttaaagtactgaaatgagaacctcataaattaaagaacactcctgattctgagttagcagatcctactaagccttttgcagatggaaatttcctttaaattggtttgttttcctttaacattccattatcctattgttcattctttggagctgtgatttgtttaatatatttcaggcttcttaataaatcaagtcatgtaagttattatttggatcatttcgaaactacaacagcttatcaaacctctgaaagaagaattttgtgtttgcccacagactgaagaactgattcagttttattggctgagctaccttcattattcatatttaattcctggtactgagggtgggaggagggagaggagcagaaaagatacaactattgggtactgggcctaatatctgggtgatgaaataatatgtacaacaagcccccgtgacatgtgtttacctatttaacgaaccctcacatgtatccccaagcctaaaagtttaaaaatatatatttggtaaatcaattgatgtgttttaaaaaatatcgccttttggccgggtgtggtggcccatgtctgtaaccccagcactttgggaggccaagccgggcggatcacgaggtcaggagttcaagaccagcctggccaacatggtgaaaccctgtctctactaaaaatacaaaaaatagctgggcgtggtggcgcgcacctgtaatcccagctactcgggaggctgaggcaggggaatctcttcaacccaggaggcggaggttgcagtgagccaagattgtgccattggactccagcctgggcgacagagcgagactctgtctcaaaaaaaaaaaaaaaaaaaaaaaatcatctttaaagagataactaacccttccccagaaggcagggccaaagtctaaggttcttccaggtcctttgtattccctataaattttagagtcagcctgtcaatttctatacacacacaaaaaaagcctgctgggattatgattggtattgcattgaaattaaatcaatttgggtataagagacttcaatttggggattgagtctatattgagtcttccaatccaggaacactgtatatctctccatttagtcagatatttagtttatttcaacaatattttcagatctttagttcctttcagcaatattttctcatttttcctgtaaagctcttgcacatcttttgtcccatatctattgtgtatatgtgttttgctagttattaaattatattaatataaattttattttccaattgtttgtcgcatatatagaatgttttaaaaatattgtgtcctgtgaccatgctaaattaactaattctagtcattatgtcttcattatctttctcttgaattttcattgtcttccccttctgggactccattcatatgtaaggccatttgatactgtctctcaggtccatgaagttctgttaatttttcttcattcttctttttctctgtgttcttcaactgaatgaatgccattaataatttggtatgtaatggctcacttaaacttccttttgtttttaagatatttctactctcagctgtgtctggaatcctttagtccggagccccaccaaccctcagcctagaaggaaggaggagaaggatagggtgaaaggaaggggagagcttctagcttcaggacagagatcagaacaaacaacagagcagtcatcttggataaggaaacttccctcaaacctattacttatatcctcagaaataagaaaaataatgcatttatcaaattaaaggattttgaaaaagggaacattcagagaataaaactaaactcttgaaagttaaaaggatgataacataaatgaaaagctcagttgaaggattgaaagataaaagtaagaaaatatcccagaaataagagcaaaaagacagcaatgtaaaataggggagaagataagagaattagagaaccagcttaggagttctagaaagagaaaatgtagacaacaaaaggtaagaaatcatcaaagactggagtaggggaggtcatgctatctgtttctttttctattttttattttgagttacatttttttttactgtgaaacaagcatatgtacatgagaatgaacaaaacaaatatgcagtcatgtattgcttaacaacagagataggttctgagaaatgcatcattaggcgatgtcatcattgtgcagacatcatagagtgaacttacacaaatctgaatggtatgtcctacagtacacctggaccatatggtatagctgttgcttccaggccacaaacttacagcatgttactgtactgaacactgcaggcacctctaatacatcggtaagtatttatgtatctaaacatagaaaaggtacaataaaaatacaatataaaagaggaaaaaaatagtacacctgtataggtgcttactgtgaatagggcttccaggattggaagttgctgtgagtcattgagtagtgagtgaatgtgaaggcctaggacatttattatatgaagtctactgtagtgtaaactctgtagacttaggctacactaaatttatagaaaaattttcttcaataataaattaaccttagcctactgtaacttttttactttgtaaacttttaatttttttaacattttgactcctttttagtaacacttagcttaaaacacacacattgtacagctgtaaagaaaattttatgtccttcttctgtaagcttttttccatttttaagatgtttttatttttaaaactgttactaaaaactaatacacaaacacacacattaacctaggcctatacaaagtcagtgtcatcagtgttcaaccttcacatgttatcccactggaaggccttcaggggcaataacaaacacagagctgtcgttttctgtgataacagtgcctttttctgatatacctactgaaagacctggctgagagtgtttgacagttaacaaaaaaaaaaaaggacaagaagtacactctaaaataatgaaaaaagtataatacagtaaatacataaaccaccaacatagtcatttattatcattatcgagtattatgtactgtacacagttgtatttgctgtacttttctataactggtagcacggtaggtttgtttataccagcatcaccacaaacataagcatggtgttgtattacaatgcacagctgcagctaagtgataggactttttcagctccattataattttatgggaccatcactataaatgctgtccatcattgactgaaatttatgtcgtgcatgaccatacatacaatttaatgaaaaataataataataaagctagcagtgtgtaattaccaaccagggcaagaaatagaatattgccaataccttggaggcctccagtatgaccatataagtttacaaatcctattttgttcctcctccccagaggtaaccactgccctgacaaatgtgatcgttgttttcttgtttttcttactacctatataaacatccttaaacaatataactcagtttgtatattttgaattccatgttaatagaatatcatatgtatatgaattttatgtgaatagaatattatatatgtcattttgcatcttgcttttttcattcaacattgtaggattcattcatgttgtagtgtacagctgtcgtttattcattgctgtatagaattatatcctcagagataagatatatggatgtttataaatcattccactattatgaacatttgactagtttgtagtttttatttaaccaaaaaaatgctgctgccaacattcttacacattttactgtatatgcacattaatttatttacaagtataaatttctttttgaatacatatctattgatggagttgctacatcataggacattcttgtctttgactttactggataataccaaactgtcttccaaaatgattacatccttaaactcaggacacatcttattgtcaaatgtttaatttttgtcagtctgatgggtatgtaagttattttattgtcgttttaatttgcatttccctgattactaattaagctgagtaacttttcatatgtttattggccatttggagttcctgtattgtaaagtataagtttttttgtccatttttctagttttctgtccttttagttgaaatccaaatttgcctaaatctgttattctctgagcacaagtaacttgggatgctttcctttagatttagcctaattctttatcattttgtcagcttgatggtgcttttaaggagatatatatgtgtgtgtgcgcacacatgtgcgtgtgtgtatatatatatatgtatatgtatgtatgtattttttgagacagggtctcactctgtcacccaggctggagtgcagcggcacagtcttggctcactgcagcctccacctcctgggttcaagcttttccctgtctcagcaacccgagtagctaggattacaggtatgccaccatacccgctaatttttgtatttaatagaaacagggtttcgccatgttgacaggctggacttgaactcctcacttgaactcctcacgtcaagtgatctgcctgctttagcctcccaaagtgctgggattacaggcatgagctaccgcgcctggcctggatattttttaaaaatattttttatctagcactttggtttttggcaggcaggttggcactcatagtctgacctaccatttctataaaaagaaacctgtaaatgttcttaaacagactttgaaccagtcttcctgattttgaacccctacctttacccccagtttttgagcctttcagaattttttttcataataattaggttgcttcttagctttccccactggtgacttaacagatcttaggaagccaacaatccttgtccatctgctttctgtcttgtgaactgttgctggtattgtctcttctctttattcttagaggtgtatgcttttaaaaacatatactgggtttgagagggagctgaaataaaagcatgtgttaaatataccatctttaaccagaactacatttgactggtcattttattttcaagctcacatacacttcaaacagagatatggctaaaggaattatcatgtgaacaacagccagggctctgaacatcacagattatatcatcatacttgaaatatttgaaattttgattcaaaatgagagctttatagctatgtcctcaatggactaagtgtttaagtacttaacatccaaaacattcttactaatcaagagaagacaaacaccccaacagagaaataggcaaattttatcaatagccagttcaccagatttgttttctgttagaagcgaatatggggaaatacatgtgtccatgttttgcctacttttcctggagcaggtaaggagaggcagtttaaggatccatgtgataaaccctaaagttgtccatcggctttccagtcccttctaggaatttaacttagggaaataatcagacatttgcaaaggtgtgtacagtggtatttataatagtgaaaaaccaaagaatgaccaataacgggagaatggaagttacagccaaatactttacaactactaaagaatcatgtaaaatatctattgacataggagttttatcaaaatgtgaagtatacagatgaatagtaccacacataaaaagcaaggtgcaaattagccatttatattgttatccccaaaataaatagatgcagtttttttaaaagatgcaggctatatatggaagtgtttgctggttttctgtcaaaagaatggcgactttattttctaatttaaactttttgctgttttctaaattgtctaaatagttatagtttttataatgtaaaagtatcttccaatttagcttcatttgacaaattaccttttcattctatctagctatgtaattctaaatgaatttacagcagtaatcttagagcagatgaatttacaacaataatcttagagtagactacggattagatgtaaaaacatgagttgggctttatggttacagagagttttcctcagtgtggggatcatagctgtattgagtttattcagttttcctttcccacatgaatgaaaaatggggccagcctacaactggaagggcctcggcatgtaccactgtactgtgtatgatgtgatttcttgatgctagtagggagagaatcaaattgcctcctattcaaaccaagacccacaaatagcgtcaaccagtcatttcagctactccctgcagtgtcaagaaggtgtgaacccctcatgttctctattgcatacccttgtctaattcagtgtttcttcttcttttcaggttttggctttatgctacatttcagaaatcataataaccttttctggtattattttattctttttcgcactgtgagaaaaattaaactttcaagtggatgcttcttataaactatttatacccttttgctcccttttgggaggcagggacagggacagagttcctcctcaggctaactaagaaaacttactgcttccaatgtaatttaaaagatctccctctttctattgctctctgtactcttaattcttttttttttttttcacagcagagacaagtgaacatttatttttatgcctttcttcctatgtgtatttcaagtctttatcaaaacaaggccccaggactctccagattcaattatgtccttgggcttggtcgactgctgtaggagtctcagggagccttctacaaatgctagagtgactcatttaccaacattaaaccctaggatacatgcaacaaagcaggactccttcctccatggaatgtgccgatttcagatgacacagcacccaatgtagaaaacgctggaatttttccttggaactagactgtgatgagaggtgcttgacatgaacataagctactgtcttttctttttttttgagacagagtttcgcttgttgcccaggctggagtgcaatggcgtgatctcagctcactgcaacttccacctcccaggttcaagcgattctcctgcctcagcctcctgagtagctgggattacaggcacgtgccaccatgcccggctaatttttgtatttttagtagagatggcatttctccatgttggtcaggctggtctcgaactcccaacctcaggtgatctgcctgcctcagcctcccaaagtgttgggattacaggcatgagccaccacgaccggccagctactgtcttttctttgacccttcctttccagtttttgaagataaagcaggaaataatcttctctgaagatacttgataaaaattcccaaaacaacaaaacgcatgcttccacttcactgataaaaaatttaccgcagtttgtcacctaagagtatgacaacagcaataaaaagtaatttcaaaaagttaagatttcttcagcaaaatagatgattcacatcttcaagtcctttttgaaatcagttattaatattattctttccccatttccatctgaatgactgcagcaatagttttttgtttgtttgtttgtttgtttgtttgttttttgagatggagtctcgctctgtcgcccagctggagtgcactggcgcaatcttggctcactgcagtctctgcctcctgggttcaagcgattttcctgccttagcctctcgagtagctgggactacaggcacgtgccaccacacccagctcatttttgtatttttagtagagacagggtttcaccatgttggccaggatggtctcaatctcctgacctcatggtctgcccgccttggcctcccaaagtgctgggattacaggcgtgagccaccgcgcccggccagcaatacagtttttagttactcgacatctttaagcctataactcttaggctatgcatagccccatgtcctaatcaggcattcactgatcccagcaggtctccatctatttgtaccagcctcctctttcctcccaatctcaaggttactcttaaatactagtaaatgcaaaaagaacttgtaaagtggcaaggcatggcctatcaaaagtcagcccaagggcagttttcagccctgcctcacctgggtctagttcagctgacggatgagctgattgatgcgttcaccccgatagccaggtgtgcccatctccttgaggaagcccactctatttttggtagcatgatgggccactgagaggtggaaagggcgcaagaaccatgagatctcctggaaatgcttccctgggaaggcaatttcatgaatgaggtcttccaagcaaatgaagccaaacttccccaggtgctcctcaatcactgtgttgtctgtcagagggatggtcttattcttgaccttggcttgtccacgtttcaaaatgagttctcggacagacttcagatttggaaatccccaggtcacataaggttccactatatgcagcatttttagattctagggggtaacttttacaaagataccactaaaaattttctttaggcgaagtcttgcagtggttctctgcacccgtaaactcacgccatcaatcctttcgatgcgtacaacaaaggccaaggaatgtttatctggcaattccaaggcatgaggtttcacttctagtcgtctgagacgcaccttgtcacgtttctgccgccaggaatcatgtaggaatgattccagtcgcttaaacctgagcccttttcctttcttctgtcttgctactgccatctttctagtggtgcagctactcaattctttttttaattataatttttattttaagttccagggtacatgtgcaggatgtgcaggttacataggtaaacatgtggccatggtggtttgctgtacctatcaactcatcaggtattaagcccggcatgcgttagctatttttcctaatgctgtcccgcccccccacccaacgggccccagttacactcttaatccttatagctcagatgttatgatccacagtgtggttcttacagaaagttatggattaaaaaaaaaaaaaaacactcaaagtgcccgaactttcttaaaataatcctggtacagctaaactcatgcactgactgtccacctaatatttaacagtctgtgttgtgatatattgttttaatgttctgaatgcttgtcagctttcagtattgaagatgtgaatcatttatcagcaatgacacatttagtctaaggttgtcagctatttatgctacaaattaatgacttgtccttaaaatatcaattttgtgattcatgttttggcaggtggttagatgttttgtgttctaattttaaactatggataaaggttttgtcataatcattgttttattggttccttttctcccctgcccactccccaaaaaaccctgcaattcttttttgttaaacttttattttaggttcagaggtacatgtgcaggtttgttatataggcaaattttgtgccacaggggtttgctgtacagattatttcatcacccaggaaataaacacagtacttgatggataggtttttagtcttcattctcttcccaccctcaagtaggccccagtgtctgtccttcccttctttgtgtccctgtgtactcaatgtttagttcctagttataactgagaagaacatgtggtatttggttttctattcctgtgttagtttgcttaggataatggctgccagctccatccatgttgccgcaaaggacatgatttcattctttttatcgctgtgtagaattccatggtgtatatgtaccacattttctttatgcagtcttctgttgatgggcttttaggttgattctatgtctttgctattgtgagtagtactgcagtgaacatacacatgcatgcgtctttatggtagaatcatttatattcctctgggtatatacccagtgatgggattgctgggtcgaatggtagttctgttttaagttctttgagaaatcatcaaactgctttccacaatggctggattaatttacacttccaccaggagtgtataagcatttccctttctctgcaacctcaccaggatctattattttctgactttttaataatagctgttctgactggtgtgagatggtatcccagcaccatttattgaatagggagtcctttccccattacttgtttttgttgactttgttgaagattggatggttttaagtgtgtggtcttatttctgggctctattctgttgcattggtctatgtgtctgttttgtaccaataccatgctgttttggttactttagccttgtagtagtttgaagtcgggtaatacggtgcctccagctttgttcttttggcttaggattgctttggctatttgtgcccttttttgattctatatgaattttaaaatagtttttttctaattctgtgatgaatgtcattggtattttgagagcaatagcactgaacccgctaattgctttgggcagtatggcgattttaacaatatcgattctttctatcccctgcaattctttgttgttgtatttaactatttttacttgtgaagttttttcagggatgattttgttgaaagtgacaactctaaaaattatgttggtaattaaaattttaagtaatgacttttattttcagagattccacttctcttagactttggagctgttaacagcagtgtccaatctgcagtggtactcagcagtttctgtttcctgcatgcagaactgcttatatgaaaacacagttttaaaaatgctttcttatggctgacattcacattcttattccttttgattcttttcaagagggatttggtttgttaaaattaatttttgcaatacttttatgaagatacaaactctgacaaagcttttaaaacaagtttgagagaatacagtattgatttcacttgtaaatctgacgattattttagaaaaaaggaaaatattatttactattattttgcttataaatgtttatcaattttaaagcttccacattgcacatctcccactacaacagtagctaccatttattctttctcaaaaaaagtgctaagtgtgcccttgaaatttttacattgtgcagaatatccctaaaattttaaaacaaaaattacatcatcacttgctttaaatgtttcttctttatttaacatacagtttctaaaatgttagcaaatagcattttagaagagacacgttacttttctaatgaatgttctaaaatgaaccacagtaacctatacttacttagactgtgaaaaacaaaacttatattctattgttaaattttcaaaagtgaaactacacgatagtttacttggcacatcactctgttattgtgaattgacaaatgtatatgtagacaaatatgtgaaaatcagagtacatatacattatatgcagcaccacaatacattttttagtatgttttgactgatatttaattatataatttaccaagaggatctcaccagaatgtagaaaagtattgaattttagaacaattcacatatttaaaaaaaatgtagtcagcccttttatctgtatctggagaatgcagggtaaaggaataatacatgagtattggtatttaaaaaaaggtgttaatttcttacctatgatacctgttactttgggtatcatttaacctttatttctgtgaaatagaggagttctaacatcctctaattattataatattgttctaatttaatctatcttaatctgtgatacagtttgaaaaccaagcttttactattggcatgtgcaaaaaaataaagcagcagtagacttggaatcttgaatgcaaatttagattttgcctcttaataaatgtataatatagtgttctgggaccaattctctaacatttctgagtcctagtttctgcatctgtcaaatgggattagagatacctactttcaggatgtgatatggtttggctctgtgtccccacccaaatcttatcttgaattgtaatccccatatattgagggagggacctggtgtgaggtgtttggatcatggaagtgatttcctccatgctgttctcgtgatagtgtgggagatcgcaaaacatctgatggtttaaatatggcagtttcccctgtgctttctctctctcctgccaccatgtaagactttccttgcttcctctttgccttctgccatgattgtatgtttcttgaggcctccccagctatgcagaactatgagtaaattaaacctcccttataaattacccagtctcagatattctttatagtagtgtaaaaactgactaatacagagaattggtactggcagggttgggtactgctataaagataatctgaaaatgcggaagtgactttggaactgggtaacaggcagtggttagaacagtttggagggctcagaagaaaactggaagatataggaaagtttggaacgtcctagagacttgttttgaatacttttgaccaaaatgctgatagtgacgtggacaatgaagtccaggctgaaatggtcccagagatgaggaacttattgggaactggagcaaaggttatttttgctatgctttagcaaaaagactggcagcattttacccctgccctagagaactgatgaactttgagatgatttagggtatttggcagaagaaaatttctaagcagcaaagcatcctagtggtgacttggctgattctgaaagcgttcagtcatgtgcattcacgaagatatggtctgaaattggaacttaggtttagaagtgaagcagaacataaaggtttggaaaatttgcagcctgaccatgtagtagaaaagaaaaccccattttctggggaggaattcaagccagctgcagaaatctgaataagtaacaaggagtaataagtaataataagtaaaaagtaataagtaataagtaacaaggagccaaatgttaataaccaagacaatggagaaaatgtctccagggcatggcagagatcttcggggcagcccctcccatcacaggcctgagaactaggagggaaaaatggtttcctgctcagggccttgctgctctgtacagcctcacgacatggtgccctgcatccctgatgctccagctccagctgtggctgtaaggggccaagttacagctcgcaccattgcttcagagggtgcaagccccaagctttggcagctttcacgtggtgttgggcctgcaggtgcgcagaagacaagagttgaggtttgggaacctgtgcctatatttaagaggatgtatagaaacgcctggatgtccaggcagaagtctgccatggaggcagagccttcatggagaacctctgctagggcaatgcggaagggaaatatggggttggatccctcatacagagtccccactggggcactacctagtggagctgtgagaagagggcctctgtcctccaggccccagaaaggtagattcaccgacagtttgcagtatacgtctggaaaagccacagaatgccagcctgtgaaagccacaggggtaccctgctgagccacaggggcggagctgcccaagggtatgaaagcccaccccttacttcagtgtgccctgaatgtgagacatggagtcaaaggagattttggagcttttagatttaagggctgcccagctgggtttcagatttcatggggcctgtggcccttggtttgaccagtttctcccatttggaacaggaacatttacccaatgcctgttccctcattgtatcttggaagtaactaacttgcttttgattttataggctcatacgtggaagggacttgccatgtctcagatgagactttggtcttggacttttgagttaatgctgtaataagactttgggggactgttgtgaaggcataattggttttaaaatgtaaaaagacatgggatttgagagggagcaagtgcaaaataatatggtttggctctgtgtccccacccaaatctaatcttgaattgtaacccgcatgttttgggggagggacctggtgggaggcagttggatcatgggggggttttttccatgctgttcttgtgatagggagttctcaggagagttgatggtttaaatgtggcagtttcccttgtgctctttctctctcctgctgccaggtgagacgtgtcttgcttcccctgccccttccaccatgatcataagtttcctgaggcctccccagccatgcagaactgtgagtcaattaaacctcctttccgtataaattacccagtctcagatagtatctttatagcagtgtcagaatggactaatacaggatagtaatgaagattacagaatatgtagatgaagaagtgctaagtaaatagcagctattattatgtagtcaaattgaatgtatacattgtggtacttcagtgtcctttaaattgaataactagaaatttgttggctttctcaatctgctcacatcagatgacatgttaatttatgcctatacttttttctagttaatagatataaatctattcactcaacttctattgacagaactggtagtgtggcaagacatctcatttctagttaaggctgtataatattaagttcattttacttaaattaactatggtttgggaaatgcttttcatgtcatcatgtatgcccaatttgatactttagtgggacagtatatttcagaaaaaaacaaatgcttccccaaaaattccagggttgaatacattagtcagacatataacaatgtacttcagagttcctctaagggcaaaaatcgtggtatgaatatacaaaacactcctatttatacttttgtatttttgaaatgtagtcttcatgttaatttagcatttcaatgaccagcatgacattatcttaataatttggaatgccaatatgttcatttaagacttaatatagtaagtatctaaagaaaaaaatggaagtgactgaatgcttttgtatctcttaattataatttgtgctccattgtgatatgaaggatagaaggggcaggatagatagaaaacagaaattaactttgatgtttaaccttaccttaagactgtctgttaagtgacccacataatcttaaaaaactctgtcaagcttaatggatgctactctgcaggcccctgccaggcaacagtcacaaggttatgaggtgcatagattttggaattaggcagagctgaattcagatccaggtgttgccttataatgcgactttgggcaaataaaaggcccaatttttgtattcttatctgtaaaatggactcagtaaaaattatttgagataatttatttgtgtactgtacctaggcatgcagcttgacacacagaattacaagtcagtagtttccagtatgattattattgtgaaagagatattttgtttcacctactgaaaacttttttcagtcttaaattttttatctaactggctgtattgcagatgtctgctatataacttttatataattttaaaaactatttctttcctccttgatcttctaggggtaaggttaccaatgttttcattatttactaaatatagcagcccccaccccttattcatggaggataggttccaaaacccctagtgtatgcttgaaaccacagaccacagataatcccaaatcctatatgtatattgtttttcctatacatacatacctatggttaatgtttaacctactaattaggaagagtaaaagagtaatagtaactaataataaaataaaacaattgtaacaatattccagcatcactattcttgtgctttagggccaccattaagtaaaataagggttacttgaacacaagcactgtgatactgtggcagtccaactggtaacagagatagtgatgcggtttggctgtgtcctcaccagaatctcaacgtgaattgtatctcccagaattcctatgtgttgtgggagggacccagggggagctaattgaatcacagggtctggtctttcccttgctattctcgtgatagttaataagtctcacatgatctgatgggtttatcaggggtttccccttttgcctcttcctcatttttcttttgccaccaccatgtaagaagtaccttttgcctcccgccatgattctgaggcctccccagccctgtggaactctaagtccaattaaacctctttttgttcccagttttgggtgtgtctttatcacaagcatgaaaatggactaatacagtaaattggtaccagtagagtgggtgttgctgaaaagatacccaaaaatgtggaagcgactttggaactttggaggactcagaagaagacgggaaaatgtgggaaagttaggaacctcctagagacatgttgaatggctttgaccaacatgctgatagtgatatgaacaataagatccaggctgaggtggtctcagatggatattaggaactttttgggaactggagcaaaggttactatgttatgttttagcaaaaagactggcagcattttgcctctgccctagagatttgtggaactttgaacttgagagagatgatttagggtatctggtggaagaaatttctaagcagcaaagcactcaaaaggtgacttcggtgctgttaaaagcattctgttttaaaagggaaacagcataaaacttcagaaaatttgcagcctgacaatgcagttgaaaagagaaacccattttttgagaagaaattaaagctggctgcagatatttgcataagtagcaaggagcctaatgttaatccccaagaccatggggaaaatgtctccatggccatgtcagagaccttcacagcagcccttcccatcacaggcccagagacccaggaggaaaaagtggtttcgtgggccaggcccacggtcctcatgctatgtgtaggctagggactttgtgccctgtgtcccagctgctccagctgtggctgaaaggagccaatatagagctcaggctgtgacttcagagggtggaggccccaagccttggcagcttccacatggtgctgagcctgtgggtacacagaagtcaagaattgaggtttgggaacctctgcctagattttagaagacgtatggaaacacctagatgcccaggcagaagtattactgcagggcagggctgtcatggagaacctttgctagggcagtgcagaagggaaatgtgggattggagccctcacacagaatccctactggggcactgcccagtggagctgtgggaagagagccgtcatcctccagaccccagaatggtagatccaccaacaacttgcaccatgtacctggaaaagccacagacactcaatgccagcctgtgaaagcagccgggaggtaggctgcaaagtcacaggggcggagctgcccaagaccatgggaatccatcttttgcatcagcatgacctggatatgagacctggagtcaaaggagatcattttggggctttaaaatttgactaactcactggatttcagacttgcatgggccccgtaacccctttgttttggccaatttctcccatttggaacagctgtatttaacctgtgacacccccctaccccctgccccccatccctccggcccttgtatctggaagtaactagcttgcttttgattttataggctcataggcagaagagacttactagccttgtctcagatgagactttggactgtggacttctgggttaatactgaaataagctaagactttgggggactattgggaaggcatgattggttttgaaatgtgaggacatgagatttggaggggccaggggtggaatgatatggtttggctgtgtccccaccctaatctcaacttgaattgtatgtcccagaattcccatgtgttgtgggagggacccgggggtgggggtgcagtaattgaatcatgggggctggtctttcctgtgctattctcatgatagtgaataagactgacgagatctcatgggtttatcaggggtttccaaaacttttgcctcttcctcatttttctcttgccaccaccatgtaagaagtacctttcacctcctgccatgattctgaggcttccccagccatgtggaactgtaagtccaattaaacctctttttcttcccagttttaggtatatctttatcagcagtgtgaaaacaactaatacagatggctagtaagggactaaccggcagggagcgtctccagtgtggatatgctggacaaagggatgattcacgttccagggcataagatttcattactcagaattgcacagaatttaaaacttattaattatttctggaattttccacttaatgttttcaaactgtggttgactgcaggtacctgaaactgtcaaaagtgaaaccacagataagtggggagtcctgtacctaagattattcctttaaattgtttcagtggatatgtagggacctgagtgtgaagtgagagcagcagcatcaaaacctgagggaaatccagatagcaaaagaaacttgtctagtatactggcatgacagagaaaccaaaaagttctcaagttaatgtgagaatctaagaattaaagaattaagcctttgcctttgagggaaggaaaggggtaatgtggctttaaatcaggttgagattggttctgagggttccttttccttcctttatattgatatgaatatagacacaactgttctgcatttccatttgtttttataaatgtctttttaggatttaggaactgctaattatgcaatatgagatatctgttagtttgaggaacatttgaaaatttggtcaaatgacacagatcgtcacacagttttaagacaaatgtttttacctatttgacctagtctggcaatccctatttgggcaaaaatcttcatttgcaggtcatgattggaggcaggcacagaaaaaaaattgccaccttttttgcattatgtcatcaagacatcaaacttcagcctacaaagtagaaagtgttatttctcaagttgaaggcctggatatacctcagcttctcagttctgacactttatcatagtggaaaatgaagaagattgcttaagaacactgatgttggtgtcagaaagacctgggtttgaaccctgactttactagttacttagatcactttaggcaactcaacttttctaaatcttgtttcttcatctgtaaatgctgaaaatagtacccacctcttaggtctgtggagaggattaaatgagataatctatacaaagaaagagcttgcataatagtgccaagtaatggtgaggttatacctgtattctgattataatctcataaatatttaccatgttagctgtctcagagttcttttgcaaaacagataaagatagaaagtataaataagaaaaataagtgaacatatactgaactttgtacaagatgctggcgatatggagagacccaagacatgggccctacctaaaagagattattgatagaaacaggatacatatacatcaaaaggtaacataggatcatctgtgcaaagtgctatatggcagtgttttaggaagtctagaagctgtcatggatcaggaataccatggtggacacttcaggcagggaaaacagatcttagcaaaagctactcctatcataggtacttgataaatatttgtagaatccaggatccctgtagtgataaagaaactacatggattatgtaggggagtgataagacatatgactggaaaaataaaaagaccaaattatggaccatactgagcttgtactataaacagtggaggagcccttcagatttttaatcatgttgagaaaagagttttagcagtgtgtgggggatagaatggaaagagaagccagtgccagaaggactacttagtatcaaccattgcagtggttaaagcaagaggtgagagaaggcatgcattagaatggcagcggtcagagtggatgggaaggaataggtcctgacatagtgttacagggagtaataaataggatgtggaagatgggttagaattggcaaaatctctgcatgtaagtctgggttactaaatatagtgagagaaattcaaatctctctttaagaatcgaataaaatatttagaaataagttactgttgtatttgaggtgaacacaaatggcatttcaaagatgctcgagataccttgttggaaaaagtcaataactgcactattgtctccaacatgttcttgccttctctgaagacatcatgttcctaattctgaattatgaaccatctattatccttgtatgctcttatgtgtgaggaaccataaggtgggaacaaaatccggtcttcattctagaaataactatgcgatcaaaaagtttttagtctttcttcttaccatactggttcttggtattctgtttaccattcaatgtactattattgcttctgcttaaaactcgcatcccctaatgcaagcctgagcaaacagaactgataacacacagcctgagaagggagtgcttggggtctcaagacttattctgtttttctccatctttgacacttggtttgaagagcaaagaaggatacagctgttaggaagtaagttacccaaacacagtgaccaaactggattaattcttccaatgagaaagaaatacattatttctgtgagacagattagactttaagtagcatagataacatgattatattctctctacaaataaatacacaggacctaagaaaccctttacagatccaagtgttttcctctccacttttccatccccaaacccatcttgcaagatatggccagcttatttggagttaattaaatcaagaccttcgttttacagacagggaaaccaagcccagagacactgagtagtaggccactggtgtcttagaggtctgaaaaatcctttactgaacattctcttgatctattaatgtataggttttgttgctgtaaccctctccccaagaggagtgaatataaatgatgcagagtttggatgaactatcttaataagaacctaaagttgaaaccaatgcaaacctctctcaataaatgcaaagcaaagagaataatcagtctttctttggcttgttaaataagataaaatgtgttctgctaaaaccatttaacagaaatattgtgaaaggtttcccctaaagcatttttctatttgatttgaaaactattccatagcttattatcaaacaaatcagtaattctttagctaatgcagagataaatgggcagtcagaaaatataatcacctggtgtgtgcagctgagtatttacatttttcctaatgaacaaagataagaaaagtgcaggtgactttaatgtgtaaaaactaccttttagtgctagcgctagagggaaaaagaaattactggctcaagccaatcctgtacttgataactaagccgtatagtccatggcttggcttcagttctgttttgaatctctttttggacttgtcttgaatggactgtttagggctgcttcagtagtgcagttgttgcatttttaagcatagtttaggttttaaaatgtttctggtccctttttttttttcttttccactttatgttgcttaaagctttatggccaggttttctcatcctcagcattattgacatttgaagctggatacttctttgtggtgggggctgtcctgtgccttgtaggctggttagcagcatccctcgcctcttctcacttagatgccaatagcatttccccaaccgtgataaccaaaagtgttttcagacactgccaaatgtctcctagagagcaaaattgctctctgttgagaactactgtgttacggtgtttggacaaaaactgacaagccaatgggaatattctattggtagttgtaaaaaattaatccagttatagcagctgtatttctggaatttttttccatattaacacttgctttctgaggtgataatatctttgttttttttctcccaaatagatttcttgcattacactgaaaaattgctgattaattcacttaaattgaagactaagccaatcatgtcatttgggtaatagtttaccaactctgcccctttctctgtcagggaagcctctaatttagtaagcgatactgtatccttttgtcaggtacattaccattcctattagcaatagggcaattgagattgagaaagattaaaaggtcaccaagctattacattgtagaattaggttatgaattgtagcctatctggtttagaatctttaccttactagtctccataacaacaattcttccagtgtggtccatggggccctgggagtctccccttaaagggcagactattttcacagtaacacgtactttatttgccatttcattatgtcagcatttgcaataatggtacaaaagcaaagatgagtaaaactgttggcatcttagtatacagtagttactgtattcactgtcatgcacttaaaatctttgaagaagcaaaaaaattattaattacattaaatttcaacccttaaatacatgtggtctttctcatgtcagtgtgacaaaatgagaaggtgcataatccacttatatcgcatatagcatttgatagttgtctcaaagaaaagtgtataagattaaactgtgagttaacctactttttttcatggagtaccatgagagataaactctggttttcagccttgggtatttggcgatgttttcccaaaaatgactgaagtaaacttagcactttaaggaaaacaacttaaagtatttgttgccaattgataaaatataggtttcaagcaaaaatcagaatttttgaagacttgtatctgccactgtgagcttgacaaatgtgactcttttatattacataatgaactatgtcaacatttgaaagatctgcataactcagtgaaccagtattttccagatgactaatgcatgataatacaaaatcatgcatgggtaaaagatacattcaaagtgcaagatagactgacatatttcaatgtaacaatcaaaagttcattgataacagttttggattccacattgcaatactaaaacctttaaaaaacgaaattgtccaattttggtgtagtaatcagaaaaggcaatctataattacctgaacttaagtttctggaggaccattaaccttctacaggctcatggggaagactgtagcacttctctttccctaagatcctccagaaaggaagaaggtaatccttgggggtagggtagagacctattgtgtgatgatcaccaagtatgtaacaatgctttatataactctaatatatataatccacacaaaccccctaaaatggcactaataagggaatggactcaaagaagttaagtcagctagccactgtcacagctattagagcactggaactaggatttgaacccagatttgtctgtatgtaaagctgattctcttcgtaatagtactgagacacaagaggcggctacaaaatattctggtactccatcctagaccagagtttcaaggttcgttatcatttgtagcatgatactggatcctcacagtgcttgcctttcattcaggtgccaggaaacgtctgcctgaatgaatgggtgtaatttacctgcacattttacatgcttctctaggtgtgtgattaactcataatccatccatgactttcacccataatcctccttgtagcaattgctttgcttgcaacaaaactaagtagacatatctagctttatgcatggttttctctctctgaactctaacataaactcagcctcaggaattattcggtttctactacatttgccattctgattgggaaccaccagcattcaggtattcacctggaacaaggcattttgttccaagggttcctcacttaaaagcaagcaccctagcaatagttcataatggaacttcttaacattctcagaatgtttggcacagctgtgagtgaacacacattgagcaatcaataactattacagataatgatgcccttaagaccaggatattttagctttcccattcaaagggggtgaaatatgcactcttactatggtatacttttggttccttctgccatgtatccttaataaaagatgtcaattccatatggttttctcttgagttctaaccattttgttgtaccctagcccttttaacaatatcaaacttgcaactgaataccatttagcattcatccattttttccaatggtgttcattataggctatcttactcctcctatttgtatgacaaaaattggcttttttcaccgatgtctatggtacatctggcagctttccatgtactcagttcttatctgatgtagcccagaacgactgcctgaagggatgccaaaagcctgattgaggttccaaattttcagctactgtactatcaatccatttgttcatttttactttcccttgtcatctgtagcttacagttgagtggcctgaacatgttttgcatacattgtaatatctaagaatttgggaatacggtcctaggatttagacttaatactaccttccatttatataatacttactcataaaatcttcagtgttcctgaaaaagaaaaaggaacatgtattgagtgcctgctagaagcaggaacttgtagtagattttctatgtgttaccttattttcacaacacacacacaggtgatatccttcccagtttactgatgaggaaactcaggggtcaaagtagtagatacctacccaaggtaacagaagctgtgaagtggtacagctgggatctaaaatatgtcagcttcaccgtagataggctccctgatgaaccacctgccacggcccgtatgaccgcatccaggggtgatgatgtcattttcacagggttattgagagctaaaactacgaagtactacaaactattatttaaaatataaatacatactatatatgcatatgtgtgtatatataattaatggggtaaacattacagaatactgtcctaacctttaaacaatgcactcgttttctgtaaactaatatacaaacaactgtttggtccctaaaaatagatgtcaggtgacagagactggctgagcaagaataggagtatcttcagaatagaagccagaggagtttttgcttccccaacacattgtcgcaccattcactgttccaggaccttcctacttctctggaaaactctggcccaaagcagctcctctacattagtcacaagtttccattaatcaggggtggcctgtgccggacctacagcagagtcatttcaggttattctgttacaggctttcgacgtgtagtcagtccactcgcccaaatctagcagggaatgaatgccttgtaatacggaagcatctacaaattcttcttaacagtgttcagagaacaatgtgaaaccctggggccttttcccagaattagggtggtgggaatgctgtcctattgactaagcctgttaggtaagcaggcagttggcaagattcaggaagcttcatttgaagatagaatttagggcgatcgtttggatttactggcttaattacttaaggtaacatttataaaagaaattgtcattccattattattaccttttaacttttattcctaaacggaacattagcaacaaactacattacttgataaatgtaatttctaaccagattgataactagaaaaaaattttaagttactttgctctgtgaattagtttaaacatatttgtaattgagacttactactgttattggctgaaataaataaaagcaagagataataaagaataacagagacaacgaacacccaatttaagtttatttctaagttccatcttttttagagaaaaggcaaattaagaaaagtttagagagaggtactagtatatttatgaacttgtatagatgataagcaaaacggactttaatatgtagaattccagaatcaacaggttgccagcatccatgtttttgaagatttgcttaagaacacaaccaaaaatggaatgggcagtctctaattacaagcagaaggctacaaaatcattttagctgcataatacagttttggttctaaagtcagcacgtaagaggaaaattccttaggaaaatacaacattgaaaaccattgtgtcatgtaatatgaaatgcaataattaatttttcctccagtaatagaaagatcactgtttcattggtttataaaaatatatctttatcattaaatgtggcaaaatgttaagacttggtgaatattggtgaaaagtatatatccattgtacaattctttccaattttttttgagattgaaaatttttaaaacaacaaattatcttttaaacagctaataatcactagacctgcactctttgtggtgagactatgaaaaatgttagagacctagtaagagaagcagattcacatttctgtcttcttcttcaagccaaacagtcatagagtggagtgggcagaatggaactcacttttgaaagcctagtgctttgtccaatcttactgcaagccagacaggaaggttatagaaaatgtttctggatcagtcttctctgagtcatatgaaattgtggtttcagccaagatgacattaggaattagagacatgggacaaaaactttaagattgtaaaaaaattttgactctagtaggaaacatgggtagaattgtaatgacacttgattgaattttaaaagatgcctgtataagatcttaaaattaggaaaaaaattatggcctaagcaattaaaggcataggaggcatctttttgggatgatggaaatatcctctctcctgattgtgatagtagttacatgaatattcatttaacaaaaaccataaattatagacttagaaaacagtaaatgttactgtatgtgacaccttaataaacgtgattataaaaataaatcctaagcatctaaaaaaaaaaaaaaaaagaagaagaagtgaaccagaaccacaccattctattttggagacacttcaaaagaaatgacctcattcttaattttgtttaaagaagaatataacatgatttgaatatatttagctaggatattttagtgcctgctagcacttgaagccagagttcactgtgagcattctgactatgaagtgagaagctaagagaactgtattttgatattcctttgacagttaaatcataacactgttcttccccttctttagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggtagtgtgtgttttgaagagtttatttttcctctacttggttttcatttctcagggtggattttgaaatttccattatatgcaaagcccatgaaaggctaaatatcagttaagaggggagaggagggtggctcctaggtcctctaatgggcaggaaagtatttaaaacaacaatacaaaaagatctagaataaaatagaaaagtacaagttgatgtctgggagtttggtcagggagcataaggtaacactataagaaagtgctatcatatgaaatgatggtgttaagtttgggcataacataatgttcattgtattagaaacatgggctttaacttccataagctaataggtttcaaagtcaccaactttactggcctggcaaaaatgagtcacagtgagaactgtgacaggaaaaaaaaaagatattcatttcatttcttattcattttttttttctattaagccagggcactgtgctaagtggtataaataccaataagacctgatccttaccctctgggaagtcacactccactgaagtgaaagatgagttaacaatgacaaggtacagagattataatatagatgagggagagagaaactcggcctgaggaggtcaggaaaggtattttagagaaactgatttcactatataaatgttgtattaacacaaatcttactttgttatggattcagactgctgacagggcaacagcattatctccctaaagaatgagaaattcattccatagcaaatttattagaagagagtctaaaatgtcctaatactaccagtgactcctctaggaaaaaaattgtcatataatttagttatttctaaagcagtttgaaagtagcttggcctaaagctctgattatattaattttttaaagaaacaattattcattcactgtatgaggattattattatttgtctcatgttgtgtttgcatatccatgagagttagatgagtcattttcttttgttttactttttaatacattagcaaattataaaattactcatattacaccacaaagattacaaggatggcagctttggccagtgtagtagtcccacctattgattagagtcaaaagtaaagcccagccctgctttgtgcattgctcctaataaagtggatgttacttaacacatacgcagaagacagaagcgtcttcgtgtcctcactttactcctcactttcttaactgcttaagtatttccacgatataaatgcagtgataataataatacggacagtccctgacttaacgatttttcaacttttatgatggtgggaaagtgatacgcattcagtatggctcctcgacttacaatggggttgcctccagataaacccattgtgaattgaaaatatcttacacttagcactccattcttaatacctgctagaattatagattatccctcaaaattggcatagtataatatgggtatcagcaagttgttgcactttattcagagctttacactaggcaggggtgggctttacttttgactctaatcaataggtgggactactacactagccaaagctggcatccttgtggtctctgtggagtaacgtgagtagcattataatttacatcccccataacaaatgatccaagagagtatgtgatcaatgcagcagaactattgtcttttattatctgatttcacatgtaacatgccatcacttctgccatattttattggccacacagaccaatcttggtaaaggacggaaagggactgcacaagaccatgcattcaaggaggcagagatcactgggggccatcttgggaggctggctaccacacccaccataaatagaaaaccagaattatttgccaaaaatagactttaaccacaaaaatgaataccatataaacaaaacaaagtcacaaaatttcagctgacttgaagactcatctttctattagttagaaagggaatttaccaagtagtagaagacacaggaactccaaaataagatatctcattgtcttatcagaagggttgacaggaaaatgggctgggcactgtggctcaaggaaaatgggctgtgcactgtggctcacacctattatcccagcaatttgggaggccaagatgggaggattgcttgaggcctggagtttgagaccagcctgagcaacataacgagaccccgtctctacaggaaaaaaaaaaaaaaaaaaaacgttatccaggcatcgcacctgtagtctcagctactcaggaagctaaagcaggagattcaggctgcaaagagctatgacacaccactgtactccagcctaggcaacgtagcaagaacttgtctaaaaataaataaataaatgagtcaaggaatgaatgaatggattgacaggaaatgactattagttgtacgtggccatgtgttatgaaatagtgaatactagttaaaactcctcattttatagataaggaacagatagatagacttgtccaacttcatgctaataaccacaaagggctatttttaacttatgaaggtacattgcctctgatcctatagctcagagtcttagctgtgcacaagacatacctgggataaagaaatcaagattggcgtaatgtgcacatcctgacatttcagttggatataaacaaaactttggaatttttcatttttagcagtgggtgattttttttctttttttcttccagtaactgtaggacagtgatttagagattccttatagggtataacttttttgtattataaccacttcatcaatagatgtatctgttgatcgtacttttgatttataggggatagaattgggttagtgcttccattttctgtccaagtaaagaagctaggatatttatagagtacaaaaagaaattgaaacagctggtacagatatttggcattggagagcagctctgaacaaaggtgaattatagtctagtggtcaattttgtggcctattctttacaaagaattgaacctgatacagttaaccatctaccccaaactattatttgtttaaaacacaatctattggctgggcgtggtggctcatgcctgtaatcccagcacatcgggaggccgaggcgggtggatcacgaggtcctgagatcgagacaatcctagccaacatggtgaaaccctgtctctactaaaaatataaaaattagccaggcgtggtggcgtgcacctgtaatcccagctactcgggagtctgagccaggagaattgcttgaacctgggaggcagaggttgcagtgaggtcatgccactacactactacactcccagcctgggcgacagagcgagactccatctcaaaaaaataaaaataaaaaaacataatctatcaaactgtgtaaaacacagtttatcaaaaaagtagttacccttggtgggtactggctggaattgggcagaaagggggcctgttggggtactgttctgtttcttgatctgagagctgattacataaaggttcttggtttgtaaaaatttattaaatggttcactgatttgtgtactttttttatatgtgaatactgcaataaggttttttattgcactgttttcagtttgttgaacagaaaaagggagactctttttgttgtttttgacctctcgacctcataatggcaatgtaggcaagaacattccctcaaggcaatacctgtgggtgtcttggttatattccaccggaaacaaagacagaggctgtccttataaaatatgtttgaagacctgtgaaactttaatagtgccttttattccatataggacagcacaattacctatgtgctggaaggaatgattgcatcatcgataaaattcgaagaaaaaactgcccagcatgccgctatcgaaaatgtcttcaggctggaatgaacctggaaggtaatataaatatctgaaagcaattgtttgtctctgtagcttataaaaatttatcattttacttttgaagatacacgtaagcagatgtaattaatgtagtcagttcagtatatatatgcttgactagcataatgttactgcccaataaaaatgggaaatttttttcatgaatatgtcatattgtttgtttatccaccagttcttcttacacacactgaattcagtacagccagactatatacaaagaaaggaaattatgtaataatgaaacttacacaacatgcagcaactttattattcttactccttttttcagcctcaaaactattccctagggttggaaatgtttctgtatcagacatatttacatgtccatttttctgtttgccttttaaaagcataccttttacttggagatctgtgttttattacagatcttcaagcggggggtggtgggaaaaaaaaaacctcaaggaagaactggatgggttttgttttggttttcaagtaaagaagaaacctgggccgggtgcagtggctcacgcctgtaatccccgaagtttgtgagaatccttctgtctagtttttatgtgaagatattaccttttccaccgtaggcctcaaagcgctccaaatatccacttgcagattctataaaatgagtgtttgaaaaactgctcaatcaaaagaaacgttcaactccatgacctgaatgcacacaacagtgagaagtttctgagaaagtttcttggtctccccgcactttgggagaccaaggcaggcggatcacgaggtcaagagatcaagatcatcctggctaacatggtgaaaccctgtctctgctaaaaacacaaaaattagcggagcgtggtggtgtcacctgtagtcccagctactcaggaggctgaggcaggagaatcacttgaacccgggaggcagaggttgcagtgagccgagatcacaccactgtactccagcttggcgacagagcaagactccgtcttggaaaaaaaaaaaaaaaaagaaacctgaaactagttataagttagagtttcatatccctgtttatataacaagttgtataattaacactgatctcagcattaaaaaattttcctctgaaaaaagtttggaattctgctgtggttgaaattgcaagttctgtgaaggtagtggtgatctcataacacatatgcttagtatttattgtgaaattagcacttttattcaacaaatatgcaccaacaaggcagtcactaggtataaaatgaataaaatagtgcctgtattcaagtagtttatctgctagttaggttgcagagtcagtcacaaaatagcatggcacaccatagagggcatagggccacaggaacaagaggaaggtcacctaattctgtcttggaagtcaaggaagaagtaacattgaattttaaatctataagctgagtaggaattagatagatgaaaaataagggcagagacatgatcagatttgtattttacaaagactaatcttacatggagagaccaattaagtgaatatggcagtcctccagataagagatggcagtactgagagagaatggaaaccatgtggttccttttatgattatgatgattattattattttagagacagagtctaactcttgtcacccaggctggagtgcagtgacatgaacatggctcactgcagccttgaactcctagactcaagccatcttcccacccagtagggctacggatgtacactaccatgcccagctgatttttttttaatttttgttttaattttttgtagagacaaaggggtcttgctatgttcccaggctggtgtctaactcctggccttaagtgatcctcccaacgtggcctcccaaagtgctggtattacaggtgtgagccactgcaactgacctatgtggttcttttgataggagagactaattgttggtgctatctagcacacactgtgtgtagacatcttgttaaatagaaaatagatttatgggtatgactatgaagagtctaattccccaaaccacacacacaactctatctacgtttgaccaggctatttaaacttaactgcagagtgtcagcatgttaaacattgatttacataaaatgatagctgcccactttcttgtaaatgttataaaaactgtagagattaactaaaaaatgcacacagaagtttgctttcagttccacaagggtagtttatttttgttataaaaacagtattccccactttcttagataccagatctctgcccagattttacccagtttcatcttgctgctctctaatctcctatgtatgtaatatactttgaccatttaaatatgtattaagacacttgagtttttagtgccctttggtttattttctccggtcccaattatctctaatcttcattttttcattttacctattttatatttcgaaataggttttgaatgaagctcaaaggacaaacccaaataaaattctgtcgtatctctaatatattgtggttgcttacccagtaacatttttaggtgcttttctgaatacatataaagtttaagatctttggagttttaagtatataatgtttttctgggcaatttctccctatccaaactatgagggccttctttcatcaaaagaaaaaagatatatcaactacaaagtaatgattttgatggactaggctacgaaatctgtccattttttcctccttcttacagtttaatagcaattgcagtgccctttgcccttactgtactagaagacgaccccaggcagtgactgacatctgatttttctattaattataccatcactgccatttccagttgaatcttttgttggacatcagaaatttttcttacatgaataaaatttaagcatacggttgggcgcggtggctcatgcctgtaatcccagcactttgggaggcctaggcaggtggatcacgaggtcaggagatcgagactatcctggctaacacggtgaaaccccgtctctactaaaaatacaaaaaattagccaggcgtggtggcgggcgcctgtagtcccagctactcgggaggctgaggcaggagaatggcatcagcccaggagttggagcttgcagtgagccaagatcgcgccactgcactccagcctgggcgacagagcgagactccgtctcaaaaaaaaaaaaaaaaaaaaaaaaaaaaaaaaaaaaaaaatttaagcatacaatttaggctgcagtttctcaaaatattgtattaaaaataaccaattatatgcttttatagtcagtataacgtatccagttagtgtagaaattggcatttgttgaaaactactacatgttagtctttgatatacattcttctactttttggaccctgattattaaaaacacctttgaatagggccatgatttactttatatccatttttatactacatagtggaagaaaattctgatttgttatttcctactatgatatgtaccgtgtggcacatatcatataaatgatccaattctacttgtagatgaattgaaagaaaggcttaaaaaagttcttagggtttgtgtgtgtggtttcactgtaaaactatcatttttgtattgaactaacctcagtatacataaaatctttatttggcctggtatgtacgtatgccaggaatctttggcagaccctaacacttacaatacagatgagccatgtgtttcacactttttttttaacaaccttcagaaatattctcttgttcatcagagtgcttcccctaagccaagcagtttcgatgatagccccagaataactttgcccaagtctctccataaatgtaacttaggactccaagtggtgtatttttatactcttgccccataccaagtaaatctcaagatttattttaagggagtggccttcactgcttaaagggcctagcatttaagaacagataagatttttaatggtgatcctaaatgtttttttttaaaaaacttgcttgtttttctcttgaaactaaatgtttttattcacttcattttaagatatattgtaatcaatccaaagtatggctttatttttagtataaacagtcaaatgaagcttagtcttgtggcattgtcagatttataaccaaatattactgaaactaatttttttaagttcaaaaacccaatctagtagtttctctcttattttcaacttttattttagattctaggggtacatgtacaggtttgttactaagatacattgtgtgatgccggtgtttggagtatgattgaacctttcatctaggaagtaagcacagtacctaacaggtgctttttaacctgtgcctcccttcctctatcccccctcttgtatttcccagtgtctgttcccatctttatgtctatgtgtactcaatgtttagctcccatttataaatgagaacatggtatttgtttttctgcattagttcatgtaggatactggccgcctgctacatccatgttgctgcaaaggacgtgatttcattctttttgtggccacatagtattccatggcatataaataccacattttctttatccagtccactgttgatgggcacctgggttggttccatgtctttgctattgcaaaccatgctgcagtgaacatatgggtacatgtgtctttttgatagaatgatttatttttctttgggtatattcccagcaataggattgctaggttgaatggtagttaaactcttaattctttgaagaatctccaaacttctttccacagtggtgtcattgtggttttgacttgcatttctctgatgattaacaatcagcatttttccatatgtttgttggccacacgtatgtctttttttgagaagtgtctgttcatgtcctttgcccatttttaatggggttgtttttgcttgttaatttaagttccatataaactctggatattagggctttgtcagatgcatagtttgcaaatattttctcccattctgtagattgtgatagtttctcttgatttgcagaaactctttagttaggtcccattgtcaatttttgtttttgttgcagtttcttttggggattagtcataaattctttcccaaggccaatgtcgagaaggttatttcctaggttttcttctaggattttcatagtttgaggtcttacatttacatctttaatccaccttactaatttttatatggcagtaggtaggggtccagtttcattcttctgcacatggatagccagttatcccagcaccattaatggaatagggagtcttttccctatggcttatttttatcaactttgtgtagattacatggctgtaggtgtgtgtctttatttctggactctattctgtaccattgtgtgtggtttttttttaccagtaccatgctgtttcggttactatagcctgtagtatagtttgatttggggtaatgtgatgttgccaactttgttctttttgcttaggattgctttggctatttggggcattttttggttccataggaattttagaatgctttttgctaattctgtgaaaaatgacattgtagtttgataggaatagtgttgaatctataaattgctttgggtagtatgaccattttaactatactgattctaccagtccatgagcatggaatgttattccatttgtttgtgtcatctttgatttctttcagcagtgttttgtagttctccttgtaaaaattttaaactaacttagatgcattcctaggtattttactctttttgtgactgttacaaatgggattgcattcttgatttggctctcagcttgaacattactggtgtatagaaatgctactgatttttgtacattgattttaaatcctgaacctttaccaaagttgtttatcagctccaggagccttttgacagagtcttcagggttttctaggtatagaatcataagtgaaaagagatcgtttgattatttattttcctatttggaagccttttatctctttctcttacctgattgttctgactaggatttccagtactatgttaaattggaatggtgacattgggcatccttgtcttattgcattaaggggaatgcttccagcttttgcccatttggtatgatgttggctgttggtttgtcatacagggctctttattactttgaggtatgttccttcaatacctagtttggtgaaggtttttatcatgaagagatgctggattttatcgcaactttttctgcatctattgagatgatcattattttttttgttatgtggtgaatcacatttattgatttgcatatgttgaacgagccttgcatcccagaaataaagcctacttgattgtggtgaattaactttttgatgtgcagctggattcagtttgctagtgttttgttgaagatttttgtatctgtgttcatcagggatattggcctgtagttttgttgttgttgttgtttctctaccaggttttggtattagaatgatgtttcccttgtagaataagttagggatgaggccctctttctagattgcttttttagaatagttttagtaggattagtaccagctcttctttgtacatctggtagaatttggctgtgaatccatctggtcaagggctttttttaattggtaggttttttattattgattcaatttcagaactcgttattggtctgttcagaatttcagtttcttcctggttcaatctaggcaggttgtgtgtttccatttccacatacatacttactccaaataatggctttatatatacgggggtcagctgaaaacaaaaatgatactttcatagtaaactccacccgcccccccacccacatacacacacacataaaccctagattttttaaagcctttgttccaatttatccatttcctctagattgtctactttgtgtgcatagaggtgcttgtaatagtgtgaagatctttttcacttctgtggaatctcttgtaatgtcatcttttacattttttattgtgcttatttgggtcttcactctttttttctttgttaatcttgctagtggtctatcaatcttgtttatcctttcaagtaaccaacttttataaactaggttttaagctaattaagatttctctactttcattaagaaggaagtagtgttaccacagactcatgaacacttctgtggagctcctgtattgactgctaatcaactatatgctccaatgggtcaggaatttatataaagttgtattaactaagttgctttaaaatagtgattgcttaactaaatgattcagttcagttaactccttcctgaagatattttgaaaaattaattagtattatttcttgctctagtcagtacagcacagttgggttcaattgtactttctgagctgtattgaaaaacatcagttttctcatttagaactatatataagtagtgagaaattaattacaaactgagtcatagaaaatgtttttttttaatcctccagcttgttactctttcttccttgttctaatgtggagtaaagaaatatgcattccaaaccatttaaagttatgactaattgaggctgtcaaagtactgtttcagtgtattgatttggcacatgtgtgttctcttttacattgtcaacaaaagtacattttatgattttggatcaagatttcactgagatacttctggttgtttaaagagtttctttatgtattggtgtctttcctttttaaaattttatcactcctctattaagttgtgatatccaaatttaaaatattctaaaaacatgttctcctgcaagttgaggtaatgatagttgttatgtggtacttactataatatatgccaggaactgttctaagcattttacatatttaattctcacaacaaccctatgaggtagggactaatattgtcctcattttacagaaggggaaatgaagagtcagggagtaacttgcacagatatccagctacaacatggcagaaccaggacttaaatccaaatatgctgatttcaggtttctgccctttagtcctatatcatactgtgcctccaagagagcatggtaaactaattagcatggttctatcatgattctgtttctattttgaactattaataaaaatttttgcaattctcagttaccccatttagtatagaacacaataagaatggaaccattctattctaacattgtacattgagatatcgttcccaccaccatatctgtcctccatagactatatggtgtgtcattttaaggacagaggatctaaaaatgatttttaaaggtgatttacatttactcttccctttgcaaaatggtttgcatccctaataatttagacaagtacatttcttcgtgatataaattacatttcttgcctttccctggaattctgagtactttccctctgagagaacaatgtaattcttatttatttagtcactaaaataacttcaggagtatgaataagtctactaaaaagtctacaggatccatgttgtagtttgagtagatggttccataccaagtcaaggtaaaagataatttatatataatatgaaaatggctgctttaggtttatagagtaatcaatataaatcttccttataaaagggaaatttcccacttataatttatgtaatgtaaagtttttcatttcatcttcccaaatgtttttagtcccacgcagtatttatgttagtacctatgtaaaggtgaaaagtgaattttttctactggtagaactaatactatttttagcatgtaatctgctgtcatcttcctatctttataagtggctttgaacaagtgtaaatagtgtaattctcttcattatatatactaccatgatttagattaatcttaaaccacagtttgtaatccgttactccaagcttagatttttttttcagtttatagtaagagtaatttgccttatataaccaatgaaattgttgcatttagagtgaaagtgagataaaaaaataatttatagaagaatttacaaaagttatttactcagattgttttaacataccgttataatactttgtataaggaataactctaatgaagtttctggcctatttgtaggcaaaattaattgggaataggttcctctggatcttttgctttcagaaaaaaaaaagttttttctccttttccatgtcactttatcataattgctaaataaaatatttctcccatcttaatagttttagaaagtaaaaatacttcttgaataaactgtgtagcgcagaccttcccattacagttcatttctatgtatttgtttaaatacccacagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtaagatgcaaaacataaaagagcaactatataaacctttgtgttttcttcagcaaaaacactttggcttttatatcatcgtgagcccatggcttatcttgtttctcttagttctggggactatgaaggggagagtcaggtgaatacaggtgatagggagtttataataaaacatttacattactccctgcttttcaaatcattatgcacaggatggtaatttcacataggatgatgtaatatcagaattcaagttacaagactcactcaaaactccttttacactgaagtttggggaaagaaaatgtttttagttaattccatttgttttccttcattgtgccacttttaaaaatcaggttgtttgtaagattggtaaacatcaagtatgttgattgtcaaaatttgtactaaagtagaatgattttaacccttcactaaatgaaatgctacacattgaatgtaattttaaagataattttaaataaaagttaccctattggaatttggtgtggaatggcagaggtcaatgttagtgtcagctctgactttaaagacagggaattgacaagcctgtgttcacgcaaatagttagggagagagcaagaaagtaacctgacctcctgtcatccttgttttattaagggggaaagaggtgtgaatagcagggcaaatgttttgcttaactcattgattaatacctcaagccaagattcttttctgttttttaaaatcaatacataatagttgtacatatttactgtacatatttatatttagggggtacatgtaataatttaataaaagcatacaacgtgtaaggatcaaatcagagtaactgggatatccatcacctcaaacatttgtttggggaacattccaaatcttctcttttagctattttgaaatataaagtaaattattgttaactatagtcatcctgttgtgctactgaacactaaaacttatttcttctaactgtatttttgcacccgtcaaccattcccgcttcatccccatcaccactatctttcccggtcactggtaaccgccaagccaagaattttggctattttactatttagttcatgtttacttaagcagacagaggtgacaaaactggctttttttttttttttttacattaaaagctattaaaaagcacctagggggctgggtgcgatggctcacgcctgtaatcccagcactttgggaagcccaggtgggtggatcagttgaggtcaggagttcgagaccagcctggccagcatagcaaaaccccatctctactaaaattacaaaaattagccgggcatggtggtatgaatctgtattcctagctacttgggaggctggcactgagaatcacttgaacccgggaggcggaggttgcagtgagccgagatggcaccattgcactccagcctgggtgacagagcaagactttgtctcaattaaaaaaaaaaaaaaaaaaaaaaacacaagagggtttgtgagtcttaaagtgtcagatgacagaagaaaactgtgtctacctagtatttaatttccattttctgttaggggtgcccttgttttgacagggctaattgatctcattgctccttggcaattcccacagagatgatcttctgaagagtgttgcctcatacctttatttctcttaattcaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagtaagttgtatgtgtgtcattttccctgtattcatagggtatctttaaccagctgatgttttcctgattgactgctattgtgataattcaggactgaaacaatcctactaggtatctaggatctaggcaaactggaaatagagttatgagtgcttggggcaggacaagtgtaatgtaaagcaaatgtacatgtggcattattactgtcccaggacatgtttgaggatatttaacagcatatctgaggttagtaaagtctgtcgcaagcaacaaggaatcttactgtgatatcatttacataaccctattccagaaagaaaaaggagcatggtaaaactcatgtggattcagtggggacaattgtagatgaggatatctaggctgatggggtgggacatatggacccagacacaagaggtatctctttgcatggcaaggctcacccagtgtctgtggtttaagaatatgggaacaaatttgttttgtttaactgagagaagaccaagcctttaagattttataaatcagctattctcttatcctctaagcttattcctgtgtctgcgaaatacttcaggtgtccatttccccttacctcattgcagttgtttcctcactcgttttctccctccagtgtaacgttcatcatgttggctaatgtttgcttcctcaagcacagtctgactgcatcacatatctccccagtacacagattgtcttcagtatcttcccactgaccctccagtacatattctgcatgatttcagactttccagaatctgacctcacttcctctcccattgttttccttcacacactcttcattcccatccatcctttccagcatactcttagactcttggtgttcacatcaccagatacacagcagagaagtcacatcctagttactctcactttctaccttgtattactacttttcgtacccctagcttattgctattagtacaatgtaaacagggagttcacacacacatacccctggtctaagaagaataaaaaatgaaggagatttctgtttgtatagaaaacagaagtcaccttgacttttattgccaaaaagaggactgttcaaactactgcatcacaatgtaacaagattaggtagttggatccaattttaaattaactggtaaatatatttagtttctggggaaactgaagacattattactcatcataatcctaccatgctgtttaaaaaataccatgttggcagtatttgttttttagtcactttctaatatgtaatttgaaggcatttaagtggaattaaaagcataaacagatttgtatgaaacaccaacttatcctggtttataaaactaacctaatttagggtttttattattagggcattcagatttagctttaagcagtcacagcaaaatctaatcatgccacatacattccttacataaagtgggatttataattttttttcctcaacagatttacattagtttcattttcattaagggatatgtacttcctattcttgtgttctcatgctgctgcctaaaagatgggcagtcctccacctttttcttttctttttttttttttttttttttgagacgagtcttactctgtcacccaggctcaagtgcagtggtgtgatcttggctcatggcaacctctgcctccagggttcaagtgattctctgcctcagcctcccgaatagctgggattacaggcgcactccaccacacttggctaattttttgtatttttagtagagacggggttttgccatattggccaggctggtcttgaactcctgacctcaagtgatccacccactttggcctcccaaagtgctgggattacaggtgtgagccaccgcacccagccctccacccttttttcttagcccactatgtttccatactgctctggtgtctgtgacaggcagatattgcatatcagaaagtatgcattcaagttctgaccctctatagagctgtcaaacagtctctcatggttgcccttaggtcagaacgttgtgggggaaaaaaaaattgttgttgtttttacagccaacaagaatgagtttttacttattctactacactataactttgttgaaattttcagttatatgagtataaccatgtacaagaaactaaaggaaaaaaaggtgcctcccagaaaaggagtgctttacctactattaaggactagggaggtgcctcttcggtaagagcagattttaaatttgaagagcctctgatcactttggcagcatataagtcatgtctaatttattttatataaaggaataaaccacatattcagtagagaaaaataataacctttctgttgttaagtccaagacgactttctgtcagaaacttaaaaaaaaaaaaaaatcttgaagcattttaaaagctgtgaactgggcccagtttcaggctcttagtgtcatttcacaagtcaggaaactttagagacctatttgaaaatcataggtatgtaatgacttcagaatcataagcaagaattggtttagtacctttagtttaaagaatattaaggcatatgcctgtcagaggcagattttgagcatcagaagtctagaatcaagttctaggtctcgccctctgcataactgtgaacagtgtcacacatttttgtctttaggatggactgctgtgaaaaaatttacctttaaaaatcaagtgtgtaggacctaaaactgtcgtctaattgaccgtattcaaatgataaaccttgatttaaatgagcaactagtaataagttctataagaattctaacactttaattaaataataaaataatacatggcatgcatgatagaaaataatatctccactgttacattagattattcattagtctatttaaacagccaagatgcaggaagtttaaggaaagttctccaaaattctgattttatagggaattagcaataatattattgcagtagttgtttttctttatgagttcatagttttgcaaaacaaaacaaaaatgtgctttttggggggaagtagcagtatttctaactaataccctgctatttatctttcacaggcagagaatgactctaccctgcatgtacgaccaatgtaaacacatgctgtatgtttcctctgagttacacaggcttcaggtatcttatgaagagtatctctgtatgaaaaccttactgcttctctcttcaggttggtagaacaccttttcaccttatgtcaaaagcatgaaatatgaaggcctagaaacaaaggttaatttatatacatagtactaataattataccaagtctactattatttcctactagtcagatgatttttatgaatgtaaaatattagaaaggcacagtaagtgacaccaagattaataagacaaataggtatggcagaaacagagaggtatatgagctgcatagggatctctgttgataagaatctgtgtagacttttttctccttccttcctttgatctttgatcatgggaagacatggaaaaagaaagctaactacagtgattttgtccactacactgttatttggttaaaaattttagtttcctaatgagtattagcatgtatgagaaattatgggagaaaaaggcgcatcctagaaaaggtgtgcttaattactattggggattggttaacatagcatgggagctggattgtcagagattcattatctagaaaatggcaacaagagtttataaaacgaacttctgtgagattactttttagctagcaaagacaaagatgtccttcagtaggtgaagtgataaactatgatacatccagatgatggaatactattgaggactaaaaagaaataagctgtcaagccatgaaaacacatggagggacgttaaatgcatattactaagtgaaaaaagctaatctgaaagggctacatactgtgtgattctaactatataacattccataaaaggcaaaactgtgaagacagcaaaaaaaaatcagcggttgccagggtttagaaggaagggagggataaatgtgcagagcacagaggatttttagggcagtgaaaatacttcgtatgatactacaatggtggaaacatgtcattatacatttatccaaacccaaagaatgtccaccaccaagagtgaaccctcaactatggactttgggtgatgatgtgtgggacaggaggtatatgaaaaatctctgtaccttcctcccaattttgctgtgaacttaaaactgctctaaaaaaagtcttttttaaaaaaagctctatgaactagttggtattataaaccttaggccatttcaagtaaaaattacatatcaatgtttattaaatactgagttaatagctgaatacctctttcatatacaaataagtacatttgcaattttttaaaaagtcttaattccattagtaactgtggtttcatagttgccaaataactgtaagctatggatgttgcacaagactgtgattttatttaatcatttcatatctatttaaacatttccaaagcgcacattcatcttaatgttttcacactatttttgctcaacaaaaagttattttatgttaatggatataagaagtattaataatatttcagtcaaggcaagagaacccgataaagatcattgctagagacgtttaatgttacctgtagcggtacacttgttaaagaagtgattaagcagttacataaaattctgatcatagctttgattgataccatgaaggtataattcagtgcctggatactaacaactttacttgtttaaaaaaaaaaaaaaaagaatggtttcaattgtatacatcccagactaattgagctatatgatttttttcattgtaaataatatcacgagttcttcttgttaaaaaataatagaatcataaggatggaaatatataccttaagatatagacttctactatgatagactactggaataggtatataacctcccaccaaaaatgctagactaaaaaaattaagaactaagtgaaggcaggaacctacagagataagtggaactcaagccaacttgctctttgacggcatttgtagaacctggtaaattagtaagtttagtaagttggggtttttttaagtttataatcttttttaaaatgatttcaataggtttttggggaacaggtagtggtaggttacatgaataagttctttagtggtgatttctgggattttggtgcacccatcacccgagcagtgtacactgtacccaatgtgtagtctttcatccctcatcccctccccaaccctagtccacaaagtccataatatcattctcatgcctttgcatcttcatagtttagctcccacttagaagtgagaacatgcaatatttggtttcccattcctgggttacttcacttacaataatggtttccagttccatccaggttgctgcaaatgccattattttgttcctttttgtggctgagtagtattccatggtatatatataccacattttctttatccactcgttgattgatgggcatttggactggttctgtatatttagtaagtttaaaaacaagggatggaaatataaatgcagttgaaaaggcagtggatggatctaaaagcagaagaatacaattgtttttaatgattgtgtatatgtttgtgtatataaaccacaagggaaatctgtaggtactgaaaatcacaacaggaaaatggcaacaaagctatagaaactggaaaagcaatgacttttcttagatccctcagagaatggaggtcataggacaaaccaccacttcaaaatctagaagaatagacaaatacagagaaacagccaagatcagcttactgggaaaagatgccactgaagccaggaagactatggcaatttgggaaaagatgccactgaagccaggaagactatggcaattttgatgaattgctggaggctgagtgaggactagcttcagagttaaaaactcccagggacccagtcttagtgggggtttcctgcaatttcttgggtttaccccacaaaatttctaacttccagaaactccacaaggttcttatggtgaagatgcaagaaaaattccctcctttttctggtaggagtagagggaaggtaaaatttggaaatacgtagcagagtgttcacaacaaaaggcctgccctgtaaggaaaactaattcaacaggcccttatgtgacctgggggaaaggcaaatagaggattctagcccttccttagccttcttgtctcatttctgaaagtcacagcccagggattcagacccactaaaaaaaactgagatttaatcataaagattaaaaaacaattcccctccccctccccaacaccttaccaccatataaacagggctccaggataaaataacagtggattacaactgagagagctgcaagacacaagctgtttaaggagctcttaggaaacccaaaaacaacagaagaaaaagtaaataaaaacaaggaaactagaggaaactgaagcctccagtacctacaattatggcaaacattaaatacagcccagctcctagccagattagcatgaaacctcacactaaaagtctaattacttcagttttgatatatcaatcatgtccagctttcagcaaaaaaactacaaggcatgctaaaaggcaagaaaaacccacggtctgaagagacaaaacaagcatcagaagcagtcctcagatatgacacaaatatttcaattatcagatagggaatttacaatacctatgattagtaggttaaaggctccaatggaaaaaagtagacaacatgcaagaagtgatgtacgcagagagatggaaactctaaaaataaatgctaaggaatgctgtaaggaaatgcagaatgatgttgatgggctcatcagtagactgagcacagccaagcaaagagtcagtgagcttgaagatagataggtcaaaggaaattcccccaaactcaaatgcaatataaacatagtagacattaatccagctgtatcagtaattactttaaatttgaatgctctaagtacaccaatcagctatttttttaactaggaggtgaaaataaagtttgccaccagatgctcactaaaaaattattagaggatatatcccagccaggcgtggtggctcacaccggtaatcccaacactttgggaggctgaggcaggcagatcacagagtcaagagatcaagaccatcctggcttacgtggtaaaaccccatctctactagaaatacaaaacttagctgggggtggtggtgcgcgcctgtagtcccagctactcaggaggctgaggcaggagaatcacttgaacctgggacgtagaggttgcagagagccaagatagcaccactgcactccagcctagtgacagagggagactccatcttagaaaaaaaataataaaagtaatcccatctttaagaaggactgaagaataacaaaagtggtaaataatatagatacatttaaactgacatttactatgtatataaaataacaacagtaacaatttccttgagggctaaaaagtagaactaaagtaagtttcaaggatgacaactagaaatagggtatgcagggtatgcaaagtaccaaaccattgggggaagagaatacctaagaaaaacaatccaaaagaatgaaagacatgagaggagggagaaaaaaatgcataaacaagggcatgataacaggaagtaacagataaggtacattagtacagctaaattcaaacacatcagtagtttagtttcattaaatatagagatggggccaggtgtagtggctcacacctataatcccagcactttgggaggctgtgggcagatcacttgaggtcaggagttcgagaccagcctgaccaacatggcgaaaccccgactctactaaaactataaaaagccgggtgtggtggtgcatgcctgttatcctagctactcgggaggctgaggcacaagaatcatttgaacctgggagatggaggttgcagtgagccaagatcgtgccactcttctccaaactgggtgacagagggacactgtctcaaaaataaaataaatgtagagatggactgaatgctccaagctaatctgacaggattttagaaataatccaaatttatgctatttaaaaaaagctatatctgaataaagatattgaaaggctgaagtaaaaggatctactttgcatagtataacccaagacatggccaactttttctgtaaagggccagatggtaaatgttgttagctttgcacagtctctgtcacagctactaaactctgcccttgtggcaggaacatagtcattgacggtactcaaatagaacaggcatggctgtgttccaataaaactttatttacaaatacaggctgcaagtaggatttggcccataggccaaagtttgctggcccctatattgaccaaaacaaaaccgaaggagctacattattaccaagcaaaatagatgttaaggcaaaatactccttaaagcatttgttcaggaaaaataattgtaaatatatagtttcaaattacataatacaaaaattcatagaacaagaatacttagataaatctagtaaaaataatgagattttactatacctttcttacaaattaagcagacaaaaaaataaggatatggatgtacatttcatctctcttgggtcaatactgaggtgtgagatcactgggacataggttgagtgtgtgtttaaatttatttttaaaattgccaaacttttccgcaattgttaacatttaccagaaatgtatgagacttcttaagatccattctatatcctcctcagtacttggtactgtcagcctctttcatcgtaggtatactgatgattaaaaatattaagcatcttttcatgggcttattggccacctatatttcttatttggtattgtgcctcttttaatcttttgcccattttttaactgggttttaagaattgttcaaatattctcaatgtggccctttgttaaatatatgttttgcatgttttctttaagtggattacatttacagttttcttaaaaaaatgtagagatgagcaaaagtgtataattttgaagaaagcttcgtgtctttgtttactaagaaagttttgcttaatccagggttaaaaagattttctactatttgttttcttatagaaattctgtagtttcagctcacatgcttaagtatatgatgcaaggtaagggacaaggttcattttcttccccaaaatccatatctggttgctccagaacttgactctcttttccctattgagttacttggcaattttgtagaaaatcagttgtttgtatatgtgtgggtctactttcagactctttttcttacccaacgatctgtatttcttacccaatgatctgtatgcctatattcatattgataacaccctgtcttgattactgttgcattacagtaaatcttgaaatttggtaatatgaattctccaaatctgttgttcttttccaaactgttgttttggatattctagtttccttgcatttccacttccttttttttttttttttttgagatggagtctcactattgttgcccaggctggagtgcagtggcatgatcttggctcatcgcagcctcagcctccccagcagtgggattgcaggcacccaccatcatgcttggctaatttttgtatttttagtagagacggggtttcgccatgttggccaggctggtctcaaaccctgacctcaggtgatccacccacctcggcctcccaaagtgctgggattacaggcatgagccactgtgcctggtcttccacgtattttttaattagcttgacaatctctaccaaaaagtcttttggggctgggtgtggtagttcatgcctgtaattccaccactttgagaggccaaggcaggcagatcgcttaagcccaggagtttgagaccagcctgggcaaaatgtcgaaaccctgtcactacacaaaatagaaaaaattagccaggcatggtagcttgtgcctgtagtcccagctacccaggaggctgaggagggaggtcaaggctgcagtgagccatgatcatgccagtgcactctagcctgggcaacagagtgagactctgtctcaaaaacacagtctgatagaatttttattaggatagccttgaatctatagatccatttgaaaataattaacatcttaaatttccaatttctggccgggcgctatggctcacgcctgtaattccagcacgttgggaggccgaggtgggcagatcatcaagtcaggagttcgagaccagcctgaccaacatggtgaaaccctgtctctactaaaaatacaaaaaaattagccaggcgtggtggcacatgcctgtagtcccagctactcaggaggctgaggcaggagaatcgcttgaatctgggaggcagaggttgcagtaagccgagattgtgccactgtactccagcctgggcaacagagtgaggctccgtctccaaaaaaaaaaaaaaaaattccagttgttgagaaagaataggaattccagctttggaggagtggggagaccatcaaatcctctttccaaaaatactactaaaatactactgagcagagtatagttccacaaatagtcttctgtaaagagactcacagtacatatttgtctttgtaggccatatagtccctgttgcaatttctcaattctacagctataacaggaaagcagctatatacagtatgtgaatgcttgtgttctaatacaaatttatttgcaaaatcaggaaaatggcttgaaatggtttaagatctagttttctgactagatcatggtatataatcttttccatatatattttgaatttggtttgctaatattttgctgatcatttttatatctctctttatgaaggatgctgatctacaactttcttttcttgtgatatctttttctggctttgctaccagggtagtactagcctcttaaaatgagttgagaagtattttctgttttcttaaagagtttatagagtattgatcttatttattctttaaatatttgatacatgttaccagtgaagccatctgggtctgtgttttctttcagggaagatttttaattatttgcttatttgttatatagatctattcagaatttatatttttccttgacatagttttgtaatttgtgtgtttctatgaaatgagccattttgtctgagttgtctaacttgggcataaagttgtttgtaatcctttaagttttgtaggatccatagaggtgtcccctccattatagattttcataatttgtgcctgatcatctttttttcatggtcagtctagttaaaaatttatcaattttgttggtctttacaaagaaccaatttttagtttcattgaaatttttagtttcattgattttctctttttgtttcctatgtcattgattattatttcttcttttctgcttgcttttcatttaatttgttcctctttttctagtttaaggtagaagcttccattgttagttgaagaccttattttcttatatagatgtttaaagctatacattttttgtatattttcattcatttcattttctaatgtccttcatgatttttttcattgacccatgtgtattgcttaatttttatatatttggggattttccatatctcttcctattcatttctaatttaattccactgaggtaggaggtacattgaaggactctaatattgaatgactccaataagtcttctgagacttttttaggcacttgcatatggtctatcctgagtgttccatgagtgcttgaaaaaaaacttactgtgctcttgttaagtagagttttatgaacgtcagttaggtcaagttgattgatagactaattcaagttttctgtatctttgctgattttctgtctagttgttctagatcctacaactttgtctacatccttgccagagcttggtatggtttttttattatcgctatcctagagagtatgtagttgacccttgtgacttgccatgcatttaatgactgcccatgttcatagcagcattattcataatagcaaaaaaaacttttatcatatgcttttgtgcctcaagatcatatatttttcgtttttagtcactaatatggtataatggtataatatactgtttaatttctgagtaattgactagcctttcattccggggataaatcctatttggttatgatatagtatcctttttacatatagctgaattcattgtactaaaattttggtatttttgcatctaaatccatgagggatatattctatagctttggtgttatgataatatggtattatttctttcttaaacgtttggtaaaactcagcagtgaagctgtcttggtttgtttggagccttttttgtagaaaggttttcaagtacaagttcatcaaatgtttactgataatatgtttattcttgagtgagctttgttggtttacatctttgaaggaatttaactgtttccttcaaatgttgaatttattggtataaagttaagttattcataatattcccataatatccttctaatggctccagtatctctagtgttattccctttcattcccgacattggtatttaatatattcttgctttttttttttttttttaatcagtctggctaaaagtttttcagttttaccaatgttttcatagaaccagcttggtcttgattttgttgttgtttatgcatgttcttagttattcgtttctactctttatcctttccatttttcttgtgtttagggtagaagcatatataattaattgagacctttcttttctaatcaaagcttttaatgctgtaaattttctaagcactgtcttcattgcatcccacacattttgatatgctgtgttttcagtactagagatttttaattttatgataccttatttaatcatgatgccttatttaatctatagcttattaaatgtcaaattctaaacatttgggtttttctccagatatgtttgttactgacttctattttaatctcatttttgtcagacagcattcattgtatgacttaatcctcctaaatgtattcagacttgttttatgttctagattaatgttctgtgtatacttgaaaagaatgcaagttcttgggtagactgtttcagaaatgtcagtcaaatttaagtcttgtttattcttattgattctgagacaaaggtgtttataatgttagatttgtctgctatatctctgacattgccaaatatccccttggaggcaaaatctccccctcccttttgagaaccactgatctatgtagccttttttctgggactaatttagccttgcttctgagatgtggcccctaggtctctactgaatgcccggcatatttaattagatctttctttcctctatggcctcaagggatttcaccctaagtatgcacaaatttttattcagccgaagactgtacagatttctggaggcctttctttgtgtacctccttcgtttccagtagtctgacccataaattgtacagatttctggaggcctttctttgtgtacctccttcgtttccagtagtctgacccataaattgtacagatttctggaggcctttctttgtgtacctccttcgtttccagtagtctgacccataaattaaagctgctttagcctccccaaacttcaatctctttctcctcaacccagcaagattgctagaccctgggttccctttcccttcactgcagtatgataattactttcaagcacaaaggtttagaattaagatttcttactcctgggctaggtatggcttaccgtatttgtttctcttttcctagggatcataatcatgtattgcttgttgtccagttttccagtaggaggggaattccaggctgtacttacttcctgcagccaaaagaggaagtaatgttagtgatttcaatattaaaacattaaaaaaaaatttaagatggatgaaattcttttatatgcatattgaattgggcttcaccatagttatttttagaattaggactaaccggcagggaaaaaaactatacggcagggaaaaaaactataagccatcgctgttttacaattttgcaataattagattttctgtagtatagtaatgtgtaaaattaacccattgttaatatagaatgccgttatcactcctgattaagcggtcttcattttcatgttaatactgatgtcttgtaatgctttatggaatcaaacattttcatacatattcattagtctaattctaatcataatccaatgaaaaagagcaggaaagatgctcaaggaggttatattcaagtccacatggcaagtaagaaataagactactcggctgggcatggtgacttactgcctgaaatcccagcactttgggaggccaaggtgagcggaattgcttgaacctgggaggcggaagtggcagtgagctgagatcatgccaatgcactccagcctaggcaacacagcaagactctgtctcgggaaaaaaataataataataagacttctagaagctcctaaatccatagcttttcctctataccagcatcttctaaaaatgtcagcagcagtgaagtttcagtttgggaaataatgcatttcccctctctggagagtgcacagttatatctccaagaagtactgaaattcagaagtctgcctaatatgtattaaacatttagcttttctcaaactttgaccaccaaatcctttgtctcgctctaactatagttaacacagaatcagtgttcccaggagcacactgtgaaaaatgtagcactctacaaaagtcctaatctccacaggattaagtgaaaccatgattaaccctctgttccttgtccttattagtaccattttctgaagagtaatgtatccccccaaaacttttatactagtttcactaaccagaatccatgtacataaggaaggacagatatttgctccctactaagacatatctattagctacattaaaaaaagtattgcatgccgattttaaagttataattaactggtgatatcacagatattccaagatataattgctggaataaacactgttgttgaagccttctatctatctcagtactagaattaaactcaagtgcagaatggcagacaaagttaactaaaaatcactgtattatttcatttggtcctccaaatagctttgtgagctaaggaggagaaggtgtatcatcaccacttccattttatagatgagaaatcaagtgatttactcaaggttaagtcctccaattctttgttatcctgcattttctcttggctgtagtttaattaataatcctaagaaaatgcttatattttagagtgcagtaagagtacataaacaatgttaaatgcccatcttgcatgtataaaaagttatagcaagaaatctggctgggaatggtggctcacacctgtaatcctggcactttgggaggccgaggcaggaggattgcttgagcccaggagtttaagaccagcctgggcaacatagggagatcctgtctctacaaaaaaatttagccagacacagtggcttgtgtcctagctactcaggaggctgaggtgggaggatcacttgagccaaggaggtcaaggctccagtgagctatgattatgccactcagacatggtggcttgtgcctacagtcctagctactcaggaggctgaggtgggaggatcacttgagccaaggaggtcaaggctccagtgagctatgattatgccactgcactccagcctggatgacacagtgagaccctatctatctcaaaaaaaaaaaaaaaagaaaagaaaagaaaaagaaaatcctttaactgacttcatcttaaccttttagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtaagtgtcaaacataaagccaaatataagagttttctgggacaaagtatgttttgattagtgaatataattatataccagcagcgcccccacccccgcccccagtttgtggatgttggtgatagcttgagttcaacttatgaacttcagttttgtagacatttttcctaaggccaattatgaaatatcctttcacctagtcatgtgtatataaaatcaccatgttattacagaatttagtaatactgtttttaaaaagtatgattaatccattaaattagaataatgcacccttcatatattatggtactacagtgattcatgaaataattctatataattctacatacaatcaaagaaatataaaatgtgttttgtacggaagtgcttatttttcatctggggaattccagtgagattggtatattctaggccagataattttttcaaaatagaggacaacaaacatgagatgttcccactgaccaatttggaagcctgatcattaccatatcttctcttgcaggtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttgaatgctctctaaaagggaatgtaatattttaagatggtgtgtaacccggctggataaatttttggtgcctaagaaaactgcttgaatattcttatcaatgacagtgttaagtttcaaaaagagcttctaaaacgtagattatcattcctttatagaatgttatgtggttaaaaccagaaagcacatctcacacattaatctga

SEQ ID NO: 35999 - DNA, 254739 bp, Homo sapiens
gtgagggaggggccggcggcgggggcggacccctggcggtcctcctggctggggtccgcgcgctcgcggcagctccccgtggaggtcactgtccgtgccagtccctcccgctgtcccgccctctcccgctgccgccgccgccgccgccgcgcccgcctcagcgcccccactccgcgcttgggagcgaggagccgccagcgcccccgccccgccgccgccgcagcgccctcaggccgccattcgccaccgaaactttccagcgcccgcgctctctccgggactcggcggcggcggggcgggggcggcccgggggcggcgcgcggctgctccggggcgccgggccctcttcggccgccgcacggccgggactcggaggctgccggctggagggaggttcggagcgcggccgggcgcgcggcgccgccacaagttgcgctgctcgcgacgaggtgagtgcgcagggctcggcgggccgggcgcggggtccgcaaacttctgcggggaggcgggtcccgcgctgaccctccagggtccggccggcggctcggggcgcccgaacgctccacccgcccctggaactcctgtaggtgcaggtcgccaactgtccccgcggcgctcggactggggtgcggcgcgctcccaggagcctgaacaataccccgaggtggccgctccccgaagtgccggcgcgccttgcggggagagacggaggtcggcggggggctcctttgttttggggagggggaagtggccggtaagtttagggaagcgctcggcttttcctccggtgcccctttgtctgccgattcaggggcttgctgggcaaacctgcgccaccgcgggctccggggaccggggtggagggcggtggcgggatttccccgctgttggggagaagagccccattcatacccgggacgcgggccggccctcccggacccgggtggaagcgcagcctcgcggagtggggcaagcggcgggcgaggtggcgcgggccccgtgtctgctcagtttctgacgcgcagaaactgtcaaggaagtcgggagccccagtcctccgcccatctccccggcctgagcgcacggctgggctgggggcacccttggcccgtcgagggtctgcagagcgccgcccggggagagcgcagacctgttgctgctcctgggctctgacggggcgggtggggtgggtctcgcagatcctgggccccggccttgctatccagggggaccttccctaacgatgggaccggtgctcggagtggagtatggggagtgcgccttcgggagtcggcgctggccggatatgtgacaactgtgggtcgctggaggcccgcctgcgctgggatagggcctggacttcacgtgcgtcgcctgtgttccgtcagaccggggccggggctcgctccctgcaaggcctcgtgttcccccagccagctgcgttggacgttccacaaaggtagggactgacgtttattctcgagtcagtgatgttctggagcaaaacctaaaaagaaacaaaaacctaccctctattgtatttgcaactgtttctgctttgcattgtcatgtgtggtttgacctgccttttggatgttttcctctcctgaaacatcgcccagtccctggtttaacctggaaggcgagggggaaggaaggcaacctccctgctaaggttccaggcagtggctttggtgttggaagtggcacttgacgattttatgaaaagtttacaagtccttcctagaaaagatgtaattaggaaaaataaaatacagaagaacgttgagtatgacgcgtttattttaaagggtagtcctgtctcaaatgtgctgcacatttttgtggaaagccaccaagctgggtaactaatgcaaacaacaaaagttgttcatcactggatcaccggcccttaaggcgattccagcccttagtagaacacacacctgtagggcaaatatggagatttgtggtgtagtgctgccaccctcgctccccaactctcaggcattttgcccctttacctcagagaacttctctctgtcagtggttttaaagaggaaacagtttgcaaaaataactttattgtagacatacttagaagtgaatgtttcaatttctggagttttcccatcaattatatcagtaccactggttctgtacaacatcatcttagttagaagattttttttcaccttttaaggtgacgaacagaggcgggaaaatggtccctgcagagggaggccatctccagcaggtcccgagggtcaggaattcagattatccgatctactcctgctggataggagcacacctccgctagaacctgggtccggccccctcccagttttctgcagggcgtccagattccggtgctctgccccgcagcagtgccctgtgggcctcctggcttagctgatcagcacagcttctctgcccagcgaggcaggaccatcctcccactgctttcctgatgccttggatttgctttttttcctcccttaggaaaagcaaaaaaacctaatatgctacatccgagaagttgttaatctttcactaccacatgcattgaaaaatcagttccacccaggaagcaacactaaaggcatattgtaaacacttttttttttttagttggaaagataaacttttttcccccataactatttttagttagccggagactggactcgagtttttacctccggtcttgccccctccactcccgccctcactttctgtggggctcgaccacatggaccatgctggccagactggcaaacatgaaacccaccagaaccaaaagaaaagctggatatgggaaggggccgaagaagtccacatgtttctaaagggcaaagagcctaggctgaggagagacgtttcagatctccaggggagaaagacagccgttaaggagtccgccgggctgctgcctgcctggccagcgggagcctgacttcagatgcctgcgcctcccaagctggccccctcccacacagccatcgccatccagtatttagggagaatccaccgcatgcctgaaggttgcagaagtgaattggaaaccgttacaaatggaattggaacaaatttaaagttaagatggaagagagaatatgttgagttttcagaggaagtcgggtactgcttccttttcttgtctaggtttgttcttgtccgatgggatcagagagatttgagatggggcatgataggcggcgggttcaggagaaagggaagctttagaaatgaaggtagaaaagatgcttgcttattggaacagtattttcaacgttgagctctggaatgttgcagccaactaatggttctcatttgggacagttttgtcccccacttttgaagggagcatttgccaatgtctggagacatttcccttcctgcaactgttaaattagcaaacaggttgagccagctgggtgtggacctgcattttcctcgtggaggccctcttccaagtgtcagtaggaaaagggctcccagagtgtggtcctgctgcgggaccttggcccccacgtccaagtgagccccagaggtgccccaagccctgcctggtcatggggaatctgggctcccgctgaacttgggcgctggggacagctatgagggaaacctggtttgcagctagcttgccgtgcactgactggagctttgggcaaatcagtgaacttctctaacattaattttctcattgagagaggaggtgggtaggagtatatatatatatatgtaattatatatataggggtcgggtagagggagagagagatttcccaggctccttgtattaaaggagatagagttattatatttctcatttagtttttatttatttgtttattttgagacagtgcaattattatagctagctgcagcctcaaccttctgggcttaagcaattctcctgcctcagcctcctaagtagctgggagtaccaaatgcgcactaccatacctggcaatttttttatttttatttttagtagacacaggctctcactgtgttgcccaggctgctctcaaactcctgggctccagtgatccttcctccttgacctccccaagtgttgagattacaggtgtgagccactttactcagtcgaccgacatagaattattataatgcttggagcctaacatgccttttttgtttgtttgtttgttttttctgagacgaagtctctctcacagcccaggctggagtgcagtggtgcgatctcggctcactctgcctcccgggttcaagcgattctcctgcctcggcctcctgagtagctgggattacaggcatgctccaccacacccggctgatttttgtatttttagtagaggtggggtttcaccatgttggccaggctgggctcgaacttctgacctcaggcgaccctcccgcctcggcctcccaaagtgctgggcttatgggcatgagccatcgcgcccggctagcctaacatgcttatagtttcctgttttctgaagttgggaattgggtctggaaaggtatcaccatcagtcacgatggtgtctagtagtttgctttgtttttttccttatcttttccctcttacattttagggctgtatctatataattttattatttaaattaccatatggtaagtttgtctctttgggtgcattatgagtcttgacacatgcatagattggtgtgaccaccatcatcatcaggagagagaacaatctcctcagcccagagatgttcatggctctgtctcccacagttcctccacagtcaccccccccagccccgaatctggggcacccagccatctgctctgctctggaagtcttggggatcccatctgaatgtaacacatggtggaatgccttaggtgaatccatccgctcttccagtaccacctttgcctcctctctctgatgacacatgaacttcatgcctttgtgtgctttggccaaccgcttttcttagaacagcacattttgcactgtagatgttatcacaagcaaggaaaaaacagctttgctccttaatgtaagaaaccacagtggaaaaacatcaggtgtgttgttgaggctgctaaagctttgctcctttttaaaattttttaaaaatttttctggatacgtaggtgtatatatttatggggtgcattagatattttgatatagtcgtgcagtgtataatcacatcatggagaatgggggtatccattccctcaagcacttattctttgtgttacaaacaatccaattatactcttttagttatttgctcttttttcttttattttgagacggagtctcactatgtcgcccagggtagagtgcggtggcgcgatctccgcccgcaagttcaagcgattctcctcctcagcctccggagaagctgggactagaggcatgtgccaccacacctggctaatttttttgtatttttagtagagatgggtttcaccatgttggtcaagctggtctcaaactcctgacctcaggtgatccacctgcttagcctcccaaagtgctgggattacaggcgtaagccagcacgctcggcctatttatttcctctttgttctatgccagttagttcttgatgcctcattgtttcagatgggacattttctaatgtcgtgtttttgtttttgtttttttgagacagaatttcattggtgtttcccaggttggagtgcagtggcatgatctctcctcactgcaacctccgcttcccgggatcaagcaattctcctgcctcagcctcccgagtagctgggattacaggcatgcaccaccatgcccggctaattttgtatttttagtagagatggcatttcaccatgttggtcaggctggtctcgaactcctgacttcagatgatccactcgcctcggcctcccaaactactggaattacaggtgtgagcaaccatgcccgacctctgatgtccttttagaggatgttaccctcacctttattgcacagtcctaccaaaaggtacttcatatgtgaaatgtatcagaaggttatagtcatggctttagtttaaaaacaggatacatgttcattaaggacctttgccgttttcccaatgggttaatcacgtaaatataaaataggctaaaaatatcaagttgtttttgcctttgttgtagaaataaaaaaatgaattcctacatctgtgtttctatggagctgctaacctgtgttttactctgggccatatgtcgctttctgtgatctcatgacgtggcatgttttctaatataatccttgtcctggcattttggtgacttttgtcctgcctgaggtggtctacctggttgtgtgaagtcacagaacctgtgcatgtcctaccgtgtagagttaaagggctggatgagtggcctcaagccttttcctccctcccaggtgtgaagatttggtttggaagatggaccctgcttcaaggtctgggaggccatgtttttttcagactggttaaggatgacggttttatgttaactaaacattgggatcaagtgacagttgtttatgtccggtgcctagagtatcagttttcccatgattaaaataagcgatattttggtaaacattgataagttagttgcgcattttagttcagaaacccacagcgagtcagaaggcgctttgtgctgctgggcgcctctgagtgattccggggagtgcggcagttctccagccccaggagaccctgtgaaagaagcacaaacaatgctcacggcaaaactcacagtgtttattcttgacctgggtgtctgccttgaattcttgtcatttttcctatcgtggtggatgtagccggaatgctttaaagaaaacatgagagttttttctgcctgtttcccttgagcctggaaccgattatgaccccagatagcctgcacagggctctttcctttctggaacacctgcccaggctagaatatgggagtagggaggaggtgaggctctctcctgcccggtaaccttcccggccagctctccaagacgctgaaaccttccttcgggtctgttgaaactgcatccccagcaccatcatgtcggagcaagaagagaagggcatgtgtcccctttaggcttgactctttccaattagggacctgcctgttgttaggatttagagtccatgtgaatgtgcagtattgttcagtgctgcgagcatttttgcttgtctgaatttcctgatagaagggaatttggacaaaaagaagcttattgtacatggtgccattttattccttaaatcaataataacaaatactttatttatgtatttttagagatggggtcttgctctgttgccctgatcatagctcactgcagccttggctttctgggctcaagtgatccttctgcctcagcctcccaagtagctgggccgacaggcacaagtcagcatgtccagctttttttttttctttctttttttttttttttttaattttcaatttttttctagagattgggtcttgctgtgttgcctaggctggtcttgagcacctggactcaagcaatcttcctgcatcggcctcccaaagtgctgcgattacagttgtgagctactgttcctggccaacatatactttaatatggcaagaccatataaaataattttaagaggccaggtgtggtggctcatgccccccagcactttgggaggctgaggggggcagatcacgaggtcaggagatcgagaccattctagctaacacggtgaaaccccgtctctactaaaaatacaaaaaattagccaggcatggtggtgggcgcctatagtcccagctccttgggaggctgagacaggagaatggcgtgaaccatggaggtggagcttgcagtgagccaagattgcgccactgcactccagcctgggtgacagagcaagactccgtctcaaaaaaaaaaacaataattttaagaactggaggaaaattcagcaggactgagtcgtgatttcagtttctggtgcactgtgggtaattgggtaattgtcagcctggatgcttgtgctcctttagttgtcactgttaccttgtcatctatgtgaagatgagaaatgaagttgagtggagaactgtcgccaaagtctgccatgtaaaaatcggtagtgccaatgtgcaaaggtaattcccaggtgctataaaagtccaggtggcttcacagtttcagattgtatttcccgaaagcgtagagaattgatatccctgaataggaaattgacgtccctgccatttggttcatttggggaacagaataaacttgtgtccttgccttcagttcttttttcaacagaatcttatcaagcatttgaatcgtacacaactgtaatgccagctccatgttgataaaaactcaagaattcaaaattataaacttgaaaacagcaattgccaacttctgacagtagcaggagagtctggaggacctgttcagaggaagtcgggtactgtttccttttcttgtctaggtttgttcttgtccgatgggatcagagagattgagatggggcatgataggcggtgggttcaggagaaagggaagctttagaaatgaaggtagaaaagatgctttcttattggaacagtgttttcaacgttgagctctggaatgttgcagccaactaatggttctcatttgggacagttctgtcccccacctttgaagggggtttggtttaattcccaatttgattatgaagaaaataccagattcagcttgcattttcaagacacagtggttctatgtcaacttcagccatttccagggatctgtcttaggatacttcaaaaagcctaacctttgagatgcactcagctcataagttcgtgaaaataagaatgaataatcttccctgtccagtacatgacagaaattattgtagaccagatgagagcaaggagagatacttgttgatattacatgtcacgggatgctctgttaaattttatgggactctgagtgtaattcctttaagccagtagtctctaaatttgggggaaggacaggggacagaaatgacttgtttcagattttaattcccaaaagggtcttagtgagtttcatgccctctggcaggtgcacagcaagatttattgggatgcaggaagaaattatgaaaatgtccattaagaaaatctctaatacttgtaaaaaatatatttcttgtccatgaaatgcatgttacttgagtattttatatatttaataaattacatgagttaggagcaccttctgaaaacttttttgctgaaaaggatatatgatgaaagaaacatttatgatgtaggtccccaaaggctggaagagggggtgataccaacgtccctgcctgcaggtaggacacagttgtactcccctttcctctgacttcagctactaaggtatgtgtgcgtttgcacgcacatgtatgtgcgttaagtaactttgagatccaccagcttaaggactggacatcgttccagaggtacaggtattagtgatttgacttagggaagaaagaatatgcaataacagggaaccatgcacatactggatctattgtattttgcgtgttgtttttaaagctgaaaaaatgcgcttgtttcggaactagatgacagtacctgtttgcaggtccacaaggaaaccttggaacaatgctatgctttttaagcgttttatgactgcattgttttcataatcactgaattctgtttataaatcagctgatttcattgacggatgccctcagggctctggagaattaggcgttttgctgcagaaatggttcagaatttcaaagacatcaacgtgagattgtactggaattgagttgtgataaaagtcctagggtgctttaaatctttaaatctggttatttgtttgtttgttttttgaggcagagtctcactctgtcgcctaggctagagtgtagtggcgtgatctcagctcactgcaacctccgcctcctgggttcaagcaattctcctgcctcagcctcccgagttgctgggattacaggcgcctgccactgcacccggctaatttttgtatttttagtagagacggggttttgccatgttggccaggctggtctcgaactcctgacctcaggtgatccgcccaccttggtctcccaaagtggtgggattaccggcgtgagccactgtgacctgctgtttttgtttttgagacatatttcatctatcatggttattaagtgttttgtttttttgcatttctcattggtgttttttgtttgtttgtttgtttttttgagatggagtctggctctgtcgcccaggctggagtgctcagctcactgcaacgtctgcctcccaagtttaagcaattctcctgcctcagcatcccgagtagctgggattacaggtgcccaccaccaccacgcctggctaattgttttatttttagtagagatgtggtttcaccatgttggccaggctggtttcgaactcctgacctcaagtgatctgcctgcctcggcctcccaaagtgctggaattacaggcgtgaaccaccacgcctggcctcattaggttttttttttttttctgagttgctgctacactactggtgttacagagtgaataaacataaaaattatattcacaactcagaccacattgtgggctgtggaggtgagaaataggaatcatctctaaatttaaggtcttctggctgagctcatttgcttagaatggctgaaggtttggttttcatgagatgaaatgccaacctcaagtggttctgggtttccagaccagtttttagtttgtttaacttgagagaattgatatgtcagctttagtttttgtgtgtaatttttggtgtttgcatctgttttcttctttgtgaatattgaattcgcaacataactttgttatatgaaatgatgctcatacacttgcgcagtgcattagaaagcctgccaggagcagtacttgtagatttccgtgtaccagcaggatgcctaatgccgaccatgattaatgctcatcagaatctatgtagacctccatttgtcctttgataagctgaaatatttgtgtctactttttaaaaaacctgttgcttctctttatggtaatactcagaaggcactcactgtgaagagaggagaaacaggaagtagaattttttactatctagattgatgcacctatctcccctctccagagaccaatgcatttaggccccagtaagaaatttagttgtaatgaaccataaagcagatgcagagtatatttgggaatataccttatctgactccacagcccaacccctttaagaggaaagagatggcacaatatattttgctttaagccttagactggtcttgacttcatattggaaccactgaattgcttcagctgtgaactggaatcctctcctgtctttgttgttgagtgatgacactcttaattaatcatttgcttatttgccatccaaatcaccctatataatctttcagaagtgtatctcagagaatgaccctaagtcggctgacctctgaagcctgtaccagaattgactttatttcttaagcgcacacttcctgtgctttcaaggggcagctgtctaggtttagtttctgggagtttgaggcacagaggtatgtaggggaatgggaaggccaaatggtaaaagcccctgggacgtggaatctgtgagtacactaaccttgaaagagattatgaaaacaaactttagagcattgttgaagcaccatctacataatttatatcaatgaagacagtaacttattaggaagacaggattattaaaattaaccattttcatctttctacaaaaataaaaatcaaatcaattttagttcagataattgtatgtgaagctttataagtgaaaatttgaagttagcaaaattatataaccttagttaattatattagtgtactcaaactaaatatagaataagattagctcatggaaacattgcatttttatctcagtcagtactgctcatatccacccagtagttagtttctagttacgttttgtaattttttgaatatcctggacatggttttagaaaagttagttgaaacaagatattgtatgctttcattatttcccagttcatctttaagcataataaaaacacagagtaagttgtcctttttgaattttctttcctttctaatatgtgtctggcacaacagaggaccaagcccagggatcattaatcccatttttctgcatggcgtttgctgtgagagaagtttgggctggattcgtagtttgctatctaagagtaaatgttcaaccttctctaatttcctgttttgtttgcttttccattcagtgttctatatttggacaacaaatatatttttctgtatgggtttctggtggcccagatgttcattggagtggaaattctttctgtccacaccactgagttgggcagttactggtgtttggctttctctatctcttggagttgacttagatacattgtgtattcaggttgggcactcatcccctttgcaagctctattactttgttccatttggctttgccataaatgtttgcccttggcttgccaagacgtcagctttaagagatatgtcatttaacttagaactcttgagtctgacttaaaattaagtcagttttcttaaacattgttattgaggtataaatgacatgccacaaaagtcacctctttgaggtgtaccattcagggatttttggtaaatttactgggttgtgtagagatcaccatgatgcagttttagaacattttcaattcccaataagatcgctcctactcggttctcacccatttctgctcccacctccagccacgggccaccatgaatatccttcgtgtctctatagattccccttttgtggatattttagagttgtgcttccaagaatgagtatctctgtgcttggtcgaacttcccggatggtgagacctgatttagtgactttgccttccgccccttcatccccaggagaggaaggtggggaaaggggaaagacggcaagtatagtagtataacaggcatcgtgcctcagtttcctcatctgtaaaatcaggataaccatggactagtttcaggctctaaatgtgaaactctgtaggaagtaattagctgggaatctggcatagaggaggagctcattgtttgcgtgttaacagtgggaaatagttaaggaggtgggaaaagagctacctgtagaaaggtggcctaagtccctggagagctgagcacaggaccccagggcacacacccccttatgcttcccctgtctttcatcttgaaagcacctgcctgtgaacctcaggcttggagggaatctggatgttttcccaggatctacctctgctctatggtcctcaatccaaggtagttttgaaaccgcctttgcaaaaattatatcaatgagaaaattataacagtatgttaagctaacccatcccccatcttgcctttcccttaatattcttgggctattgggccaggtgaactttggaggacttttaggctacggtttaaatgataataggccttgtcccaaactcaaaacttgccccaaactgtaacactaatgggaggccatcaggatgggggaggagaggagcctgattgctgctaaggcaaagacatgaaccattgccagattgtcaaatacgcagattcccagttactcccgcagataacatcactgttgtagaacctaagattggccttttgagatatcttttcaggtttttaaaattttcttttctctgaactacctttggggagattctagatcttttaaaaattccttaccaactctttggagatacctcctgcgttcatggttaatccatccccttagttaaggcttattgattgcacataggaagttccctttagtaaaaggttcaaaagctagaaatgtcctggctgaaatccggtaaaaagagattttaaaatgatttttcttttgagagctctgtagttagaaatcgacttaattaaagctgatatgtgtacagatactgttttaaagcccctgttctccctctgaaagcttctgtcaatggacttctgtcttgattcttcattcctgtctttctgtgtattcttctctgttatgtagtgtttatataaaacagctctaaataattggcgtaggccaggcgcagtggctcatgcctataatcctagcactttgggaggccagggcgaggtcaggagttcgagaccagcctgaccaacatggtgaaaccccatctctactaaaaatacaaaaattagccgggtgtggtagcacacgcctgtaatcccagctactcaggaggctgaggcaagagaatcgcttgaacctgggaggcggaggttgcagtgagctgagatcacgccactgcactccagtctgggcaactgagtgagactctgtctcaaaaataaaataaaataaaattggcttaaagaaaaataagcacttaaacattgtcagaaaaatggaaactttaatggcttttacatcacatgactctgatctttcaaaaataaggacagtttaaagattatttgtaaagtaaaataaaaatgtcttcaaagttaacacactttgtctaaattaggcaggtcagatactctttgctggatgttttaaggtcataaactgcttctgtgacttttaataattgtttgacttgtctgtcttacagccattagattctaggtaaggtctggggacacatggagttagccggctcccctggctaggctgggaagaatcatgggttctgtagttttatacatggttaaaattgcttatttaccaggtttttcaccaaaaataaaagttgctgaaagttaagattgtaacacgtataattgagactactggagaaacagttttacatgcaaggcgtagaaggaaagtagaatgtgtgtgtgtgtgtgtgtgtgtgtgtttgagatggagttttgctcttgttgcccaggctggagtgcaatggcatgatctcggctcaccgcaacctccgcctcccgggttcaagcgattcttctgcttcagcctccccccggcgtagctgagattaaggacatgcgccaccacctccggctaattttgtatttttagtagagacagggtttctccatgttggtcaagctggtctcgaactcctgacctcaggtgatctacccgcctcggcctcccaaagtgctgggattataggcgtgagccactgcacctggcgggaaagtagaatgtgtcttgtgggaggctataagaaagcatgggaatatggtttttgtaaaagggaatataattttgtctggttcggaggattttaaggatcatcttaaaagagtaatgggacaaaactgaaagtttaagcaagttgaaaaaggtttgtaaagggttcatcttgtaaaggaagttctgtgggtatgagcaagttggctaagacttgaaggggattatttagtttttctgtaggttgaatattttttgtttgacttttgaatgaatgacagaaaaacgaggagagaggagcctcatactgtctttattttgtcctgtttggaaagttgagtttcccctctatcagtgagtgaagatttttgccttttaaaaattcttgagttattatggctaaataaatgacttctagtgacttgggattttattttgtaatatcaagggtctaaacatttgatatttgacaaaactttccaaagtcaaaatctaaattaagccacccccccccccgcccttattttaatctggttaaccttccagatattaaatactgtaaagtccaaaagagacatatttggcttatttgatatattaaaactataacagtaagcattgtcaggtatgcaatagtgtttggctttctttggactgtatttgtatgaatgtgttgttagtatgtgtttcagaattgtataagatttcctgtaattctgatatgttttagtatatgttatcagtaataattatgattgttaagttattgtatgccacagagatgatcagaccttaactgtggctgttctgaaacttttgtcatccacaattgttttactttggttattttcagggtggttttataatcagctataggactgtgacagttttctgataactttggagattgtgacattaaaatagacgaaaaagcttccaaggctcccattaagagctaatgtattcatggatatcgagcagaacaggagttaattacatggactgaagtaatggaagaccgaaataaactttttctggcttttcgtttgaaacattgctcattcttttgtttttcagagtccagaaaaccttttttttcttttgagctatttatagcttttaacaattggataaagtatgctcttgtgaacaaaatctgaagcacatttctctctctacctgatttctctagaatttgaaaactgtttgcaagtatacttaatttatgatgttatagttgtttgttaaatacaaatctgttttcttttgtagcaggacacaattggagacactggttattttaccaaagctttgattggaatggcatactttcagattgctttaaggaatcaaagttgacttacagagccaataaaagccccttgggtaagctggcctcataccttgtctacacagtccctggacaggttcctaagtaaagaatgtcactttctgacaggtccaggagctccaagttatcttgagcccttgaggtgaggaattcacccaattaatacaagtatttgcaggcacagataaatccgtggctgggctaaatgctttgaagtctaatgtgagatttcttagggaataaagttgcagcaaagccaattttaaaaaggagcatatatggcaaataattgttctagctgaccttatgcaaacactcgggccaggtatagtaagaataaaacttattttgcacataaattagtcctaatgtgatttgtctttagtaaaaatagggactggagagagaaattatgtttcagaaaaaaactatagaacacctgttgttagaatctagtcttgttcactatttttgaatttttattattttctgtcatttggactgaatcgtgaattctttctggactacaagtcccaaactaatgctttcaaatttttctttcatttctaacttggcctcaataaaattgctactacctctttcctgaggtcctataagctgaagcttattatgagagaaaaacatgtcagattgccaccaccttcctcgtctataactaaagatgttttgagtctaatgtctggataaattgtgcccagtgttaatctttgttttttttccgtgtctatggaaatgcctcttacagaagcttagcccatctgcagtgccacctcctgatatgggaaacagctgtttaactgatctagtcttaggacttggacactgactaaaaagatatgggacaatatatttaaattcactctttcctgtttatcccagtctctctttctaacaacatatagtctactgttgacttaagtgttgtactagaactgtgagtaagaacattaacatctttgtcatacacccgtgagtacatgcaggtagctgcacggtggtgagctcactcctattcccctgggaccaacccctgcaactatgccccctgtcagcaggaagaagccagagtgatggtcaccctttttctatctctatagccagcaccttaagaataaggtgtatgaaagccaaagggggtattgaaaccacctttgcaaaagttatatcagtgagagaatgatgacagtgaaagagatctgagctaatccaccccccatcttgcctttctcttaattattcatttcccttaattattgcatttcccttagttattccatctcccatgtggtgtggctggccttgtgtctgttaaactctttctctactaaaatgcccatggtctttatgcagccggcaggaagaacccctcaggcggttacagttttgctcccaggggacagttttggttgttataaatgaggaaggtgtgctcttggcatctagcaggtagaggccagggctggcctcctgaagtgcagaggaaggtcccctcctctttcaagagagttatccagccccaaaaggtcagcattgcagaaattaagaaaccctgacttagaagctttgcacctcgtggtagctgtaaatgaggtatttacatcctccatgaagacgtaaggaagttgaaggaataaaaatctcatggggctttgaaagcaatgcaagcatcttttagttttcatacattccatggaagtagggatttttttctaaagcaaaaagaccaacaagactttggagctcagtttagaagaaaaaagtgactttcaaaccctttagaagtattcatttacaaatgaacaatgaaatgactgtgtagatggagaaaccctgagcgccccttggctttgatctggtggtcacgttcatccgtgtctgttccctgaagaaccagtgcccacatttgcctgccttctttacctaactccccccaacaagagctgaccctcctcccatcttctcgcctggttggtctttttcctccctccccctgaagcctgcctgcctctgctttccaccctccgacaagccctgatctgtgctctgaacaaactcctatgcgggtctctttgaagtctttttgcctgcccctaagtgcatccctcccacccccacccaggtgatactgaatctatgtgaatttgtggagttctcccttccttcccctctggcagaatcaccaggattcagtctagagtacaacattatagatgttttctagcacttttcagctgtccatacgctaatatgtagtcttgggtctttatccgaatggagtcctattatatttgtttcacaccatctgctttccttatttttgtatctttactgaggtatattgaagtacagtaagctagacttgtatgaagtgtgcagttttaatctgttttttcttttttatttctttgtttgtttacatacattttttagagacaaggtctcactatgttgcccaggctggtctcaatctcctgggctcaagcaatcttcctgcctcagcctcctgagtagttgggactataggcgcatgccaccacacccggttaattttttattttttgtagagatgagggctccctatgttgcccaggctggtctcaaactcctgggctcaagtgatcctcctgccttggccttccaaagtgctaggattactacgggtgtgagccaccgtgcctggctcgttttttcatacacacacacacacacacccatatttgtgaaaccagcaccacagtcaaagaatatttccatcactctccaaagtttacttgtgcttttttgtaatgtctctccccctccctctacccctttcccaggcagccattggtgggcagtctgtgactattgcattttctagcaatttatattactgaaatcatatggtatgtactcattattttgcctggcgtctctccctcagcatcatgattttggggcttcatgttgttgcacatgtcactaactcattcctctattgctgcgtaggattccttcctgtatggatgcactatggtttgtgtatccattcaccagttgttgaatgtttgggttgtttgttttttattgtgacaattatgaataatgctgctgtaaatgtttacatggctgtacagtggttctcaaacttcatcatgcatcggaaccacctgcagagcttgttaaaacacagagcatccaggcacggtggctcatgcctggaattccagcaccttggaaggctgaggcaggaggatagcttgaaccgagaagttcgagaccagcctgggcaatgtagagagaccctggcactaaaaaaaaaaaaaaaaaaaaaaaaattagccaggtattgtgtgcacttgtagtcccagcttctcgagaggctgcagtgggacaatcacttgagtccaggagtttgaggctgcagtgagctgtgattgtgccactgcactccagcctgggtgatagagcacaagaccctgttgcataaatactccccccaaaaccccagaaaaaccaacacacagagtggcaggccccatccccagagtttgtgattcattgaattaggggctgggttaagactctgcctttctaatgggctctcagctgatgctggtgccaatggttcaaggaccacatagacttcgagggctgctgccttaaaggaagtctttgtaaattatgatagttaatcgtttgttagttgttccaggtatttctcttctagaccattccttgccatgtaatgttgcttatggtttgaagcatcaagctcgcatttttgtgtagtcgaacatgtcagtcttttctttgggcttctgggcatggcttccttccagcaaggggcagataccaagaataacttggagtaggtgaggcaggttttgatgttagcaaaactcaaaccatgacactcccccaaatgggagtctgccctcattgggcctaattgtgccctctgctgcagatgctgggatggccttctgatgggatggccgggctgtgttgtcagcacccgcccacatgagacgagtttgtagctgtgcctggtgccaagagctctgaggtgctactatgccccctggaacctttgggcaaagcatagctagtcatcaggcttgcctttcacaggcaaaccaaatccatcctttcttcatccccctgccctgccaaaatcaaccagtctcaaatcaattcacgaaagggggccaatttgcctttcgggtgtctgatctaacaagccttggagcagctaggaagctaccagaagatgtgtatgatcaatgtatttgttatttattttattttatttttttaagtttggggaaaggtaatacttttggtcaaccatctgaagggactccctcctctaggccagggcactccatagttaacctgaaaaactggttcagggcatgacaggaagggggtttgaacatgcttcattatgccctcctcccttttggaattcatgaacagccgacagcatttaacacagaccttaagtctgataagaaacagttacaatctattttctctgaagcctgctacctggaggcatcatctgcgtgataaaacctaggtctctacaaccccttatggtacctggacatttttttctattgataatagcttttttttttttattattgagacaagtgctgttgcccaggttggagtgtgatggcatgatcacagctcactgtagccttgacctcctgggctcaagcgatcctcccacctccgcctctctagcagctaggactacaggtgtgtgccaccacacctggttaatttttgtattttttgtaaagacggtgttttgccatgttgcctaggctggtctcgagctcctggactcaagcaatctgcctgccttggcctctcagagtacagcgattataagcatgagctaccaggccttgccgataataactctttcaaccagttgccaatcagaagaattttatcccagaacacacaccccccccccacgcccccgccgcctcaagtcttcccacctttctggaccaaaccaatctatatcttaaatgtattttgatatctcatgtctccctaaaatgtataaaaccaagctatgccccaaccgccttgggtacatgttctcaggatctcctgagggccatgtcacgggccatggtcactcatattcagctcagaataaatctcttcaaatgttttgcagtttgacttttttcattgacagagagcagctttaaattactgtggactctttgttgcaaaagcatcttcttgaatttgataataaagccctactcttccagtttgtccctgagtgcattctgcaggtacctccggtcaccgcttcttatctttgctgttgacctcagttcattcctttcagattcttcactcaggagaagtcgtggaacagattcctggaggattccaggctctgtaaggaggcttatctccttaggatggttaaattttggatttgcagtgacttgtaatcattggctaatatcctagtttcttcttctcttttttaatgacaactttactgagcatacacacaactcattcctctaaagtgtgtaattcaggaatttcctagtatttttacaaagttgcacaaccatcaccactgtctaatttttgaacattttcatcactcccaaaggagaccctgtacctgttaagacatcactgccccttccccttctccccagcccccctggcaaccctgaatctggtttctgcctctatggatttatctattctggacatttcatagatacagaatcatgtgatgtgtgaccttttgcgcctggattcttacttcatatttctgagtttcatccatgttgtagtatgtgttgttctagtttcttgtaaatgttctgtcaaaaccccaggtgattaaggaaggtggaacaatgttctgagataagtcagccagagacacaggctgctcctccctccaattacatttaaaatggaaaatcgttcacaaatggaacattgttcataaaattgtttatagttcagcttctattctagcatgaacggtaattttctctttcgcatttgctgtagttcctccaaatttctcccactttcctatacctaaaggtcaacgtagaaaacaattttcgtcagctagagctgggcctgcaggtctctcttgtgttgcatcttttgggtggagtcagaaggtcctttcttggtgtaagagttaggaagcttgcatttcccaaaggggttgtgtggtgttccttccagagctgaggttgtgggattccaagcagcaagacttaggctgttttctacggcgtccccaaagtcacaaccctgactgatgcaggaacagaatcataaggttgtttacttttctgaatttatcaaaccttttgtctgtgtttgaccaaaattacttttcccgggttgggttggagaatatggagggtgattttctgaaaccattcatgggacatgattttctggggcatctgtacctgcaatgaagggcttactgataagactgaaggccattgtactttactggttggtgttataattgatcatattcatttcttgtcctactgtgacaagtgactgcacatttactggcttaaacaaaaactattatcttacggttctgaaggccagaagtctgaaatgggtctcactgtgctaaaatcaaggtttagcagagccacaactttcctggaagctctaggggagaattggcttccttgccttttccagctcctggagactggccgcattcctgagcttgtggccccttcctccatctgcagaggagcagcgtagcacctctctgactgtccttccataggcatatctctctgagaccatagctgggaaaggctgtccacttttccgggctcctgtgattacattgggcccatccggaagatccagaataatccccacatctcaagagacttaatttaatcacatttgtaaagtcccttttaccatataaggaaacatattctcaggtcccagggattcaggcatgagcatctttgggggccattattctgcctactacattgtcagtcttcaaggacagacttacttcctttgtttctgtctcttaatttgctcctctgaagcctgcaagattcataggcttatgtaacgtttgtgttttgtctctcgaataattgagaaatctggtactgttgagccatttggtttgtattgctcactcactgagtcgattgattggttggttgattgagtgattaatagagacagtctcattttgttgcccaggctggtctcaaactcctggtctcaagcgatcctccctccttggcctcccaaagtgctgggattgcaggtttgagccaccatgcttgccctcagtattgattccctctgaatgagccaggatttgctttccattttggagagcccctagattgctgaacagctcagagacacacttgtgtattgaggtcctctttcctgccactcttggttttggactttatcagggactctgccagagctacttttctggacttggagtctcagagtctgtgtcagctgtgggtaaggaatgagaccaccatgaagcaagcagaggtagcgggtggggcctggcttccaggactttgcagatgctgtgtgtggatttctggggcctgaatcaagagcccctgggtttgtggcttcacagaatggtggaggaagactggtggagttaagggacagaagactcaacaataattagcttgttaatcagcattttggctcaaaaatagtttgggagtatactggtcagctttctgccatgctaatgttgcataacaaacagcccccaaattcagaggcttaaatcgtttctttcttgctcactagtcatggttagctgtgtctctcctgggcttatatgggaataggaaggcctggtcaggttctgggctaggcttagggttgaaatgatgtgtctcctcatcaggggaccctggggcatgttgtttgtgcctctcccatcaggtataggaagccaagataaatcatgcaggcacatttaaagtctctgtttgtcactacccctaacatcccattgaccaaaacaagtcccatggtgaggtccagcctccacgggttggggagggctattctagtctgaaagccctgaaaagtcacatggcaaagggagcagccatagacttccactatgggaggatggaagagttagcattgcagtgcctctgccatgtttgtgggtggaagggaaggtgatccctgtggaagagactgtggatacatccagtcataccctagaaaatcagctctataggtggatttttgaagcactgtgtgcttgttatctttttattattactttatttttgagacaggatctcactgtcacccaaactcgagtgcaatggtgagatcatggctcactggtgcttctttcttctgggctcaagtctcctcccgcctcagcctcccaagtagctgggaatacaggtgcacactcaccacattcagctactttttaaacattttttttgtagagacagagtctcatcatgttgtccagactagtcttgaactcctgggctcaagcagtcctcccacctcggcctcccaaagtgcagggattacaggtgtgagccactgcacctagccagggtgcttgttaaacctgcagcttccttgattccatcttagagccctgttctcacctgaggagaggggattgtgccccttggggaacatttgacaatgtcgggaaacacttttgcgtttcacagctgggtgggggttgctcctggcatcttgtgggcagaccccaggggttccactaagcactgtaatgtgcacaggacagcccccctcaaagaattatctggcccaacaaatgtcagttctgctgaggccaagaaaccctgcacaaacaggcaattttaggtgattttcatgcactttatagtttgagaaccatgtcttgcaagactgttccaactgggaaggggaattggtgattctttccatataagtagacacggacacatctaggaaggaaggtttgatatctcgcagatagttgtgtggagaggcgaattcaaacccaagggtcttagttagatctattacttctgtaattaaaaaatatgttctgctcatattgtattaattctttgttgtattaagtatttactcttgctgtttattagtagcttaataaatggaccgtttatttggtgtgggaagaaatctatgttttattagatttctattatgagcttattttttttctaagtggccttttgccagctgtttcttctgtcctgttattcctgctcaccagcaagattataaattcttaaaaaatttgtttttaattttttttttgagaggggatctcactctatcacccaggctggagtgcagtggctcaatcatagctcattgcagccttgaacttctgggctaaagcaatcctcctgcctcagcctcttgagtagcttgggactataggtgcatgccaccatgctctgctagtttttaaattgtttttgtagagatggggtctcactgttgttgcgcaggctggtcttgaactctagggctcaagcaatcctcctgcctaggccttccaaagtattgggattacaggtgtgtgccactgcaccaccgcatcaccgcacttggccagtatatttatatatatatatatatatatatatatatatattttttttttttttttctttgagacagagtctcactgtgtcatgcaggctggagtgtagtggcatgatctcggctcactgcagcctcgacctcccaggctcaagtgattttcccgcctcagccacccgagtagctgagactacaggtgcataccaccacacccagctagtggccagtaagttcttaatagcagtgatcacgctttatattttgtttctactctgcacagtactcagcatacgataatgatcagtcagttgctaatggtatcaattgcaatgtgagttgcgctctgtggttaaagactcatttatgaggtatccgtggaccagccttttatactttgctataaatcctgtttctaggcttttggggctgaatggttggcatattgatgctcggtttctgtgtggcaattaggagaaaaggtccttgtcactggcaagctgacagcctcctttcttctcctaccctcaagttgttttggtgattgaaatgtttcagatattaaaaaaaaatcaagaattgcttgctgataggacaacagaagtacagttcagggagttaaagcttctccattccccacctcaattgtacacagcaagcatggacagatttccttgtagaaagcatgcaagcagcatttctatggaggatgctgtgtcacctgaaatttgctatgctcagatcagccaagtattgcctctgggggctaccagcaagttatagaaataactttgttatgaaatacttctttaagggggtgttagtattgattcactgaagtggttctccttgtgtacatggagtagttgtgagacgaaggtttcttttcttcctggctccccatgtgggaaggacgcttagtggtttgtgggatgcagggagaggaacagagtccatccttcagttgctctttttactaatttattaacttgcctctcatccccttggctgttaagacactaagctggtgtgtctgacaagcagatgacctaaaaattcacgcgtagtaaaagggaagatgaaaatagaagtatatgaactaaattaggaggaggacttggcttcattaaaaaaatgagaaagccatgttgtgctttttttaactgccacttttccaagtgcaggactaacagtttcagatgtcattatgctaccagtcttggtaatttctaatcatgttttgtctaaagaatatttacattaaaatgagccagcctctttaaagtcacattttagtagtgagaaaaccaatgtccgtttttggaaagggagcccttacctcagctggtgtgagcgttttgtggaggtctgcggtgtttgtgacttgtgccagaggccttgagctagaggcaacataagaaggaatcaaacttccctttctgttcggtatgcctctgtaccaagacgttttgttgattgattcatggcacggtgatacagggtgcatggtatcagatgcagggagtggaatattgttgagattggggctagagggtgtgtgtgtgtgtgtgtgtgtgtgtgtgtgtgtgtgtgtgtgtgtgtgtgtgtgtgtgtaggggaggaaggaatggaaggatgaaaccatttgggaatgtgctggaagacatgcttttgaggacaagcaatgcgattttggcattggctgggtttctgagccagtgatgaatgtagtgcattgctatgtgactgggagtgtgatagagagatattccgctggttatttccctccacctgcttcttatcagtgccatagggcagagtctcaattccacttgccagaatgctttctaggaactctttatgctcaatggaggtgatgttttcccacttgctatgctgtgccttagggaacaggaactggtattatcacataagcaatctctaagtcccttggaagattgtctcattcatcaagagggagaggattctgattttcctgcctggctcctccaggaagtctaacttcttgcaggggacctgttctctcggcccacttgtacagcatgtataaaaggaaatgaagacttttggggatttgttgattcacttgtttggaaattggggttatgtaagcccaatttgagttccaggactcatctatgattgcctggattaaatcaaaggacacccatgtaggctggacgtgatggctcatgcctataacccaagcactttgggaagctgaggcgggcggattgcttggacccgtgagttggagaccagcctgggcaagatggtgacattccatctctactaaaaatacagaaaattagccaggcgtggtggtatgttcctggtcccagctacttgggaggctggggtgggaggatcacctgaacctgggaagtcgaggctgcagtgagctgatatcctgagatcatgccactgcacttcagcctgggcaactggagtgagatcttgtctcaaaaacaaaacaaaacaaaaaaaaccaaaaaacaacctgcgtaattgtagatttttgttgttgtttgatatactgtctcttttcctggaaagaaccctctcgtgggaacagaaatgttgaatttagtcctgatgctgtccctaaccaccccgtgacactggtcccaggaaaatataggaattgtctctctttttctgtcatctcagagcttgagacaaatgttctctgaggttgttttagcaccacactgtgattcatcttcgagactgttcacagcccttgatctgaattgatggagctgtgggggatcataccgccactgccagtgctgagagctgcatgtggtgcggtccagtggctacagcgttgtctttgggatcttcacttggcaccacagcggatttgtataattattatgttgactggaacttagagtgactcaactgccttgaacaggaaccaagaaagagaggaaccaaattccagaagagaatttgccagaacattccagcatattccatactctagggttgtcttatagggtctgagggtacttcttggttatctactcatgtgcgtctgacataattaaaggccgacttagaccctatcagagaaaatcaagttcagacacttagtctaaatggaagtaaggaaaacgattacctttatctcattatcttagttctctttggaagatatataagcttgaaccatggtgacaggtgttgcctttaaacatggtgacaggtgttttcctttaaagtccttggcaaatcaactcatagacttcttcaacttcaaaaaaaaagtttttttaaaaaatattttaaaaatatttaacttgaggatcttcattgaaaattggtcatctttcgtgaatttgcttaagtaggctttgatctctttttaaaggattccttcctgcctgatacatttggtccttttagaattcgggctagaacaattctccatgaaggtggacgtgttaaaatctatttggttcattgttaggatcactcacattacaagagaaatttcggtcttgagtttttgtttttgcttatttgctttcttggaaatgtttccacatcaggtcttagaggagttgtaaaacaggaaggaggagttgacatgctgtttcataaccaatgcttgcttctcgccttggatactaacattttttccatccatttcccacataaaacatggagacaaacaccagagctgctcctgagaggtgctgagtcataggaattgaagggggctgttgggccctcgtgtgtgggatgggctcaagagctatcagtctacagagggaaaggttcatctctgtccctcattgcctgcagtttctctttggccctggctttttccgttcacagctgccctcgacgttcattttaatcaaatttcacctgcataaaagggctatgggcagagagtcttctctgtgatggagcgcagctatcctacaagtatgtagccctgatttagtagagaagaggcaggaattgtcgagggcggaggagcaggagaaatggtgcacaagggagaggggataatgacaggtcattcagggatgtctacggaatgtgaaaatgcagcaagatgggtttcggtttctttttttttaggtccgacagagattcctgggatagctgcatcttcatgttgtacacgcatacacttgattcccattattcactggagctatgttctgtaaagtcgctgagactttatagaaagcatcaccccagggaaaatacacagtgaggcttctgcgaacctctggtcacaatgttgttgtcaagcagtcagtgcataactttgttgtatgtatttctattgtgtgtttctgttggttcctttacattgcactcacgccaacagcactgtgactcacgcctggccgaacctcatctaacgcacgtattttccccataagacgcatcccagccttgtgcttcaggacatgagacagcactgcagcatctgggggccattttaagcagcaaagtcacccagaaactacaacatttcaaaaaactggcactgtgaatagactgcgaaaaggacacttgtttacggagtgagagccttgttcaccctcagctgggaacatgtgcatttggtgacacagccacacgctgcatgtttgagaatgaccatgaaagcgctgcaggtactgattttggagctacaaataaatgttagccaataggcaaattcacagacacggaatccgtaaataacaaggcttggctgtgtgtgtatacatagtgtagtgttgatagtgtgtatacacaatacacattgatattttgggagagattttgaagaagtcaccatgaaagccagtgtgtccgtttggccctctggaaagcgtgcggtgaggaggagtcagggtacaagtgtttaaattggggacatggcctgaggagatgaaagagaggtggggactgagtagggaaagctccacaccacaatgcataactgataaggttttggccaacaagccagagaaccctagagcaaagagtgccccttgcttacagccagagggccttgctcagtgaatatagggggctaggagtggggaggcatctccaaaggagcatcgtggatttgcaactctgtctttctggaaaggatatgagagtcttgccctctcccccagggctgacacagttgtaaaccaaacttttgacttcagttgtacatatcaattattttgcacccacattagattgaaccaaatgacactggctcttttaaattaaaagtggtcaaatgctggcagcctcttagggttcaattcaatggaatcttttaaaggtgcaataatgctgtttgaaatgaggagaacgcctgtgttttgtttgctgagagaaatccactatctctcatccagaagatgattagacccataatggaagccagtcagtggcatgaggaatcatggagatgattctcacctggttgattggatcagacgttcctagcccgaatgagggtggaaagggaaccaagagatgaagtggattgttgggtttatgagaggacggtggttgtctgtctatagttaaggttgtttaaactcatgaccatgagaatgagctttttctggataactctttccttttccttctgatttttgagagtgctgaaaactcaagtcctgtatttaaaaattccatcgttgaaaacatgtttcaaggacagatgacacacttatgattatagcatctgaagtgatgggaatattaaataacctttggttggacatgtaaccatcagggctccacttggtcttaaaaccaaacacacacagttcttgtcgttaaagatatccatggcctggcacagtggctcacgcctgtaatcctaacactttggaaagccgaggcgaggggttaacttgagcccaggggtttgagaccagcctgggcaacatggtgaaaccttgtctctacaaaaaatacaaaaattagctgggtgtggtgttgtgtgcctgtagtcccagctactagggaggctgaggcaggaaaatcacctgaacccaggaggtggaggttgcagtcaggcaccatcctgcgattgcactccagcctgggagacacagccagactccatctcaaaaaaaaaaaaaaaaaaaaaaagacttacacagagaaagcctgaagcccacaagagcaattagcaaaaggaaccctgacataacaaatacggtggtgtcattagcaaccaggtagttaagctcaggggttgctatgtgtcataaacttgaaagctacattggccacgagtaacacaaatgtaggtgctaatcacagatagttggtgggcatttcaaactttctcttcatatctatggatacccaaaacagtgtgcttccatttagaaggcttccattgggaggctgagacaggaggattgcttgagtccaggagatcgagattagcgtgttcctccctccctccctccctccctccctccctccctctctctctccctccctctctccgtctcttcctccctccctctcgtttctttcttttttcttttctttctctctctctctgtctccctctctctccctctccctccctccctcccctccttcctcctcctctctttcttttgaggtggggtctcgctaagtttcccaggctggtctggaactcctgggctcaagtgatcctcctgccccagcctcccaaagtgctgggattacaagcatgcatgagccactatgccaggcctattttccctttcctgctatttcctcccagctaacgcgcttttaaaatttgatacaaattaatttttctttttttgtcttttgttcaaataatgatttgatttctgttctctgtctgggtcgcttcaataacatggatacctacacatagttttatcagtaaaggtcattgacataatcagtgtgttgtgagaacaaagataggccctcatttaagctgctccattactcattttataagtcagagaaggaaggggacagcgtcctctgttttcagatggctattgaagtgagtcagagtgacggtgagcagcatgcattgaattctagctggaaagagggtttttaggcctgcgtttgagcttgccctgaatgaataaggctggaaacctataggccctggagaacattaatgaggaatctgctttccctgacagctccttgataaacgaaatgatggatgtgcagcgtgcagccctgagcaaaggcctggcagctctgtggctgagccctagagggctgagctgggccagggctcccagtagtttgttcaggagcactgagagccacagcaggtgctgatccagctcttgccttcttcgcgagtatctgacaagtctgcagagaccgcaggagcctggctactccttgagttcactgtcttggagcaagcctgtgggggaatcacatgcccccccactctagtgcccattggggacatggaggagggagtttccctatttgcagttaggttttgcgtgctgtccgcgagcttggtttcccctttgggttgcacagtgctgagatctgagcccaaggcagttgggacattaatgatgagacagaggaggctttgctgtgttccacatctatcaggctgctttgcccagggagacgccccccttgcttggggtcttgggcttgggtaggggttctggaatgtctcccctccagcaggctctgcctccttggcttccttgattcagagagcagtgcagtggctttgttgaggagcagcccctgtggaggcgctcatgggtgacaggctgtggctgaatagtggacagccctggtcactgacattaacatggtgcaatagagccttcttatgtgttccttggttcccactgccctttcatggtcgggtgtcctgattgtctgtggctagactatgccaacgtgatcagtgtccttcccagaacccctgaaagagggtcatagattgagatgtctgtcaccacccctgtccattgcagagtcacatacatgctagagaccagctcgcccttgatgcgacctgaggacctcgcccgctagtcattacagggaggggaaagacaataaaaagatgaaagagagtgctgtccctggtaatggaagttactcatcattgtaccagtgggcagccacatagggataggtcggaagagaaaggggaaagagtgaataaaaaacgctgatgtttgtgaggccgagagaggaacagaactattactgctggtcaagggggccatccacttaaaatgttcacatcctgtttcagccacaagctggccaagatcatcacataaagggacaaacgttggccccagaaagaacgcatggtcatcttgagtcaaggctgtctcatttgatgtcagaattcttaagagctgctctggctaggtgcagtggctcatgcctgtaatcccagcactttgggaggctgaggcgggtggatcacctgaggtcaggagttcgagaccagcttggccaacatggtgaaaccctgtctctactaaaaatacaaaaattagccggacgtggtggcaggcacctataaccccagctacttgggaagctgaggcaggagactctcatttgaacctgggaggtggaggttgcagtgagctgagatcaggccattgcactccagcctgggcaacaagagcaaaatcctgtctccaaaaaaaaaaaagaactgctcttggctgggtgtggtggctcacacctgtgatcccagtgctttgggaggctgagacgggaggattgcttgagcccaggagttcgagattagcatgggcaacataacaagaccccatctctttaaaaaattagccaggcatggtggtgtatgcctgtggtcccagcaacatgggaggctgaagcaggaggatcacttgagctcaggagttggaggctgcagcgagccatgatggcaccactgcactacagcctggacagcaaaggaagaccctgtctcaaaaaaaaaaaaaaaaaaaagcaagaaaaaaaaagcatccaggtgtggtggctcacacctataattccagcactttgggaggccgaggcaggcagatcacctgaggtcaggagttcaagcccagcctggccaacatggtgaaaccccgtctctactaaaaatacaaaatattagctggatgtggtggcgggttcctgtaatcccagctactcgggaggctgaggcaggagcatcgctcaaacccaggaggtggaggttgcaatgagccgagactgcgccattgcactctagcctgagcaacaagagcaagactccgtctcaaacaaacaaaaaaaactactctccaaacagaacctgcacctacccaattgtggtgggtgcccctcctggggctcctgcagtagcggtggtgtgggaattgagaatcttgcaagtgctatgagggagctgagacactgagtgtggcagggccatgtgcccagagcatgcacaacccatcctaacgtctgccggggaaggtgggggatttctgtgcattgcttttcaaccagaaaggtaatttttgttccccaggggacactcggcaatgtctggagacagttttggttgtgacactgggttaaggagtgctactgtcatctaatggatggagagcagggatactgctgaacatcccacagtgcacagggcggcctcacaacaaccaagaccacctggcctcaaatgtcagtagggctaacatccagaagctctgcgagtctgtgggaagccctggatgccccaatcctctttcattttcttctcaccacgtaggacagtttagctggacagtacacaggactcattcaaggggtcatgagaggagacctcatagcataagggtcaagtacaaggactttgcagtcagactgacgtgggtttcagtccctacccatcctagtggtgtgaccgagagcaagttgggcatagtgacatctgtcttgattgactttggagtttgacaggcagtacatgcaaagttctctattcccatgtcactcagagtgagtgtgcaaaacatactattgttggcatccatcgtcataagagtcactgtgaacatgggtgagcttagcaccttgtggcacggggctgtggtgagggactcagacagctttatgattgagtttgggcctcagcgagatggcaaagctatgcttctcttgctccttggaccatggtgacctgtgaggacccctgggggctgccttctccactgttgcagttcagggagctaaggccaaaggctactgcagtggtggactctggggtccccctggtgacaaggaagggactttgagctttggaatgccctgggctgagtcttgccacctgcaggtttgtgaacctcatcatgccttgtttttagcacaacaaaatgggataatagtgactttattattgatatactattatgctgttttcaggtatgtgacactgctgctattttactgtttcttccagatttccgtgagggtggaagaaaatcataccatatcagatgcctcgcagagcaccaggcccaccgtgaaaggtacagcaaattttacttccctcttcttgcctcgttggaaattctttcctgtgagatttcctcccctccgccctccgcgccttctgccatagcctatagcctcctctgggagttcttggataattttgttgccttatacctttgcaatttccagtatggtagccatgcgccacatgtggctgtggagtgcttgaaatgtggccagtctagattgagatgccttgtagaagtataaaatacacactggatttcaaagacttagttcaaaaagaaagaaagcaaggtatcttattgataatgtaatacagtttacatgttgaaatgatcacttggatacgtggagtaaaatagaatgtattattaaatgtaacttcacctgttttcttttgacatttttttgtggacccagaaaattgatagacaggtggatttccttcacacttacacacttgtcttgctcaagaccagccctgcttcctcactggctgctcagtcaaatgcctcctccagtttaagctgtccatcacggggccacccattatgtgtccatctcatcttctctgctcagtgcctgtgcaggcagctggtgttcctgctcctcccgcccagctttgcttatgatgctagtcttgagtgcaggctgctgagcttctcacctttcttcccatacatgtagaacctctcctccagaaacatggggtacttaccagctggcaaggagcagagctggggttcacattcatttctgtcttgctccaaatccatgtccctaatagattactgtctccaattgctttgtggatgtaaacacatagtaagttcctagagagcagggaccatttttatttctttcatctctgctgttcaagacctttctaaagcttttttgaaagaattaagatttctagtctcttgcccttccactttctgctatgtgaagacacagtgttcctgccctctgccctctggatgctacagcaacaaggtgccatgttggaaggaagcagagaacatccctcaccaaataatcaatcctgctggtgccttaattgtgaacttctcagcctgcagaactcacgaaggtcatcaccatgtaggctgattgatcttggacttccaagcctccagaactcaaatcagtgaatttaaaaacattttatggagggcggggccaagatggccaactagaagccacggtgttgggaggctgctatcagaaaagaccataataagcgtgtgaatccttcatcagcaaccaaggtatctgggttctctcatcaaaattgactagaaggctggcgtgacccacagagagaaggaagaacagtgtggtgtggcggcccacctgagagtcacatgggaaagggaaccccctcactccagataaggcaggaggtgagtgagcacgctacccagccggggaaactgcttttccacagaactgtgaaacccacggattggaagatctcactcgtgaacccacgccaccagggcctcgtgtcccagccccagaacacacagattcttacagcctctcagctggaatccgcttaagcttaccaaactcctcggggaggggtgaccagtaccagctgcagctgcctgctgtctaagccctttgaactcctgcagggaggggcagcagccagcactggcaactgcctaacatgctaagctccctggacagggggaagggtggcacccatttctgtagctacaggctacgcttttcccctgctagagccagggaggctggacagcttggtcccaagacttgtccccacagcccaacacactggctgtggcagtctgcggctagagtgcctcttcaggcccaatcccaacccatcctttcttagttggggtgtgtgtggggcggggcgcttccctgctggatctccagtaactccagccagaggctaagggacagaatttggatctcctgggcctcagcccataggggaggggtggccgcagtctctgctgaccagcagatttagcttttcctcctggtagttccaaggaatctggacagcccagatgagtgggtttcccccaagcaaaacacaccctctccaccaagggacagagtgctccattaaacgggtcctgctccctgtgtcacccaactgggtgagacccttcaacagggcttgtcagataccctctgcaggagtgatcctactggcatcaggttggtgccccttgaggtcagaggtcccagaagaaggagtaggcacccatctttgctgctctccagcatccttaatgacatctccaggcatgggagcgaatcagatgaataaggcctgaaggtgaaccaccagcaaactgcagcagccctacagaagagggactggactactgaaagaaaaacaagcagaaagtgacaacaacagcatcaacaacaacaatcaaataaaaggtccccacaaaaatctcatccaagggtagcagcctcaaagactgaaactagacaaactcatgaagatgagaaagaatgaaaaaatgctgaaaacccaaaaggccagagtacctcttctcctccaaatgattacaacatctctccatcaagggcacagaactggacggaggatcagatggatgaattgacagaagtaggcttcagaagatgggttataaaaaactacaatgagctaaaggagcatgttctaacctaattcaaagaagctaagaaccttgataaaaggttagaggaattgctaactagaataaccagtttagagaggaacataagcaacctgatggagctgaaaaacacagcacgagaactttgtgaagcacacacaagtatcgtgaagcataaacaagtatcaacagctgaatcgaccaagtaggagaaaggatatcagagtttgaagaccaccttactgaaataagacatgcagacaagaatagagaaaaaagaatgaacaaagcctaccagaaatatgggacctcataaaaagactgaacctacgattgagtggagtaccagaaggaggtggggagaatggaaacaagctggaaaacacacttcagggtattatccaggagaacttccccagactaccaagacaggccaacctgcaaattcaggaaatactgggaacaccattaagatactctatgagacgatcaaccccaagacacataatcatcagattttccaaggtcgaaatgaaggataaaactaagggcagccagagagaaaggctaggtcacctacaaagggaagcccatcagactgacaatggacttctcagcagaaactctacaagccagaagagattgggggccaatattcaacattcttaaagaaaagaattttcaacccagaattttatatctagccaaactaagctttctataaaatcctttccagacaagcaaatgctgagggattttgttaccactaggcctgccctgcaatgtctcctgaaagaagcactaaatatggtaaggaaaaactggtactagccactgcaaaaacacatgaaaatataaagaccaatgacactacaaagaaactgcatcaactaatgtacaaaataaccaaatagcatcatgatgacaggatcaaattcacacataacaatattaaccttaaatgtaaatgggctaaatgccccaattaaaagacacagactagcaaattggataaggagtcaagactcattggtgtgctgtattcaggagacccatcttacatgcagagacacacacaggctcaaaataaagggatggaggaaaatttaccaagcaaatggaaagcaaagaaaaaaagcaggagttgcaatcctagtctctgacaaaacagactttaaaccagcaaaaataaaaacagacaaagaagggcattacataatggtaaagggaacaattcaacaagaagaactaactattctaaatgtatatatatgcacccaatacaggagcacccagattcataaaataagttcttagagacctgcaaagagacttagactcccacacaataatagggggagactttaacaccccactgtcagtattaggtcagtgagacagaaaattaacaaggatattcaggactcgaactcagatctggatcaagtggacttagtagaagtctacagaactctctaccccaaatcaacagaatatacattcttctcagtgccacatggcacttattctaaaatcaaccacacaattggaagtaaaacactcctcagcaaatggaaaagaactgaaatcatgacagacagtctctcagaccacagtgcaatcacattagaactcaggattaagaaactcattcaaaaccacataatttcgtggaaattgaacaacttgctcctggatgactcctgggtaaataatgacattaaggcagaaatctagtatttctttgaaaccaatgagaacaaagagataatgtaccagaatttctgggacacagctaaagcagtgttaatagggaaattttgcactaaatgcccacatcagaaagctaaaaagatctcaaatcagcaccctaacatcacaattaaaagagctagagaggcaagagcaaactaatccaaaagctggcggaaggtaagaaataactaatatcagagaagaatcgaaggcgatagagacgcaaaaaagccctccaaaaaatcattgaatccaggagctggttttttgaaaaaattaacaaaatagatagactgctagctagactaatagagaagaatcaaatagacaataaaaaatgataaaggggatattaccactgaccctacagaaatacaaactactatcagagaatactataaacacctctatgcaaataaattagaaaatctagaagaaatgaataaattcctgcacgcatacaccctaccaagactaaaccaggaagaagttgaatctctgaatagaccaataagctctgaaattgaggcagtaattaatagcctagcaaccaaaaaaagcccaggaccaaatggattcacagctgaattctaccagaaatacagaggagctggtaccactccttcagaaattattccaaacatttgaaaaggaaggactcctccctaactcattttatgaagccagcatcatcccaatacccaaacctggaagagacacagccaatatcatactaaatgggcaaaagctggaagcattccctttgaaaactggtacaaaacaaggatgccctctctcaccactcctattcaacatagtattggaagttctggccagggcagtcaggcaagagaaagaaagaaagggtattcaaataggaagagaggaagtcaagttgtctctgtttgcagatgatgtgattttgtatttagaaaaccctatcatctcagcccaaaaacttcttgaactgacaagcagcttcagtgaagtctcaggatacaaaatcaatgtgcaaaaatcacaagcattcctttacaccaacagtaggcaggcagagagacaaatcatgagtgaactcccatagacaattgccacaaagagaataaaatacctaggaatacaagtaacaagggatgtgaaggacctcttcaaggataactacaaatcactgctcaaggaaataagagaggacacaaacaaatggaaaaacattccatgctcatggataggaagaatcagtatcatgaaaagggccatattgcccaaagtactttatacattcaatgttgttcctgtcaaactaccattgacattcttcacagaattaggaaaacctattttaaatttcatatggaatcaaagaagatcccacgtagccaagacaatcctaagcaaaaagaacaaagctggaggcatcatgctacctgacttcaaactatactacaaggttacattaacaaaaacagcatggtatgggtaccaaaacagacatatagaccagtggaccagaacagagacctcagaaataacaccatacatctgtaaccatctgatcttcgacaaatctgccgaaaacaagcaatggggaaaggatctccttattcagtaaatggtgctgggaaaactggctagccatatgctgaaaactgaaactggaccccttccttacaccttatacaaaaattaattcaagatagattaaagacttaaatgtaaaacccaaaaccataaaaaccctagaagataacctaagcaataccattcatgacataggcatgggctaagagttcatgactaaaacaccaaaagcaattgcaacaaaagccaaaattgacaaatgggatctaattcaactaaagagcttctgctcagtaaaagaaactatgatcagagtgaacaggcaacctacagagtgggagaaaacttctgcaatctacccatctgacaaaggtctaatatccagaatttgcaaggaacttaaacatatttacaagaaaaaaacaaccccatcaaaaagtgggcaaaggatatgaacagacacttctcaaaagaagacatttacacagccaacaagcatggtaaaaagctcaacatcactgatcatcagagaaatgcaaatcaaaacctcaatgagataccatctcatgccagtcagatggcgattattgaaaggtcagaaaacaatagttgctggcaaggctgtggggaaataggaatgcttttacactgttggtgggaatgtaaattagttcaaccattgtggaagacagtatggcgattcctcaaggatctagaaccagaaataccatttgacccagtaatcccatttctggatatatacccaaagtaatgtaaatcattctgctataaagatgcatgcacgtgtatgtttcttatagcactatttacaatagcaaagacatggaaccaacccaaatggccatcagtgatagactggataaagaaaatgtggcacatatacatcatggaatactatgcagccataaaaaggaatgagatcatgtcctttgcagggacatggatgaagctggaagccatcatcctcagcaaactagcacagaaacaaaaccaaacaccgcatattctcactcataagggggagttgaacattgagaacacatagacacagagaggggaacaacacacaccagggcctgttggggagtggggatgagaggagggaactatgagggtcagtagggatggtgctactaattaggtagtagggtgctgcagcaaaccaccatgacacacatacacctgtataactaacctgcacgttctgcgcatgtatcctgttttttttgttttttttttgtttttttagaaaaagccgggtgcggtggctcacacctgtaatcccagcactttgggaggccaaggcggacggatcacaaggtcaggagatcgaaatcatcctggctaacatggtgaaacaccgtctctactaaaaaaaaatacaaaaaattagccgggcgtggtggcgggcacctgtagtcccagctactcgggaggctgaggcaggagaatggcatgaacccgggaggtggaggttgcagtgagctgaggcgacaaagcgagactctgtctcaaaaaaaaaaaaaaaaaaaagatttctagtacattgcctaaaagaacccttggatgaagtcagacacatgggtagtatgagaccccagatagcatcattttgtatgtacagaatcgcttttttttttttttttttttgagtcaggttctcactctgtcacccaggctggagtgttagttatgtggtcatggctcactggagccttgatctcgtgggctcaagtgatcctcttgcctcaacctcccaagtagctgggattacaggcacacgccaccatgcctggctaatttttgtattttttgtagagatggggttttaccatgttgcccaggctggtctcgaactcctgggctcacgcgatcagcccacctcggcctttcaaaatgctaggtttacaggtatgagccactgtgcctggtctagaattgcttttagtggatgattttttgctgtcactgttaatggcgtgcattttctgagttatcagagatggccctgcatgctgcgagtctgtgttgactgtactgttggctgtgtgtgtggagggcaggaaagtgccgtccttgctgtaacttgtgttattaatgatatggacactgtgagttgcttctagagagctacacctcacttctgtgtcagcaaatgaaggcccaggaactgacagcgttccctctagctttaattgcggtataatcaccacaccctaacattctcctgttttacctttggcaacatctagagtttggttgtcacagctgatggggtgggggtgctatggcattgggtgggtagaggccaaggatgctgctgggcatcctacactgcccaggacagccccccacaaattatccagccctaaatgtctacagtgccacaggtaagaaatcctggaccgtagggtagacagatttgactggagtggagaaattgtatcctggggtaagtgggatttggattgcagttagtgcagagcttgtgtgtgtggaacgccttggacactggactaatccaagaagttgggtggggaggaggggggctttttctttaggtcctggaaaccattaaaaacctttgaacaggtgctttagaaagacaaaactggcatctgtctgaaggatggattacaacaggcaccagcagactgtggcccacggggccgtgtccagacttggcacacaaccatgcccattcattcatgggttgtctctggctgctgtgatggttaactttatgtgtcatcttggctaggccatagtattcagatatttggtcaggtacttaggaatgttgttgtgaaggtattttttagatgaaataaacacatcagtagactttgagtaaggcagatgacttccataatgtgggtggacctcatccaatcagttgaaggccttaagaaaaagactgaggtccgccaaagaggagggaattctaccagtatcctgcctttggatttgagactgtgacatctgcgctttcctgggtctctggcctgctctggaaagtttgggcttgccggcctccacaattgtgtgaaccagttccttagaatctgtccatctgtccgtccatccatccatccatccatccacgcacgcacacataaacaaaccctattggcactgtttctctggacagccctgactaacatcactgctttcttgccacagcagccaagttgaatacgtgcttgtaagtacagggattgtgtggcccacaaagtagaaaatatttactctctggccctttacagaaaaaaggccaagcattggatttggtaagtgaagtccttccatgaaactgagaagtgctgagtcagtactcaatgggagttaaaacagagaaactgtaaaagccaagagggctcaggatggtgataatcacggtctttcattcttttctcctgtgcacatttgacccgctggcatgcaggagatttaatctctctaatccagaatgtgttttagggaatggcttgcctggcttgtgggttgaaatgttctctcctcagatgtggctcctgcaatatcagctcacctgatgacaagaagtggaagccatgtaaccacctgagacgcaagttaattagggtttatcagaaagacaacctgaacccctgtgggatgtgctgtgggtgaagaaaagataccagtattctgtgattccaaataggagattttaaaaattctacccctggaggatgggttggcatttgtcttccaaacataggttaaatacgttttatttctgtctgttttgtacacattttaatcattttccagctcacaattacagttggtacttctcaattctcagtgaattgtgtagtggaattgtttgcaacatcatactttggaaatgacgttggcaattaaagttttggtccaagtttaataatgaagactatttgaaaggccaaaaccgatggatgcttttgagatgaaatagtcatttgggaagaaaatgagggcaggttgtctacttcttaacatttatctgtttttttttcttttttgagagggtcttgctctgttgcctgggttggcgtgcggtggcgcgatctcaggtcactgcagcctcaacctctggggctcaagtgattctcccacctcagcctcccaagtagttgggattacagacacatgccaccactcccagctagttttatttttttgtagagatggggtctccctatgttgcccaggcttgtctttaactcctggtctcaagtgatcctcctgcctcagcctcccaaagtgttgggattacagacatgagccaccttggattacaggcatgagtcaccacgcctggccttaacattgatcttgatgacactgaaatcgttgatgtgtgccaagggggttcctttttctaaatggaagctcactgttttgggtatccatgaattcatcatagatatgaagagaaagtttgaaatgcccaccagctgtctgtggtagcacctacatttgtgttactcatgaccaatgcagctttcaagtttatgacacgtggcaccccctgagcttaactacctggttgctaatgtctttggacatcactgtatttgttatgtcagggttccttttgctaattgctcttgtgggctttcagactttctctatgtacgtttttttgttttttggtttttttttgggagatggagtctctgttgcccaggctggagtgcagtggcgtgatccactgcaacctccacctcccgggttcaagtgtttctcctgcctcagcatccctagtagctgggactacaggcatgcgccaccacgcctggctaattttttgtagttttggtagagatggggtttcaccacgttggccaggctggtcttgaactcctgacctcaggtgatcctcccgcctcagcctcccaaagtgctgggattacaggcatgagccaccgcacccggccagtgtaagtcttttgaaacacagacacctagtgcctttcccgtgagtctttcagggaaagattgagttccgtgtcaggttggagttgctgatcaagcgactgactatacggcttcctagccccctttatttgaaaaaccagcgtggtcttcacttttcccttgagcctacaaccacagggtgcctgttcatgtatttccaggaccttatgcggctcctttgctctgcttattccgagaaccaagccttgggactgtgcattttgaatacaaatgaaggcacccggaggaagcccccagagtctcggcacagttgaggaaacaaacaaagcatgctacacgtgcaggaagatccctctttaattcctatgatgacctctctgcttttttattttttaagttaaaaggagtcaatgctttgggttttgttagactggacaaggtagcaagtcatattaaactaacccaggttgttgcttgagttttcactgaacttagactctactgacgagtatagtcaagcagaaattcccctcacgaggtggcctgatggtgtactccagtgggggggtgcagaagatttggagggatctgcttcccgactggggcaggttaacctctttctgccttagttacctctttgcatgtcctaagagcacctgcttatcagatccttaggaggattcactgaattcgtccacttggaatccacatggaaggctgcctggcatgtaggaggtacccagtaaattttagactcctgttatttttgccagttggattcaacagatgtttgttccctggactagtgtttctcacctgggggtgatctgcacctaggggacatttgacaaagtctggagacattttgggttgtcacagcttggggagggagtgttactggcatccagtgaatagtaaccaggtgtattagttttctgtcgctgtaaaggaatacctgagactgggtaatttagaggtttatttggcacatagttctacaggctgtacaggcatggtgccggcatctgcttggtttcttgggaggcctcagagcttttgctcatagcagaaggcaaagggagagcaggtgtctcacatggcaagagagggagcaagagacagagggaaggctaggctcttttaaacaaccagctcttgcatgaactgagggaactcactcagtaccagggggagggcaccaagccatggttcctccatgaaccaaacacctcccaccaggccccacctccagcagtgaggattaccccactacatttcactgtgagatttggaaagggaagacatccaaactatgtcaccaaagatgctgctaagcatcctaccgtgcacagagcagcccccataacagggttacctggcaccagagtgtcagtagtgttgaagttaggctacactgtagttcacttgcttattgtgtgtaggaagaccggaggccagttacctggcaataacaacaacaacatcaaaaccccctcaaacccaaaacaaaaaaaccccacatgacactgtgagtgttttttttttaatttgcaggagattgagtcttaatccagttgaagacctttatttccttgctagttacagagaggtttttcctggttcgttgcctgtgtttgttgcagttagtttttattgacctttctagggttcatgtgtgtcccttgggtttgccatgttttgttctccaaagccccaggagggttccccagtaacagagactgtgttagatttttaacattttcttttactttttgttttaaatgatttcttttgattaattacacactcacactgcgttgcaaacatagtgctgtcagatcccagtactgtgtcctttaccggctttccccaaggggagtggcttctcacaggatcatagagcaggaaaacccaggaaatccacgttggtgcaacacagttacctagccttggagcccttacttggatttcaccctttttgcgtgtactcatttgtgagttgcatgttaaagatgagagtcagtaatatatttccaaatgtcaacagaacataaattgagcagaagagtttataatgagatggaggattgagcagaagagctcatagcgagccagggcgaacaacctggcgaggagctccttgactttcttggaggccgaggtgggagcgttggtgacaacccccgggaaggcagatgttatcaggagttaaaatgtgatgtgtgtaccgctcatgtgtgtatggggtgtgctccttttgtttttgatgctgaaatgagacaaatcatttcccttttaagctccaggcagactgatggaggggggaaaaataacacccaacttactgcaacctgaaatcctttgccttggatccacttcctaagttcctatagtccttattttataaactgataaaacaacttttctctctcaagtgatgatcatcttgtgttttacactaattaagcccatatacacctccctttggaattccttcttctgatctgcttggcctgtttgccagttagtcgccttactaggagaatcaaaatgtaaactcataatagacaggaacccaacatcatcagcacaggatgtggcagaatgatttttctttcccacctcttgctgagaaggcaatgagattggaaatggcaaacaccccagagttctgtaactctgagtgtggaagaggaggtggcagcccttgacctcagtagcggagccagatcatcgaacatccccgtccaggaatctggacatgcactggtcaagaattcagcacaatttcctttggtctggggattgggaagctctttttgtgagtgaggcatggagtgaaattgcagaagcctgcgtgacttgtagaaaccgaagccaggctcgtttactgccttgcacaagggagatatgataagacagaatttatttgtgagtgtcgtcgatgccaaggagcctgtccaacatttatagaggcttttgggctaaacgaaaaagggtttgatctgtctgtggagacagaaagtagatgagtggttgcctaggactggggctttaggcgggtaagaggttgtcactgctaaagggtacagggttaatggaaattcttgaaattgtgctgatggtggctgcacaactctgcaggtactaaaagttgttgagttgtactcgaaatgggtccactgtatggcatgtgttttatatctcaataaacctgtcaaaaaagggtgcaggaccactgtttttgtacatgtcctcaaaatacttcctgtaatctagtgtggtcacagctggttcatgtgcacggacatagtgtcagtgtcattgtggagatagcagtttcagattcactggttccagaaaatgtgtccctgcctgttatctccgtgttgccacaattaagaaccaagggtccataacaagcagtgaaaccatggttcatatcagaggaagtggggtggtgtcatctcttttgtatttttctcttttctctcccccactgcctttgcccacttccttctccaaaataaaacaaaagagagaaagcaagagataagtggctgagctgaatgtggtccagccctttagaagaggggagtacacatactggagggaagataagcgaaaatacagcctttctcaagggccagcacagacggagataaagagagagccacaggcacactggccaagcatcagctcctcaagcatccatctcactattcagggtggggaaatacttgatacctcaagtcctctttatcatcgcagatgaaaactgacataggtgatttcctttcggagcatttagggagaatgcaagggaaattgacaacacacttggtgcaattgggtaaccagtctttgtgttgccctccaatgactcttgcttggaaatgattggaagcccatcgttttaagtcattggaacgactgtccccttcataaagcatgatgtagcaaaatgaaaagcatacttctggttaaaagtgtttttcaaaaaaagcttaccacattgaggaggtcatttcatatttcctgatattcagcaattttgctgtgagctttgtagagttgttctggtgcttagttcaaataagaaaggaattactgaaattgcacattaagttaaaaaaaaaatcagggttttgggtcctgagacttgttacctaaacatctgtcttgctattttgttacagcacaaagtaggaattgtaaaacatcttcgttataaactgagtactatacagtctctgggagagcagaagaaacgtggtaggaaggaaccacccagggtgggtaatgacagagtagagatagtcagatagggccggagacaaggccaggaaaggcgagaggaagagcctgcaggaacgagtttcttgcacgtttgagagctggacctgccaagagggtaaggccaacatctgtgtgtgttctttgaggaaatccgagtagcctgccctgcctttgaccctctgctctttgaactgtggattccttcccatacacctgtgcattctcagtgccgtggtcagatccccaaacagacaccaaaccccgacctccgaggcccaggcaggagcataacccagccccaaggggagataaagacagaaagaatcagtattatagcagggacctttttcaggaatctgccttctgcagggcagtgccctaggtgcattcaagccagcatagcaaatccacatcactagaaagactctttccgttttataacttgggaaactaaggccaaggcagtgacaaatgccaggtccccaaactctgaactgcagatctgcaagctgaatggtggcaggtgggccagtgggattttaaagccgtgtgcttttcagggcaccctggtgcttctccaaatgccggaagggtttccttgaaaattcatagcactactcagtcaggattctgcaggacagtgccctggggagtgcatgagtggatggttctgtgggtagaagccacgagctgaagatagttttacatgtttaaagagtaaagagactgggagcggcggctcatgcctgtaatcccaacactttgggaggctgaagtgggaggattacttgagcccaaggagttcaagaccagcctaggcaacatagcaagaccttgtctctaaaaataaataaaataaaataaaagccaggcatggtggcagtgctcctgtagccccagctatgcgggaggattgtttgagcccaggagttcgaggctgcagtgagccatgttcatgccaatgcactccagcctgggcaacagagccagatcctctctcaaaaaaaaaaaaaaaaaagaaaagaaaaaaacagtaccttgttgatacatggaaatgatgtgacattcagataaagttttactggagctccgccatgcccattcatggacatattttctatggttgctttttcacaacaaggggtgttgcaaccatggcaacagacactgtctgtcttgcgaagcctaagatatttgctctctggtcctctgcagaactagcgtgtagttctgagtgcttgaaggcacgtaccatcttggtggtgtgacttggactttcacctctcctgatcccttcttcatttccaccctactctcatcttgccttgcttgcagaagcctggtattttcataattcgagagtcacttacttcatgtgaagtcttgtcccagttaaagtgccaatagtcctgggagaggtaatacattaaaccttatcagttatttatacctcaggattggaagggattgttgctggctttgtcctataacagctgcgaccagaggacagagcctaagggctgttgcatgaaatgagggaggtgtgggtcacctctgtgcagggcatgagaagagaggaggctgggtcatctgaaagatgacctttgttcatggcctttttctgtatcctcctcagtcacccagaaattgggattgttggtgacaatcttttgggaattggtgttagcttcggagagccacttagcctgaagaccctccttactccgttatcatagaaccagagtggtagccacacaggcagactgtccatgctgacgtgtaaggcagggccttacacctcctacccatgtaggaggtggtggagctgggattttacatggacagccttctgctcccctggtgcttagctacattctagtgccttctgtgcaatgccagcttaacatacatatgaagtgtgctgacccaatctcctgcctttgcgttcactattttagatggttgtgtcaccttgagcctggactagggagataacacgtgaaggagatgccgcgtggtttctgtcttgtccatggtacgtggaacacattcccctcagtaacattatggttgagacatggaatgccacaatgtacagttgccaccatatggtatacttcatatatatacacatatatatttatttagtttattttaatttttttagagacagagtcttgctctggtgcctaggctggagtacagtggtgcagtcgtagctcactgcagcctcgatctcctgggctcagtgatcctcccactgcattgtcccaaagcgcttggattataggtgtaagccactgggcccggcctacttgtatatttttcattgcaaatgtacatttcagttacgttgtgggctttaaaaagcctttctaggctagttgggaatttgaccctattttttacagcatagtttctaggagaaaaacatttctgaggaagtaacaaaagaagacttgggctgtatcccatttttaatttagagagcactgtcatttgaaaatttcttctctcaacatgttttctttttgagacatgaagtaggcaggcaggatcttttttacagtggcgctggtgtctttgggaagcggcttccttggtttgcctttgctcattttctttcttgacttctccaggcattcagctgcaggcatgtacctctgctgctgggagagtggcaaggagagggggttggaggaacggggataaaaattagctagaattcaaaaacggcagtgacagcccagatgatttttcatgctaacctactttaaaagctgccagaataattgtggagtgggaaatctctcatttctcctgtcctactctgacaagatctaaaaataactttgaggagatgggcatgtggccctttgatctccttggcctggagtatttcttggtaggagcagagcttacaagaaggtgttcttcaatgagtgttctggcagtcggagttgtgggtggggctgattactgtaatcttccttcgtcattgaacgatttcatctgcccctggtttccattacttgctgctctaaatattcctctccccgcaccttccttttatgtagccacaaactggaatatgtgcatggaaaacccaaaggaggcaaatcccacttacactgcagaactttggtgctggatttagcggctatttaccaagcacctcctcttccagaataagtagcacagatctttgaccgccccccgccccccaccgagggactgtggtctagttggaagacacaaggcagaggtgtaaaaagggaactctggagataggaattggaaatggggctgagagctgaagagatggcctggggctagagaccagggagatgggaggagggggagttccttggaagagtgtgcccctaagagatcctgaagagtgagcagagattgatgagaggcgagaggagacctagagttatcagggctgcagaggtgtccttggcacatagaggccatagtatccacgttggcttccagggtaggggcagtgcatctgcggctggctgaagatggaataaatgggatagtggctaaaaagatgggggtattgggggaacacctctccttggagtggtcctccttgcagataaggggagacgtagaacagcacttgacagggaagctggtgtgggggaaggatttttttacactaggggagacttgtggttgagttaaacaggttctagaggccaggcatggtggctcatgtctgtaatcccagcactttgggaggccaagttaggaggattgctcgagcccaggagttggagaccagcctgggtagcagcagcatagagagaccctgtttttacaaaaaatacaaaaattagctggacatagtagcatgcacctgtaatcccagctgctcgggaggctgaggtgggaggataacttgaccccaggagttggaggatgcagtgagctgcagttgtgccactgcgcaccggcctgggtgacagagggagaccttgtttctaaggggaacaaaaaaagaagttaaagagataagataaagaatggggggaggggacgtattttttgcaggagggaaattttgagggtttttagccttggaaaaggagcagaacagatgggaaggtcgtaaacgtggaacctttggaagcagaaaggaagatgatttctcttaaaaagttttgcctagagatgactaatgtgaaggtcttggtgttttaagggagcagggaaagccagaggtggtgggtccggtagatgcaggaactgacccaggctttcagattgtacactggggagcagagagtgcgtgcttgggggtggggaggctgctggccagggctgaccttcctcccatgacccctgcgtagaatcagagtagcctcatttagtgtacttgagtcaaggccttctgtttaagagcttatttgaactcattacagtcatcgcttggtatccttgggggattggttccaggacctcctgcggatacccaaatgattgcacactcaaatcctgtagtcctctcagcaaaacctgctgataggaaaagtcagccctctgtgtctatgggttttgcatccccagatactgtattttccatctgaatttggttgtgaatgcagaacctgcccataaggagggccaattgtatttattgaaaaaaatccgtgttgttcaagggtcagttatagtttgaactacaaaaagcaagcaaccaaacaaaacccccaaaaaccaaagctttaattggttaagtcagagcagactaaaaaggactacatgcccagtggaactttctgtgtagtctagtagccatatctggctatgaagcacctgaaatgtggctcatgcaacagaggaattgaattttaaattttattccttttaaatatttatttttgtctttcttcgtttcttttttttttttttttttccctgagatggggtctcgctttgtcacccaggctgaagtgcagggtcgcgatcactgctcactgcagccttgacctcttgggctcaagcgatcctcccacttcagcctcccaagtagctggggccacaggcatgagctactttgcccggctaattttttaacttttgtagagatgggggtctcgccatgttgcccaggctggtctcaaactcttggtctcaagcaatgcttccacctcggcctcccaaagtgctaggattacaggtgttgagccacaatgcccagcctaaatatgtatttcagtagctccatatggggaggtgtcttggacagagcaggttagcccgtgagactctctggtccttgagtgagagggaaggatgagggcttgcagatgatcccagtgggctggttctggaagcgaaacctgcaggccccatggcttggggaaggctgaccatagcaggtgggaggagctctctgaaggccgaggctgagcactggtggagaacagggcccgtgctcacgtatcccacaccccagaacttggtgtgctggattccagccttgtgtgtttctcattatgactatgtaaatgccaggagggttgggactgtgtgatttttcttcttgcttggatgctcgagagttcttcattaattagtgaaggaaagctggctctaaggagaagcagttgaagtggagttcattgcccccacttctctgcagcaggaatgccttgtccctcctgcctcggttgaactcactttctcaggctcccacctttgaatggaggcccttgtcaggctctccatccccagcgactctgttgacatttccccatgggaaaggaaaagaccatctgaaagtttccatctgtgtgcaaggttttctgaacatgttgacaacatgggtttaattttgtgaggtcagcaagagttcttgtggtttgggatttagtaaaaactgtaggctttgtatgggaagaaaatctctctcacctctgtcttctattcttcattctctacacagactctccacttgtctttagcactaaaaacacaaactaagcattatgttttaaaaaaaacccaaaccccaagtccagtagctgattgccctgctttagcttttctccctcgttgtcattcttcaaagaaagactccactcctttcagctgtcaccctttcaccctgatcaccgcatgcagtctggcctctgccccgcttgaaagaagcactcttcccagggcacccgggaactcggaactgtgaacccccagagtctgcccagcccctctgtccctgccttttgagcaacagcgactggtgccacaacctggggtgcccctttccctgggcagcattacccacactgggccaccgtgggccaagtcacccacactgggccaggtcacccacactggaccatatgaggccacgccactcacactgggtcatgtcacccaccccaggccacactgggccatgtcacccacacttggcagggtcctgtctttctccactctggtgtctcctttatcttgatgctcaagactctctcaaaacaccagtggttcagcacagtgtggggacagagacttcagcgaggcgcccccagccccacccttgacgggaaataagcgcaaactccttgtgcctgagactcaaagggtcgtgtgcctttattggcccccttgccttacaccagtgttcttaacctttctgtgtgtgtgcgtggctctctgtagtcatcgagtgaagccgcagaggtctcagaatcacattctaaaataaaagtagaatcataaaggaagcgattaaaagtgcaattgtcaaaatatcaaaaacatgatttgttgaatagtgcttttttcttttctttttattggtaaaatacatgtaatataaaatttagtcattttaaccttttttttttttttttttttttttttagacagagtctcactctgttgcccaggctggagtgcagtggcacgatcttcactcactgcaacctccacctcccaggttcaagcaattctcctgcctcagcctcctgagtagctgggattacaggcacacgccaccacacccagctaatttttgtatttttagtagagacagggtttcaccatgttggccaggctggtctcaaactcctgacctcaggtgatccacccaccttggcctcccgaagtgctgggattacaggcgtgagccagtgtgcccggcctattttaaccatttttaagtgtacagttcagtaacagcaagtacattcatactctgcacagccaacctccagaactccttttgtctcgtagtcctgaaactccatacataactacccactcatttccccattcccagccccagcacccacccaactttctgtttctgtgtgcttcacagctctgggacctcagatacgtggaatcctacactatgtgtctttttgtgactggcttatttcactcagcgtactgtcctccaggttcgtccacatggtagcatgtgtcagaatgtctttcctttttaaggctgagtgctgttccattgtatggataggtcactttattcctgtaactgtagatggatacctgggttgcttccaccttttgactgttgtgaataatgctgctacaaacttgcctgcacaaatatttccttaagatcctgctttcagttctttgatgtgtgctttctaaaccttttttattttttccttttgttttgagacagggtttcactctgtcccccaggctggagtgcagtggcacgatcgtgactcagtgtagccttgatctcctgggctcaagcgatcctcctgcctcagtctatcaagtagcttggactacaggcacatgccaccatgcccagctaatttttgtatttttggtggagatgaggtcttggtatgttgctcaggttggtcttgaactcctgggctccagcaatcacctgtccttggagggagttggcaatggaagtgggttggctgttggagcccattagaatattccagagggatgatggttccttggaccagggtgtggtcaaggagctggagagatgggagtcagttacagacaagacagtgggatttattgggattcttgatttctctcagtggtgagaaatttcgtctttccacacaccttccatggaaacccggaacaccatgggtcccccgtaggcagtcttaagaggatagctgtttttgttctccttccaaattcccattagacttgaggtcagagtcacactttacttgttttgaatatttaaagtagtatacctaatagctcaatagactgtatgcttttatttttattttttgagcctgccttcctaggtatttggacaaatttctccataagagaagtgaacacgtaactctaacttgtaatagcaaataccgcgggaacactgggagccacatattaagatgttattagaccttccctggagtatccaaatggtctataattgcttaataaggagaagtttttgctgagatttacatgatagagatttgctttttaaaaagaaattatccagatttgaatggaaaaattgcatagtctcctgagtgttgttttgcctttgactttgtactgtttaagaactgattatgagcaggaggaaataactcacttcagctgtaatataaatgtgcattggtatttaagcatatgtgacacataaaacaataccaacttggccagaatttaaatgtttatgtaaattacatttttggacaggcactttcctctattttgcagagaaaataattttttcccaaagagattttgtgtttaaaaaaaaaacccctaatactactattaggagtgttagatgccttcgatgtggttttctttcctctttttgcctgaaaggcttgagtgctgaagcatctagcgctattcttgtgtccgggaacgttcctgcctcatttttgtttctagtcttgtttctttctgtgtcagaaataagactaatgcgtgcagctgcacctatagttcaagatgaaggggtctgtgtgagagagagaacgtctgtgcatgtgtgtatgtgtgtgagtgtgtgtgtgagagagaggagagacgggcgggggaggggagagagagagaaaagagagagagagaaaaaaaaacacagcctctttgtaatacctggttgactcagtgaagtctggctctctgagctttactgaattcctccttacttattttggggccggaggtggagatgagttcaaaagtagataaaatttgcctgttacctaaatgagcagaatagattgcgcataatcttttctagatgaagcctgtgtttttggcattctgctctcaagtcctctgagctgatctgagagtgaactggagtgttaagttgagagagatgttgatgactctggtgtggtcttttcctttcggagaagtggaggtgaaacgacttgcccggggtccctgggaagcagagcttgtgccaagatgtaatttttcggttctaagccctgtggtttttcttctgcagcaaggtgggtaccctttttctgtaagggaccagagagtatggattttaggattttggggccagtcttggcaactattcacctctgcaactcagccacattgtgagaaggcagccctgcacattgcataaacaaacaaatgtggctgtattccaataaaactccatttatggccactgacttttgaatttcatagaatattctgtaagcatgtgtcagcagcttcccctgtgcaggtccatgctcagaggtagtcgcgttggggaaagttgctttctgccctcctggagttgatagacttgtggggaggcagatactggaaagcagccacagacacaccaaaggggggagtcagtcccctgtcatgggaattgtgatggggagcgccctcccctgtgcatttagaaaggccccgccacacggaaccactgggaagctgaggcttggagattgcgtgggatttgagatgagccaggcgtgggcagggagatcgcacaggggaaaggaggatcgccgtggatcacacaggacaaaggaggtcctgacctgtccacccccaaagccctttgcttccctagcccacgttggtgtagggtgggccgagagggggcgcagtgtgaggagtgactgtagctgcagctcagcagcgtctcaggagaagccagctgtctctactcaccacgggagtttatttccagtgtgggagagggactcttgagagagaaggacaagatgcccgtttgccctacagattcctttgaggaaaattcctataggggtctcgtctctgttgtatttattgtagtacgacctttttttaagtgattcaccataatctctctaggccgtatttaggcactgaccctaaatgtgcgttaaaaaaaaaggtttgggatattttggtttatttatttgtgtgtatgtatatagttgttaaattggtgtccttggggtgggggttgatcggtggaaccttatcttctctgctttcttgctccaccccatattttggtttgtttttgttagaggtcggcaaaccttttgttgtcaatggccagataataaatattttgtggtttttaaaccctgtagtctctgggtgttatatggcaaaagcagccattgacaacatgtgagtgactgagtgtgtttatttatgggcactgaggtgctgggatcccatattcacactgttccgccaccatcaccgccattcataactcccaaactttttctttttcttggtggaggagtggagcagggtcttgctctgttgctcaggctggagtgcatcacggctccctacagccttaacgatcctcccatgtcagcctcccgagtagctgggaccacaggtgcgcatcaccacgccaggctgattttttaacttttctgtagagacgtggtctccttaggttgcccaggctggcatcaaactcctggcctcaagcattccacccactcctgcctcccaaagtgttgggattacaggtgggagccaccgtgcccagcctcagaaatttttcattatcccaacccgaaacctggtccccatgaaacagtaactccccattctcccttcccccgcagcccctggcacccaccgttctattttctgtgtctgtggatttgactagtctgaggtgcctcatgtcagtggagtcatgctctgtttgtccttttgtgtctggcttttttcacttagcataatgtccttgaggttctcccatgttgtagcctgtgtcaggacatttgcagctcagttcatttccgaggaattgtcctatatgcagggggtcttaggaacacaggtaacttcacttcccatttgaagagcgaggagttctcccgaggccctgaacaggaatagagactgtgaggcattggcgtttggaaggaagtgtctctgaaatagaaacgactgtcagatgaagagggacagttcagtatggtacccgggcctgcctttccagacgtccccagcctctttgcctagttcccactctgggcccctgggcaggtgacccgcagctgcacatgggtttcctgggaagccacagtgctgaggatcttgggagagaggctcaggatcagagtctggggagtgcaggagcttgcggggggagggggtggggtcagtgggggcggggggtgctgctttggggattgggaggagtggactggggcggggtcacagagtctttagctgaacccatgggtgctctgggtctcggcttgtcctgactcaagtcaaggggcccaggcctttgtaaaggtccacattgcccattcactggggcctggctttgggtgagggtggcagctggagatggggggaagccctgaacgggaatcttggccacacactgctatatccgcgacaccaaattctatcccacctgttgttggctgttctggaaaccagcactgaaaaatacggagtggaaaagttttctgattttttttttcctgctttgtttgggttttttggaaaacaatttcaaaattagcatatggcttgttaaaattaaatcacaaaggaagtgcctatggtaacgttttgatcaggctctaggtctgtgtgaaccacggcccatatttgaaaatccagctttattgggacatagccatgcccattgctttctgtgtcctctgtggctgctttagtgtgccaccagggcagacttgggtgggttgcagcagagatggcatggccctcaaggtccaagatgtttactctcttgccggtcctctgttatctctggtctttgtggttgccacagttttcttggatccaggagttaaaggcagtcctgagggatgatggcctcatctccgcagttgcctggaatgctgaatttcagacgtgctaaaggaggggttgcagacattgtgtggaatgcattcagaccccagatgtgggtgcaggaaggcaggcatggcacagccaggtagagactggtttccaggcccaagcagccttcagcagctgtgcgccttgtttctgatgttgtttgggagtaagaataatgtagacatggggggtcatgaggctcagggtaaaaacttcaaggaaacctccatggcatggttgggcgcagtgactcatgcctgtaaccccagcactgtggaatgccaaggtggaaggatcgcttgaggccaagagttggagaccagcctgggcaacataaggagaccctgtctctaccaaaaaaaaaaaaaaaaaatgaccaggtatggtggcgcacacctgtggtcccagctactcaggaggctgaggcgggagcctgggaggttgaggctgcagtgagctgtgattgcaccatggcactccagcctggaccacagagcaagaccctgtctcaaagaaagaaagagagagatagaaagagagaaagaaacctccatggcagatgcatggaggaatgggttaatatctagaaatacgctgagtggtggagtaaagaaaacccacaatagaatacctgatgaatgtggggaaagcacttctgagctcctctagttttagaagacctaaaaagacgatttaaaaaaacaaacaggagagccctgttattgttgatgtcttccaaaacgaacgtgcatttataagccaggtggcattttaatgtcacgagggggtccattctcccatctgtctcctttgcttttgttagagtcagtagcttctaggtctgcttgacattggagaggatactgaatgcagaaaattttgtttaattataatgatttgattttttccttctgtattcaagtttgcctgcttctaatgaattggcagaaatgaagagcttgctcagattttgccaggaccatttaaaagcaattaaaatcaatttagttattaaatttgaaattattgtctggctaaatgatagtttaaaattcaatttatactggcacttactttttaatgaacagaccacatcacacatttttatgttctcaaattatctgtggctttaaagctgtaaaaaaaggtgctcttttaaaaaagccctgcatgtttcctttttcctctctacttccgctaaaatatttacatgtttcttttaaaataaggtgagaaaatccccttgacttctcaattttaagaaactatacttatcttttcatcacaaatgttcatttatctgtgttgaagtcaacccaagaaatcttaaaatataacggaaagaaaatgtttctggattttttcccgagaatacatatacttttaaatggcacgttttacccattgactttaattcctccctccctccattacatttttagatgtgttcaatgaaacgtagtcctccccctttaaaaaaatggaccgagcatcacgtgtgaggctgcaaagaggctccctgccaaagcatcttatctgccgctggtaaagccccgcccctccgtcagcagctaacccttgagcgggatgtgtgcttgtgccgggtgcattgcattaagagaatgcaactgaatagagaaggatcaggaccttttgtgcagaggtggggagtgttaaaaagggggaggcctgggtgggagggtggagttagtgggagatgggtatgcttagtgcttaaattccctgcattccctaacacgaatttaagaaactcacacagtaaatgagtcagggagagggagagacagggagagagggaggggagagggagagttcctttcattcatgacaggatgaactttgcatgcttcagaacaatttacatttttccttatttctaggtacttttttgaactaagaacctggagggtgtgtgtgtgtgtgtgtgtgtgtgtgtgtgtgtgtgtgtgtgtgtgttggtgtgtgttggtggtggggtttttttgccttatatttcataaatatttcttggttgattaaatgtcaataatcgctcatttctggtttgtaaagctgttacctgatccttgaataccacgaatattttgtacattctaaataattgagagaaaataacaacgacaacaaaaagacacaaataaaaagcatctccgcttatttaagaagagtagatctgtgcggggcgctgtggctcatgtctgtaataccagcactttgggaggccgaggcgggaggatcccttgagtccaggagttcgagaccagcctgggcaacataatgagaggctcttttttttttctttttgagacacggtctcattctgtcgcccagactggagtacagtggcactatctcagctcaccgcaacctccacctcctgggttcaagtgattctcctgcctcagtccccctagtagctgggattatgggcgcgcaccactaccacccggctaatttttgtatttttagtagaggtggggtttcgccatgttggccaggctggtctcgaattcctgaccttaaatgatccacaccctccttggcctcccaaagtgctgggattacaggtgtgagccaccacactggggcgcaagagcacgtcttttaaaatcagtgctgtctgtggggtgggaggggaggagaagtagatctggccatgctgaaaggttcgtgcagtggcctcctgagctgcgcacatgcttctggagctttgggtggacatttagtctgcatgtggatctctgtccaagcctgcactgggagcccctgccccaggaagcgaaggctgcatttcttttatgtcaattaacagatttctgccccaccctggacatctgagcgttaactgatttgtaagggaggggtgagggagggtaaaattacaattctatatcttaacattgggggtgaagcatttttaccctagaggaattctatccaaacacattaaacactcttaataagggacaaagggttgggacgtagcggttagggggcaagcccatgagcctcactccttgtgctctctctccaggaattggagagggaatccttttgcttagcattcccacgcctcccacgggcctggcactgggcccgcgggcttgccttagtctcctgggctgccctaacgcagcaccacgtgccgggcggctgtaacagcagcccgtaattctcccacagtcctggaggttctaagtcccagatcgaggggtcagcagggttggttcctccctaggcctctctcctgggcttgtagatactgtcttctccctgggtcctaacaaggtcatccctctgtgtgtgtctgtgtcccctcatctctagtcctgttggattagggcccgtcctaatgacctcattttaccttagttacctcttgaatggccctaactccaaatgaacagtcacattctgaggtcctggggcttaaggcttcagcatatgagttgggagtagggatgtaatatgcctaatgtccagaacaggaaaatccatagaggcagaaagtgggttcctgcttgccagggctggggacgggcagtgtggggtgactgctagccagcacagggtttcttctggaagtgatgaaagtgttctggaattagacagcggttgcaaaattctgaatgtattaaaaaccactgaattgtacattttgaaagagtgaatttcatggtatgtgaattatatctcagtaaagttgttataaacaaaaactgtgagggtaagaggtaaaaggaagggagttgaaagcagcatcaggtgtgaacagcccataattcagcccatagacgagcgcgaactcctagcacagctgtctgttgaagatgtgcgtgaatgcttgctttccgcacccttcggcctgcttttctctactctccaatttcatcatacattctcttccttcctccccctccccactttttcaaaacgtttcttctagtccttacttgtggctacacaaaattccataaacataatgctgcagttcaaagaagtgttctgatggtagggagataacttaggaaaatattttacctttggggaagttttggtttccttctgagtgaaaaccctccatgaaagagaaacttaaatgcagttttcaaatgctcctgagacattcccagccttttctttgtggagaagtgaaggcaggacaatttccaaggcaaagagggacctatcgcagacagcagaccccaagtaaagaaaggcacagtgatggtgggtattcgtgcagtgttttgaaaatgtggaggtcagggatgctagcttaccaggccagcatgatcaagttacgagaaatggagaccaggacactacctctgctgggtgtgctgctccgggctccttcgaaaggggaagcagctggtggacttccttgggctgtggttaaatggggctcccataggtgccatgaaggctctgcagagccagggatgcttgcaccctggagagaccttgctccaggagctcaggagctggtaggggtggtgacagtgaagcaccggcttgccgtgcccagtgcttgggcagtgctgagctccgagggaggaacccagaaccatgcgggagcaagggagggaggcaggcgaggagaagggttgcccaggagcctgcaggtcgggtcggtgttgtatcaaattgtcttttcctgctttgctgtctgatcccactaaagactagccagagagatgtggaggtgaaaaatggtggacagccatttttctccctttcactgtgtctacaatgtctgtttcatatcaacagcaacatctgtgcaggcatcctaatgagtataaataatgtcttcagaaaactgggtttgtgaggctcctgtcatctgaatttctttcatcatttaagtgatgattttttactcattgacatacagttgttatttagtggccacgtattattcgtatagggttctttatgtgctttctgtgtacatttgttttcgtgctcatcgtatttcagtgtggcttatatataataagatgcacctgttcttagctattgtggacttttttttaaaaaaaggtttatagagatatgattcacataccaaacacccatttaagtgcctaattcaacagttcttaataccctaatttaaaaaaaaaatacagtgttgagtattttccttttctcgtttttcactaaagtagactcaggattggggttatctgtcagtcccttggtttgattcttggctgccagtgtttactggggacggatgttggtacctcccttaataggatattgttacagcattttacaaattctggttaaaaaaagtcccacatgagatctcccctcttcccccctctctgagtgtaggcattgtcagctgcagttgtccagcatctccaggactcttttcatttgcgggatggaaacaatgtaccctctgaacaactcctccctgtttctcctccctccagctcctggcaaccactattccactccctgcttctttgaatttcacaacttgaggtagcttgtgtaagtggaattattttaaaagctggttcatgttaaagtgcttagaacagagcttggtgagcatccggtcaacagtaagtacttttattattctttttatattactctttttttttaaagaggccagacacatgggcttctgtcttttcacagcttgggatctgtgcagacccaggcttccagaagccatcccacttgaattcttactcccttttcccctaaaaagaagctctgaaatcctaattgtcaagaaggctttgcctgctgtgcatgcctgagtaatgttatttttgtcattatttgagagacagagaggaagcttccagtcccctgtaaggaaacgaaatcatcgtgcacagatgtggttctgtttatagagggaaggaaatggaggtgaagagtgtgtgtggcttgcagccaggcttgcgagtgtgcagaggaataaacttttttgcctccagagttttaactggaaatgtgtctgaattctacctcctgggcacactggcctgaggtctcccctgcatacctgatcgtgaaagtcttcgggtgtgtttgtaaacacgcagcccccctgatgtgagagtcagcacaaacttctaaagatgcgatgatgaattctatcagagaagtctttctggttttgtgaaaataaccttgcactctttaattatatccaaatgatcaaatctggctctgatgtcttgtcaaaattaatgttaaaggacagtgccctttatattttacttgtctgggtataaacatcctagtctttaaagttgagtctgtaggactacctctctacttgattactctgaaaagagtgtatagagtgagtttttaaaatggaattagtgtgcatacgaggaacagagtgacatttaacaaatccttcaatagatagtgctggtatgaggattggtgaaactagaggtagggaatgagcatttttggttctgtatcatattcccaagacattttcaaatgattcaccctttgccatcagaatggtttgaaatcgatcagcctgaatccactaatgtgggctgcggcacatgaattttaacactagaagcacacggttgtgctgtgtttcaaatgaactctggccatttgaagtgagcaggcataggcagtcttctgtcctgtgataacctcagtacatatcctttctgttttttaaagtaccttacaagctgctgcattacagtcgttattattgggccattacaaaaagctgtccaattttaagtgtcttggataattcttgtttgccccagcatcagaattgagcatttttttttttttttagatggagtcttgctctgtcaccaggctggaatgcagtggcgtgatctcggctcactgcaacctccacctcccgggttcaagcgattcttctgcgtcagcctccggagtagctgggactacaggcatgcaccacgatgcccagctaatttttgtattttttagtagagatgaggtttcaccatgtgggccagcatggtctcgatctcttgaccttgtgatctgcctgccttggcctccgaaagtgctgggattacaggagtgagccattgtgcctggccaaaattgagcacttttatcatgtagtattcatgtcttactggcaatgccctgtaaagttaaataagttacatttgtcttgcacaggtaataattatgaggtaatttccacagaatccaagggcctcattgactttgctataaaatcaaaacagtgaattctgataagactagacgcatgttactcttaaattgggctgtctcctggccactgttgtgcctttaacctcagcagaaggggagctgggctgcagagtgaaattacccggaggtcaaatattgctaatttgacttttatcatagagacattttctcctctcgcaccaaggcagtggctttaatccctctttcagtggtgagacaggtgcaaagcgtttacaaaaggctttctcttgttttgaatgcgccaagaaagatttccaggccgttaagttaccaatccttctttttaagtcttgaagcaattactgtaaggtcaatccactaatttcctttcagagttaccaaagacctctcatgtaatcatttggtacttgttgccatgtagccagtatcactgagtgcttttactgtgagcaaagcacaatgcatcgggcagggagggatccaaagggatcttggtttttacctttgagccatctgtggtcttgagtgatctacgtgcattagcaattaaaaggtcctgatattcttgtttgggcatattgaaaaatgtgctcttacagataggtttcctctctctactgccccccgccccccaattttttttattgtggtaaaatacataaaacagaatttaccatcataaccatttctaagtacactgttcaacagcattaaatattcattacattgtgcaatcctcaccacgatccatctgcagaactttttcatcataccaaacagaaaactgccccattaaacacaaactccctattcttccctccccacagccccagcaaccaacgttctactttctctctctatgattttgacactctagggaccttttatatgtgggatcatatggtatttgtccttttgcgtctggcttagcacaagtttcatccatgtcatagcatgcgtcagaatttccttcctttttaaggctgtataatattccagtgtatggatggactacactctgtttatccactcatctgtcagaggacacatgggtggctttcaccttttggctgttgtggataatgctgctatgagcattggcatatgtttacttctcattgatttaagtttacatagtcatgtgtggctagtggctgctgtattagacaggacaaccctaggcctgatagccctgaggacctagtttgggtgggaagacaggggtgacctgcagcgagttgtcggctgggggccttggtgagagccagatctgggttgtgaggccactcgaggcagggggaatggtgtggcgggaagtgaggcccaaaatgagaatttcagagttgaaagctttggaagtaacatgatgctctatgactgtgaccagactcaactgcaccaatgtgcatctgagatcaggtcattggcgttgaaatcgtgaaatgctcactgcttgggacgtttgcactgtgcttgatgtctggaggttccgttaatgttaaaatagcaattatgggactggagattaggtttaatgtctgggttttttccactgtcttcaaaagcccgggtcttagtagtaaccatgctgctccccattttagtaatttcagcctggtttatgttgctcaatagcagaaaagcggttcagatttcctttggatatcatggaccatatgtttgcccaggtatcctttcttattgggaactatcaaatagttaacacagatttctccaagggcaccgactgggaaattagtttaccaaagataaatttggtaaaaggaaagtttttatgtgcgctatccttaaactaagacacatctgtcgaaatattaggacgtgcccagtctcccatcctctgctgaaactttagactgtacgtccttcagatatcttctctttggtgctttgtttgggaacagattagcctcatacttcctcgcttgtaaaactgctatcccatctcttgctcaatgcttttcttgtaccgaagggtgagggggaggttccagctctgttttctgtatcagtttcctgggtgatgtttgtttgagggtgccttgtgtccagagccccagaaggtgtttccgttctctgatgagcctgaagtctgcatgcttcgcctttggtagggaaaggcagctggggaaaggttgcatggcccagtgccagggtgccagagtgcgtgtgcacctgctggggagaagcccgctggggcccctcctctcagcacaagatgaggcctcagggcagtgcagcagatggagggcttagctgtccttgccagcaaaagctgctgggaacgtggcactcagataacaggacggttgagaagcggtgagttagggttactctgatggggagatactgagaggaggggatgacaatcttgatttctgttccctttgtgaatcttttggtggccaaaatgaggaaaaggatacattgtgtttgaggacaacaaggaacatctaggcacattgcatacttgattaaatgcacaaagagcttcttgtgacctttatcacaagagtgtggttctatgaaggtcgtaggtacaatagaaattgtgttggtctgagagttactcagattagggtgcattgtgtcaccaccattttgcatagctgtggcaccttgtcaagttaaccttttcctgcttgcttttcctaatcagaagaatgaagttgaccgtatgtactctataaggtggttgtgtgaggtcaatgagattacataggcaaaatcttggtgcaggggcacttggtaaaggttagtttctgttataaatttggggtattctgtgatgattcctactcccctcttctcctcatggctaagttctacttattctttgacgtggctccgatatcactttcctcaggaagcccggtttcccacccagatggctttgggctactcatcagtgttctgtaaaatgctgagaatattgtttatagcacttctgggttgttttgtgatagtcttttgagatatctgtctcctcaccaaactgttctttgtgtcatgggcaggcccacgtcatcctcgtctttgtagtcctgcacctggcacagagcctggcacatagctcagtcaaacaggtgaagactgggttattacatcttcccactccacccccttcattatcaagtcgtggtcagggcatgccccaccaaatgcaaaccctactaggcagtacagctgagacttggaactagactaacccagtgactcagaaatgtgccacaggacttatttggctctagatggggtcttaaaagacattcatagttgcaggcagaacagaatatccagaacaggtgcagaataacctgtgtgtacacagtaggtggtagttataatgcaggaagaatttggcacaagaagtgttacagtttaaaatgaagtcatgggccctatccacactggggacagagataatagtaactaatcatcatcactgtcatcactagcccattgtcagaggtagcactgaacacttatgcgttagccaggatttgggttctagagggtttagtgtactagttgggttaccaagacaaagatgcaggcatggggtgcaagttaacaaaggttatacactaggtggcaactgactcacaggagcctggttattgcagcggttgtggccagagccatacaagtgttctgatgcccctcaactgtgttgaaatttgtttgaggccaaccaagtcagctggcgagggggaaggcaagccagagagaaattgtgaaccagaaaggccccacctctggcagtggctcttccattggagatgaagtcttcttgccctgtttttctctttaaaaaagtgagccatttcacaagggaagttaaattaaaaactgtgcttgttagcgcggagctgggacaaccgagggaagtgatgccaaaggcaattgttggtctttccttcaaatatgtgctgacttaggaagagcaaaatgttttatattaacaattaacaaaagactaagtctttcatcacaaacaagtctaaattcagtggttaggtcagtattatattttcctatagttttaaataagatgcttatgtattcactagtgctttggatgttctttggaaaaatctccaatttagtgacaagccccaggaaatattactcttagttggtccagcatcctatattgtttgtgaaatccctcttttattgtcttttaaaggttgtaaaatgctttttctgtcaataatcagagaaggatgccgcattcatattaccccagtttccaactcaacctctcctttccaattgaaaacaaaagtcagaattcactttttgttgtggggcattaagtagtaagcaaagagatttcactcgccagggaaaagaaggagcctgcaaatcagacaatatcaaaacataaccaaaccatataaaaacacaaaaatgttgcttggcagaatttaactataattaattgtactaatttaatattgtagacacaaatgatcataaagccatatggtacaatccttttgttcatgaatttcttattcatcaaatgttaggtacgtgatgtgggaaagccagtatgttgggcttcgtgctaccagggctagagttgaccagttcagctttgtttctccagtgaccaaaaaaaaaaaaaggtatctgccttgcacatgaaaacactggatggttagattggatttagccaacaacaaactgcaaaaatcggttctggctaactgaagctcacagggtttattagagttgttggagcccatgggaactgatggagggcaaggaggcttgtcgtgcaggagcagcaggaaccaaggaagctttgcagagatgagaaacaaaaaacagggaacacagcaacatttgctgtgtcaggaacgactgccactggtggcctggacaccatcacagccgcagaagatacttaagacacatttctgttctagtgttggtagttcaagattcaaagtatgtgtgaaagtgagtgtgtgtgcataggcagagtagctaattggttgagttggggtccatgtgcccacctccaggttggaccaggggacaagccatgcagcgttttggtcacccctcacttggcagtattcccaccaggaatgaccctcgctaggatttgaggggcctggagtcactacttactaattttcttaaagttgacaacgatcacaaacttcatggtctgggaaaatgtgaattaattgcctgatccaccttcatatcttttttcttttcttttttctttttttttttttttaacaaaaatctgtatattcatagattgtctcttcctctgctagtggttttgcagtagcattttcaggtgaggaaacaacaacagagtttagggtccagctctgtcattgccattgttgtagcgatttacaagttgttactgctagtatgaacttttgcctagttaaattttggaaacttgcctgtaattgcatttgatggatgataaaaattgataaatgacttgataagtgataaaaattctacggaagaattttccatggactggcttctggctttgatcctttccaactgtgcttctcctaccctcaggccgcccctatcatgctgtgcttgtctggccccactcaccctgtcctgacactggatgatttatttccaaatgaattgctcctggaagccattccaacaccattacaaccggcggcaacacagctgtcttggatactcctggaccatatagatagatgtaaccacagcattccggtagctcccacttccccagcattttcttttagaatgggggcatcagagttgaaggaggtaactgtgggtagtgtgtcttgtctttggaaattttcatcatgacctgagcttgtgaacactctgccttggccccgcctcgcactttggaagagactggagcaggagcgggcagcgttgccttcgcagcatggtaacttctctcagcgctgtttgtaaagcagaatgggagaggaaactccccagagggaaactgggaccctgttaggtagggctagcaagaggtggttaaaacgtaagcatccgctgcaccagactgtattctccacgactgtatattttttgttgttcataagagccccgaattgcaatgagtacgattttccctggacgctgcagtgtatggagaagctgtcacttgtcacatgacagctcagtcattcgatccctgggtgctgcagagagggaagaattggcctcgcagtggggagtgagtgccagcccgtggcctgtcccctgccacgtgtcaccatactgaacgtttgtgtgtgctctgtgtgttttcaaaacaccttcatgtcacctgccccggactcctccctgtgagcaaggcagggtgggcgttaccatccctctggaccaacaaggacagaacagcttgagacgcacagggtggcttccccatggctgcggaggcatagaaagtgagggcacgggacgtgaatccgtgtgctgggattctggccgcctgtgcctgccgatcaccctcagtgcctccctggatttgattttgtggctcttctgggtgtgcgtgtgagtgtgttgtgggtaagtctgttgtctaggggaaggaacgggaaatcatccggccaggaatctctgtggggtggtcggcttgagttggccatatccaagctctgcgtgtgtctcacttttcagagtagcaggaaggccgggtgactttgaaatcagatgggtattttcctgattcgaagagacttggcttcttcccccgcccctccttctccctcctcccccctcctccctcttgctggctcacaaactcaatggggcatcccagcccacccatgggaggccaggagaaagaggaggcagagctgtcagagtgtggcccttcgtcttgggggtgtgcaagtgaccgctcctgccccttgatggctctcctgtttcgggtataagggatgttgtccaaaccatgtgtgggactctctgttgacagttgtttttaaattgcctgtttaattgagcttctctaaagtcttctttgtgccaagtatcgggacaggtgatagaaatagaaaattcgacacaaatcgaaaattccagtatcaaaaatgacagcgatgtacccttgccccttaacgcagccaagaaacaggggtgaagggctactctccacatatggagcaggccaccacccttgagtgacagtagccgaacacagaacattctctgcagatgtcactgaggcttaaactcattatgttttaaagggataatctgctattcttaagaaaacaaaaaacaatcacaaatctccctgccctccccacccctgcccccacttagatcctggtagggtctggcagggggagttttgcaaggagttggggcaaattactccagcagatacttccaccccgtatcccaagaaatgtgtgtaaatgctgttatgaattaatttaaaggtattccaaactcctactaattattatgtgtttgctcaagtcaagatcaggagaagtacaggcattgctatcccatggggcctgtgaaactctggtgaggtgtcctagtggaagagcttggggccccatggtgtctggaaagcgggctccactggagattctggctgttttcagcttgatgcacacggggtcccctggagaatgccaggcctgcctgagtgtgcagaggtgagggatcctcacactgcccagcatgtacgtggctgggagactccagagagacatgcaaaagtgctgttaactagacggcgtggtacaaatgcaaagtgagtgggtttttttttttccttaaacgacagtgaacattcatttcaatatttattttgcttattttaatattttactcaatgtttatttatttttatgtttttgagacagagtttcactcttgttgcccaggctgaagtgcaatggtgcgatctctgctcactgcaacctacgcctcccgagttcaagcgattctcctgcctctgcctcccgagtagctgggattataggcatgcaccaccacgcccagctaatttttttgtaattttttgtacagacagggtttctccgtgttggtcaggctggtcttgaacccttgacctcaggtgatccacctgccttgacctcccaaagtgctggaattacaggcgtgagccactgcacccagcctcaatatttatttcaatacagaaacggacttaattgggtattttgttgaaggcaaatagtagcaaagtgggactggtgtgaggcagtggaataacttagtgaaatccaaggtttatgtagttattttccccccacttttttttttttttttttttttttgaaatggagtctcactctcttgcccaggctgcaatgcagtggcatgagatcagctcactgcaacctctgcctcctgggttcaagcaattctcctgcctcagcctcctgagtagctgggattacaggtacccgccaccacgcccagctaatttttgtatttttagtagagatggggtttcgccatgctggccaggctggtccccccatttttatggtttgaaaattttcaaaccctggctgggtgtggtggctcatgcctataatcccagcactttgcggggctgaggcagaaggatcatttgaagccaggagttcgagaccagtctggacaaatagcaaaatcccatctctgcaaaaaataaaaaaatgaaaaattagccaggtgtggtggtgcacatctgtagtcctactgcttgagaggctgaggtgggaggattgcttgagcccaggagttcaaggcttgtgagccttgattgcgccactgcactccatcctgggtgacaaagcaaaactccatctcaagaaaaaaaaaaaaattcaaaccctcagaaaagcttaaagaatagattcatggatcgttaaacatttttaccaaatgtatgttttctctcattactctaaggttgctccctttcccccctcactctcctcttctccttcccttcactccatggatgtgtaggacattctcctacaaaaccatagtacttacattcttgaggttgtcacacctcataattaaacatatgatggttttattaagtatgctgtcacatgtaaatttctccagttgtttgatccaagttgtactcatggatagtgtattgtattttacgtctctttagtcttctgtattgtagaggagtcccccaaccttcttctatgacataggagtttggggatttgtctgtttcccgatgtgattagagtgatgttgaacagttttggcaggaacgctgcacagctgatgattatatttcccattgcatcccctcaggaactcagaatctccttctccatccttggtgaaggtgtattcaccagatggctccctgttgaagctcccttctctctgttaccaatgagtaatctgtgctatgatacagtgagatggtgtgattattctgttcctcacagtggttttcctttggtggttttagcatccactgattaccataaattaattagtccagctttggcaaactatggcttgccgtggtgactcacgcctgtaataccaacactttgggaggccgaggcgggcggatcacaaggtcaggagatcgagacccatcctggctaacacagtgaaaccccatttctactaaaagtacaaaaaattagctgggcgtggtggcgggcgcctgtagtcccagctactggggaggctaaggcaggacagtagcctgaacccgggaggcggagcttgcagggagtcgagattgcaccactgcactccagcctgggtgacagagcaagactccgtctcagaaaaaacaaacaaacaaaaaaacccccaaaaaactccaccaagtctgtttacttatgtgttgtctgttaacagttgcttttgcactacaacagcagaattgagttgggacagagaccagatagccaaaaatattttctatttagctgaatcttgatctagtacatttttggtcaaaaaatgatgcatttctaattcttctattcatttttcatttagtagttggcattcttaaagaagagctttctgttttgacctttaaaaatcactatggattcatttattcttaatttttttttttttttttttttttttttttttttgagacggagtctcgctctgtcgcccaggctggagtgcagtggcgcgatctcggctcactgcaagctccgcctcctgggttcacaccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgggccaccgcgcccggccttattcttaatttttaaaagtgtgttatacgttgttgtcattacattattcttttagatacacaatgttgccctaaatttgcccagtgggaacccctccaggctgggcactgtgttcttctgtcacgcccccttcaggatggggcctgggttcttttgttatgctcctctaaggccctttaatctatgtcgtttcatttttttgttgttgtttttattttgagacagggtctcactctatcacctaggctggagtgcaatggcgcgatctcgactcactgcaacctccacctcctgggttcaagccattctcctgcctcagcctcccaagtagctgggactacagatgtgtgctaccacgcccagctaatttttgtatttttggtagagacagggtttcaccatgttggccaggctggtctcaaactcttgacctcaagttctccacccgccttggcctcccaaagtgctgggattactagcatgaaccactgcgcctagcctcgtatctgtgtcctttctttctgggaccggaagaggtttcaggttcccagtggaaattccctgcccctcaccttgaatcagcctttggccaaagagccttggagaatgatatttaatatttaaaaaccaggaactgagaactgagtgtgctcattgctatggggatatcattgctcctgggctccttgggtgcagagacccagggaaatagatgtttctgtgtatgctttcacactgtccctccctctcaagcccaactccacaggatgcttcctcaccttcctcttgccatctagtatcacgcttctgtagtgagaatctgctgcctacagcaacaacatattgacacatccattctcttctataggacacaaaaaaaggtttcagaaatttttacgttggtgctgccaccaccaccgctaccaaagcaatgaaataaagttcaagattccttgagattctcttgtcgttaggatgtatctcactgtgggtgtacagacaatatacaaaagttacttaatttttctccgatgtttatagtaccaatttgataatgtaagttaaattattcatctttattgaattttaagatatgcatattttatcctctttgagttaagtatttttcaaatatagaaaacgtttacgtggtccaaagtcaaaactctgttaataggtttgctcagagttctcagctcccatccttatcccaccaccccatttttactcacctcttcagttcattgccattactttttgccttatcttttttgtgtgtttctttttgcatctacttagtgcttttaagccccccatttaaaggcctaatgctaagtcttacatgtaaaccagcaaaaatgtcacctttttaagtagacttttgtgaccaaaaccttattatcaaagcgtgaaagttgagaccgtctagggagttttcatcatggtggttagacagtgtgtggaattgaaatgtacagcgtttgtacatgcaggtccgttattgagagaactgatccaaaaccgtgacgactgccaataaaatgtactttaccaaatatctgctcaaaatgcccatgtctccttaatgtcaatacccaacacatgggtacatccagttttagtctcaaatgttttaagatttattaagcttggtttgcaggagtttagtgttcttggaattagaaggatttctctagtgatgtggtgagaagagataaacctgggaccttttgtgttttcttgatacgcacatttatgttgtgtgcaacacaggaattgtcaggaacctgcaatgcaatctttcttgatttataatcttgcaaaatgtggaataaaaagtaaagtgcaaagtttaagtggtaagtgttacaattcatgtgaacaatatgatgctttttctcatgcttacttgaagacagcagctggcccttgagttcagtctcagtgcaaacagcctccaaagaaagtgcattgcactaaggaagcccttttcatctcacaaagggcaaagtctggattgcccccctttctctgttgtctttgcctgttgctccctggaccccagccagtctccccaggcctggagctgggtcagctaggtctgtggccaggaggtgggggtccacgtccactgtgctcctcagcggcaggttctgcaaactgcagcccgtggggcagactccacctccagcctgagtgaggccatccagctaagaatggctttgacatttttaaatggccagggtgaaaaaactaaaagaggattttgtcatgacacatgaaaatgatataaaatgaaagtgtcaactgtcatacattttgatttttgtcagtttcagagaaatttattttctctttttattaaatgtcactacataatatacttgattttgcctttctgctcactgaagctaaaatatttactctctggccctttccggaaagagtccgccgaccccctctctgtggaatgagagcttccaaaaagatgcagaagaccgtgcatcccaagcggttgtaaaagccacttactttcgtaggtttaatgactcaaaagaaagggcgcttgttccctcccttccttcctgggcaggcccctttttggaatggagtttcgttatacagaaagttgttctcgctgtacagaattctgcgatgccttcacttgatggctgtttcttcggggataggagggctgggggtcaggatctgatctcacacgaatggttcagagtctggacttagtagctcagagcagttcactgatttgggatctctggaagaaaagggtactgagtcactggcaccttctgctcagctcctgacagcagtgtaaaggatgctttcgtgacacccagccttcagcccaggaggatggtggcagatcagacagctctggaaatgcagggcacaatgcgcagagggttgcaccacaacagcagtcactcggtgcccgcctggagcactgctctcatttccagagtccctgtatttctgatcttggctgctttaaaaaggaggtgtgggcctgggatcccagaagtattcctctgtgattctgtaccacagctttaccttaattgggggtgtagggggtggggagaaagaggaagacagatgaaagcagggaaatccttcttggagtcatagttaaaaggataaaataagagctttagtgtagcctccgtttccagcaatccattttattctttgtccacaaactgaatgaaaataagcagtcattcaaaaatgatatttacgtaacctacaaaaatctcaatcaaccaaggaaaaggtggaatggggcttaatacaatacagggctgtctccggagttccctcccttgatttcaggcttttggtgtaaagctcccgaaagaaagcaactttgatttttattagactcttcaaaatcatctcggtagaatattgaccttttttgtgtgtggaaaaatgacttctacgaattctcttgtaggagtgtacattttggtcattttttggaatgtaggaaaaaaaatgtggggtaccctttattgcattttcaagaccttccaaagaagataattctgattgtaactcattataatctgggaaagtagattgttctggtttcaaggactgcgtgtgctttaaataatcacaggctgctctcagacttgggaacttttggtagaatacagcagtgattctcaaccagggcagttgtgttccttgggggacatttggcagcgtctggagacatttttggttgtcacgttttggggaaatgggtggtgctcctggcatctaatgggtagaggcccaggatgctgccaaacatcctacagtgtgcaggacagcccccccccaaccaagaatgatttagccccagatgttcatagcgccagaggtggaggaactgcctcgggggatgtgtaggagctttactttatgggttttttaatggaaaatatatgtatagacacgtacatatatatacgtgtacatacacatgtagatgactctgctcagcgcacccatgaagtatgcagtgcacctgtcccctgggatctggttatacgatgggtgtccagcctgtgcccaggggatcagtttcctttgtgctgctgcagtaccttgtcagcatggagagggggaggtcagttatgaggaggcccttttggggtagagtggaggaatggtgccgcctggtcaaggcctcgcatggggtagtgttctttgtacagttctaggtgaggcggcgaacacgttctcatgcattcttcatggtggtggtgatgctgatgttaagaccaacgggcctctgttgttctgctcaaggttccaagtagagtaggttttctattttcaaaatgtagttcacggtgtcccaatttttagtgcagcgtatttcaacaaaatgtccttttacacatataaatggcttatgttgcaaggtccccctcagcttcctggtgtggaatcagtgatggataaaggcagagaggctctcaggctgacatatactccctatgaagaggggggaagaactgtgttggcccatgggtgtttggggaaacacttgtattccaaggtatttgtggagaagatatgggatgtttttccatgttgggcttcggatatgaagtttaaggaaggagaatggagtcctggtgcacacctctcataagcacacgcacgctggccactctgctggctccagagtcatccagagcatcgagcatagtttctcccccggagaccctccaatctgatcagatagggaggctgtgagtctggtgacccccactgcagggggcagagctagtgcaggtggtgctgagctgactgggagaagaagggcctgcaggaccggctgcaaagcccttaggggagggaggaagtgaggaatttggtttcctaaacgggtggtccaagagaggccgggttcatcgctgtgcagtgaggtggcactggaaggagggagtcctcagatgggccaccctttggggctataagtctcgtggtttgtttctcttggcttcaagataacatatctagtttgggtgttttgggatgatgaggttggggtgtttgggaattgaggtggccgcgtaggcattgaggaagatactggtgttttgtgcggtcaaagggcaatggtgtggaactcagatcccagctctgaccctgtgtggtcttgggggatcatccaccatcagtctatttctctgtgacttggggataacagtacatgtgagcgtgaaataagagtataaattgcatcaatgtctgtgtgtcaaggttgcctgaggaggagttggctgggcttgcactgacgcttgattctttgtatcactccgacttaaaccacgacacttccaaggcagagtctaaagcctgtcctctcacaatcttctacaggtgagtaggaggccatagaccttgtgagtacagagtcctaaaagaaggcagaaatgtgtgaatctgccaaaagtaaagaaagggtgttactactggtcaaagtcgttgcaagaatgctggcttttacaactcctgtttctgctgctatcacctgctgcctgtgtcttgtttcctgggctccagatcattttcacatttctcaaaatggtccttggtagctgtggtagatggaataatggccctcaaggtgtatctccatcctaatcctggaacctgtgaataggtcattctacatagcaaagtggactttgtggacgtggtttaaggatctcaaggcctggtgccaggggctcatgcctgtaatcccagcacttgaggaggctgaggtggaagggttatttgagcccaggagttcaaggccagcctgggcaacagagagagaccctgtctctagaaaaaaactaaaaattagctgggcatggtggcacgtgcctgtagtcccagctactcaggatgctgaggtgggaggattactgaagtccaggaggtttaggctgtagtgagccatgttggcgccactgcactccagcctgggcaacagagcaagacactgtcccagaaaaaaaaacaaaaacaaaaggatatcgagatgaggttggggaggttgtctgggtgggcccagagcaatcacagaggtgcttctgagtggaatagggaagctgggggaacagaatcccagaggagataggaggatgggcgcagaggccccagtgatgtgggcccatgagccaagggatgctggcggcctctagaagctggacaaggcaaggaatcgaattctcccctgaagcctttaaaaaaggacacagccctgtgacccattttagacattgcacatcgagaacctaagagagtgtgtctgtgttgcttatggtagccgagctggagattctttgtgacagcagcaacaggaaacgcagacagtgggtgagcaccagatggtagagtcaagtttaatatgctggagcaaggagggtcagctaatcactggcaaaagatcagggcctgggacttttgctaactgtttctatggattcctccttcctcttgcaatgagaagcgacagcctcgtggtgaaatttgttagctgtttattattttcattgatctgattctactagtgtgatttatgctaagcataaatgaccaaagttgactgtggttttttgaagaacattggaaaataaacgtacaaaattatgtttttataataatggttcagtccaaaataaaggaatatattcatagaaattagctaaaattatagagggtaagttacatacatcttcttcttaaagatgctggtaccaacactggaagaagctgtacaagtgggcaggttgttttttgtttttgagactaggtgtcactgtcacctcaacctccccaagctcaggcgatcctcccacctcagcctcctgagtagccgtgactacaggtgtgcacctccacatctggctaatttttgtattttttgtagagatggactttcaccatgttgtccagactggtcttaaattcctgggttcaagtgatccagatgccttggcctcccaaagtgctgggattaggggcatgagctacggtgcccagtctcaatttttaaaaatatattttaccatcactttccaagctttttgtcctatgtgacaacagaaaattgaatttcttaatccacttacattgaatttaaaatccacttaggaaagtgagcttcaggtattagaattattaactccgaataagcagatactctagcatattttatcttccagattgtgttgtgattgtaacaagacacattttatgcattttagttttcatcacaaactggctgaaaatcatgttatgtacaaatatgacttgattcaatacaatttattgtttgggtataatttgaattagaaagccatttgtataccttttgctcacttacattatgctattatgcttttgacatcagaggaaatacacttacttaaaatcctcgcagatcccagagcaaatgaagagtttttgttcttttaaaaattggaagtagtctagttttctggttgtacagtaacaatgtgatatatattgtctttatcatatatacacacatacataaatcatctttccttcaaagatctcagatcacttttttaaaaaacagctttactgagatataatttacataccataaaattcccctattgtaaatgtacaggttcagtgaattttagtaaatttacagagttgtacagacatcgagacagcacaattttagaacattgtcatcactccaggaagcgtccctgtaaccattagcagtcacgtcctccccagcccctggcggccactgatctattttatgtctctggatttgcatattctggacattagatataaatccaatcatataacctgtggtcttttatgtctggcctcgttcatttagttttcaaggttcatccatgtcatagcatggattgatccttcactttttattttattttgtgttttttagaaacagggtcttgctctgttgcccgggctggaatgtagtggtaggatcatagctcggtgcagcctcaaacgtctgggctcaatcagtcctcccacctcagcctcccaaatagctgggactacaggcagacaacaccacgcctggctaatttgtttttagttttgtagagagagtgtcttgttatgttgcctaggctggtcttttgaattcctgggctcaagcgatcctcctgtttcagcctcccaaagccttgggattacaagtttaaaccaccacacctggcctgttttttattgttagataatattccattgttataaatatcccacatttttagattgattcatcagtttatggacatttggttgctcccatgttttttgctgttataaataaagctgctgtgagccctcgtgtacaggtgtttacatgcacatatgcttttattcctctggggtagatttctaggagtggagttgctgagtcatatggcaatgctatgtttaactttttgaggaactgccaagctgctttctatagtggctgcagcatttcacattcccacccaaatgtatgagggttccagtttctctatatcctcgccaacacttgttattctctctcagagaactttctgaatctctcttataatgcctagggggttccttgttgaagatgaaattagggactaccatgaactgctttaggaaacctgggagaaaggagtcaggcccctttttcatatctatgcagtgtaaccggcctctcagaaagattggttggagtggatgggagaataaagaaatgaatgggttgggtgcagtagcttacacttggaatcccagcactttgggaggctgaggtgggaggatcacttgatcccaggagtttgagatcagcctgggcaacatggcaaaacctcatctccacaaaaaaatacaaaaattagctgggcatggtggcacacacctgtggtcccagctacttgggaggctgaggtgggaggattatttgagcccaggagttagaggctgcagtgagctatgattgtgccactgtattccagcctaggtgccagtgagactgtgtctaaacaaaaaaaaaacaaaacaaaacaaaaaaaacagtacaaagtgttcagtgccgtcagatgttctgaatatagtatgatgagaatgcagtggtgggggagaaggtggattagtttctgtggctgctgtaacaaactaccacaaacctagatgcttaaaactacacacatttactatcttaacagttctgggctgggtatggtagctcatgcctgtcatctgaacactttgggaggctgaggtgcaagaattgcttcagctcaggagttcgagaccagcctgggcaacatggcaagaccctgtctctctctaaaaaaaaaaaagccaggcatggtggtccacacctgtagtcccagctacttggaggctgaggtgggaggatcacttgagtccaggaggtcaagactgcagtgagccatgcgagtgctccagcctggatgacagaacaaaatcttgtctctataaaaagaaactggaaaaaaaaaaaagtagttctagaggtcataagttccaaatgggtcttattctgctaaaatcgaggcatctacagggtggtggtatttgctgaaggctcgagggttaagtttctggttttttgttttgttttgtgttttttgtttttgtttttgttttttttttgctttctcagtttctagaggctgcccatattccttagctcatggccccttcctccatctttaaagccagcactgcttgttcgagtctttttcacattgcatttcccctttcacattgaaagcactcttctgatgaaccacttctgttaaaaccactcttatgatccaagataatttacttttttaaaagatgaactgattagcagcctgaattccacctgtagccttcattcctccctgccatgcaacttaagttgttcatggtttctgggaatcaggatgtggacaccttgggtggggatggaccttaactctggctgccaccaatggcgcctggtcaaagtatcctgtaggatttattcttggaaacggcgttaaccccaacgccctactttgctggctgtgtaagaaacacgaggtcagtcaggcagtaagaggagcatggacttgttttctgaaacagcgacacaatccattacatattttcgaatgacgagatgagatcagacttctgctttaggaagagtcacagggttttgtggatttgcaggggaaacaggcggtcagagggagttctgtgtcaccgtccagaggctggggtgccaaggagggcagtggcagtgggcttgaagagatgcaatggggctgctttggggctgaggcgactggactggcgtctgattgatggaataccaggagagggatgggagagggaaagagatgagtccaggatgacagttggaaagtcctggacttcggagtaaagggtagcgattgaggagttaaagggtagaatcaggctggggagagcaaatttacttttgaaatagtgacctttggatgctggacagggagatatgaagcaggcagaggaaatatgggcatgaaatagagcttcagcattttctacaaagaagccaccacattcggtgacatgacaagggagtgatgccagagggaagagaggtacaagggcagaatgctggggaaatgcctgtgtttaatgggcgtggagaacccgcttaataaataatgagaatatattgctggactgaaacaaaagtcctcattagctcattaaatgtttcctggaattcccagtcaaatctgtgaaacaattttaatgctagatgttttgtaagtatttctccggaaatctggaaatttgtccacagacccccagacattgtttataaactgaagtcagttgactcaagtattttgcaaatgtctatggaccctagtgtgattaatagaaacacaaattattttaaaggtgtcactcaatttacagtcattctgtatttttgccatttggtattttttcctgaaacattacataataagaatgcagcatgctttctttatgtaggtgatctgtgaaactttttgacaattaaaaattggtttttggccaggcacagtggctcacacctgtaatcccagcacttcgggaggccgaggagggcagatcacccaaggtcaggagttagagactagcctggccaacatggcgaaaccctgcctctactaaaaatacaaaattagccgggcgtagtggtgcacacctgtaatcccagctacttgggaaggtgaggcaggagaattgcttgaacctgggaggtgcaggctgcagtgagccgagatcttgccgttgcactccagcctgggcaacaagagcgaaactccatctcaaaaaaaaaaggaaggaaaaaaaaatatatatatatatgtatataaaaattggtttttgctgtttgttgcggcatcacttgcagttacaaagaagtgaacatagtggttacagattgggttgtaaggctggacctggccgtatgatgggttactaggcacctgttaaaaatagtactgtggaagtggtatatttattggcatgtccatgtgtttacaatatattacaatggtgttactgtaatccccaggagaccagcagcccagctgggactctgagagctctaagatacgtccttggagtaaaccaagctgcaaggaggtctgttcacttctgtattgtttatccactcataaatttgatttacatagctggactttggtgttgtacagttatctcataatgagggttattttaagaagtgtctcaaggaaatgtgtcgtgtgtttactgaggatagcgttgtatgtagtccacaatttcctctttctgggagaaattttgcacatgtatcagaagtctaggagctgtgtttctgatatttgcatcttctttattgtttagatactgtgaatccagcatctaactatagttccttctttgaggtctaggaaacttggaattggattgacaattcccttccaagtgatttcaggttgtatccgactgcgaactttggataccgccttcctgtctcagcttcgtctcctttgtcctaccatgatcttctcttggccccagtttacccagtgaattactttatttttgctattttgtatgtgtttttggaagccacccccagttttttctcttcttttcctgggtggggagttagaagtgttgcagtggatgatggtgctgtggctttttggaggttggtttgcagtagcttttgagttctggtgtgttagtgtcatcttattctaatctagctgcttcctgttgaagtacatcaagacgaagtatatttctaaatttattacgatgaatactctatcaaaagcagctggtgcttaggccctaggtagagctttaagataaagttctttaatatcaatttagaaaaagaaagattcataatgattaatggagctcctgcatcactgaattttactggaataaaaaaaattagtgggcttaaagttacattgaatgtagtggaaattctttttcttatctccattactgttggggaacaatttcatctaaaccccattgaaaactgggccttatagccttcagtatacttcataacatttgttggaaagcaggaaatgaaaacgaagtatttgaagtaaaagttcttaaatgtgtcccaagaaatgaggattactgcagaaagaatggatcagttatttctcgaattataagaaggaaatatctgcagccttttttgtcatcagtgcagcagccccggtttttctgttaatcatagctggtaataatgccctccggtttatagttttgatgagccgggagctaggctgcgtgttttacatataatatctctgttccatcagctgcataacctagatatccttcaccccatttttatgagactcatgggttcttgtctgggaccatgcacctagtaactgacaagattgcaaactagttatgtcacctgtggagttccacgacaaaggcaattctaggcgatgtttatgtagtgttccttgcatgccagggggattctgtgctctttccatgtgtgaatgatagcatccacctgctaactttgttgggagggttcagttatcctctctgtacaggtgagaacaggaggtactgaggacatctggcccaaggatactaccgctggcacggggtggatggtgattcgccctcagtccctctggcgcagcatctgtgctgtttgctgccaggccagctgcatcccagatagagtgacaggatctgttcgcgtcacatccagaaaaggctctgaggccaagctccctgcgttgcttctcactttcactctggaatcagaggtgcgtgcctggaggacttagctctgcatggacagctggtaaggtgtcacagagggtgaggtgggccattgtagcagagagttgttaagagttggttacgtgggttttctcacagggtacaaggctgaggaatgggaaaccagttaggagaccttgctaatagcgtggaccaaagatggggagtaggtccagacagattccgcagtgttcatgcagtgttcatgaagcaggtgtagacagattgcggggccattcatgaaggtgatttgccggggctttttacggatggaaaaccccttttctgtgttcatcccacctcctgttgtcgacagatgacacctgcacaatcaggtcctcccaactccttccaccacccaaagtgaaatacgcaagtcccagagaactgtgtcattcttaccgaagtggctgatgtaggatgttagaaacatctcccaccccaagttgtgacaacctgaaacatccccagacattgctaactgcctcttggagggggcacagtcacccgctgttgggaacacaggcctaaaagcttggagccagggctgactgtctgtgtaggctagaacagaattcccaatgacccatcaccatgacatctgacactcaaaccgcaccccaccccgaccccccacaaccaccaccttttaaaaatttccatttttggaaaaggctggggcttagaagtcattatgaaggcacccatttccagaagggtaagaatcagaaagttggctaattcgggtctctgctttacaggagttccgcagcgtctttcagtagagtgaagctccagtatttgtatgagtgttggggttgtttggtggtgtggggtaatgcaggaggagagaattggggaactgttaaccaccacccaaacaggctatagagaagaatgccaggggactttactgtgatggagacaggagcgttgaagtctgaagagtgacatctgggttctctgtacgttctgatttcttctgctaggatgagtatagaaacatgttctctggggtgaaagtgaagccttgtgaaattcatacaggtgaagctgctgatagcagctcttcccgatggcatgaatatggaggtggcggttgaagcaagtttggtttgtgaatagaaatatacgtgttcatatgtatgtgtgcacgtatgtgtttgtgcatgtgtatgctttaggacccagttcttggattagctgattatttttttccctctctatagacattggtgacctaggttttcagatacttatgtaagtgaatagttgaatttgtttgagcatatttaattgctttcctgaagggatttgctggctgttttgttaaatgaaattgaagacagtactgttgacctttccaggtgaggagggagtcagaagtgttttgcaaatgatggaaactgaaacgtgagtaccaggaccatatgatgttcagaaacttttatcataactacagtgaataaataaagtgcttgacaattagatttaaaattaagcttcatcctcattgcaaaatgtggagacagtgctttgggacatgaggaagagattaattaggattcttttctacctcaagatgcgctatgtcatctctgaacaaaaaactgattggtattacgtgaggattatcttcataaagttcagagttgtatctacggggacagatttgaattgctgttaattgacaatttgctgaattggaaagatcatattaccttaatactttaatgtatcatctttaaatgtgattctttttctttctctcactaaagattagtttcatgccactaaataaaatttaatcttttgctgtaatttaaataataataagtgcttacaaacatattatgcagctgatagcttgttaaaatttcctgtgggcttgttttttgtttagaagtactgattttgccagttgtacaagcatgaaatattgtttatcaagcctcataagacattaaagaggaaatcaagtttgtgtgactttaatgtctctttttctccttatttcagtggctcatacttttaccctgaacttgtaaaatctacaagcttaataagattccatattttataggaactaatggatattcaatgacttgcctgaagagtagactaagaaaatgtatttctccatgaatctttacatagaaaaatgaaagatttttcctgaatatttatttctcaatatatacagcattaatatgtctgtttttcttcaaagcagaaaaaaaaaaaatcagtgattgcctttgggttttgatcttgctctgtatttgttttaagtacacacctattacatgcccactgtattctaggcactaagctctaatgaaaagtggtttccagtcattcgaatggaacaggaggctcatgtactttgaagtgggtatacagaacttttgcactttggttttattctactttctgtctatgtccttggcactagaatgcttggacgacagtttgctatatctgtggtatttatggaatgagtgaaacatgcaaggagaatgccctggctgccgttctggcttctgccctacccagagcatccagtatacagaagcagcgtttcttaccacagcttgcggaaagacacggggagtagtcggcttgccatataaggaagttgccttcagtggccttgttcattttaggtgttttttaatacttgcttctcttataatacatgttactgttccgtgaggaacctcagcagctcccctaaggggaaaaaaggaggagtacttgaaggagtactgtttatacttcaggggcaataaaatccatgtttatgcacaaagggacctttccacttgtgtgataaccattctacaaggcccttgagttcctgtgaggaaggaaggacgccataaggaatgaaatcacagaaccttattatgaaaatagtaatggtgggatttggaaattatactcaattttttcttctgaaaacaaattgaataccacctgagagttggtgctaaaggccctgattttcgtattttaaaaaatttttggcatagtctttggatttgtgctgtcctaatatggtagccaccagctgtacatgagtatttaagcttaactaagattaagtaaaatgtaaaattcagtttgtctcacactagccacattttgagtgctcagtagccacatgtggccagtggataccttattagacaaggaagatgtagtgcagaaagttttattggacagaagaacaatggttattcagatatttccctattgggaattccagggaagaaagggaaaacttaaatctgaagaagaaaaattttataccaagggactagggggcaatgcagaaaaattaaccacatcaaaacaatttactacatcaaagttcattgtcatgacatattagaacattagcataaaggaagtatctatgcacttcccggatttaaaaaagagtcacacgaaggatcttggaatcagaatgacattgtatttcttaacagcaacacgtgaagttagaaaacagactgaacatagacttctttgaaaataattttccctcagaattttgaaggtgttcctccactaattattaattaaggatagaataaagatgtttgggccgggcgtggtggctcatgcctgtaatcccagcactttgggagtctaaggcaggtggatcacttgaggtcaggagttcaagaccagcctggccaacacggtgaaacctcgtctctactgaaaatactttcacatgtcacttctaggaaacttatggagaatatgtcccaccaaagtgagggagtaaaccaagaaagggggaggtttgggatcttggaaacagaaagaggcagaaggaattctcaaacaaaggtgttttcagggcagtggctcttgtagtacagactagagcaggagacaaattttaggaggaggccaggcgagatggctcactcctgtaatcccagcactttgggggggcccaggtggacagatcacaaggtcaagagattgagaccatcctggccaacatggtgaaacctcgtctctactaaaaatacaaaaattagctgggcgtggtggcgcgtgcctgttgtcccagctacttgggaggctgaggcaggagaatcgcttgaacccaggaggtggagcttgccgtgagccaagatcgcgccactgcactccagcctggtgacagagcaagactctgtctcaaaaaaaaaaaaagaaattttaggagaaagtttggtgttagtgtattggtcgaaggtgggagggatgtgggtgggtgttgcgggaggaagggcatggaactgacaaattatccaagagttttgatcatgtaaaaaatgtaatagattgttggagagtgtgggaaggattatcaaagagtacaaagaaaactgaaatgaaaacagaggcaaataataattctaggagaacacaaaaagtatactaaaaaaaaatcataggctgggtgcggtggctcacgcctgtaatcccagcactttgggaggccgaggcgggcgggtcacgaggtcaggagatcgagaccatcctggctaacacggtgaaaccccgtctctactaaaaatacaaaaaaaattagccgggcgtggtgttgggcacctgtagtcccagctactcgggaggctgaagcaggagaatggcgtgaacccgggaggtggagcttgcagtgagccaagatggcgccactgcactccagcctgggtggcagagcgagactccgtctcaaaaaaaaaaaaaaaaaaaaaatcataatcatactatattgcccactcagcagtgcccattccattgtcaaagtaatatatgtgaaatattgatttagctgaaaaaaaaagttatatgagctatcgaaaacgtggaagggtcagtgtaagattggtggtgggaatgtaaaaaaccaacaatccttacctatgtgtgtgaaaatcagtaagtgatatctaaacttgatgtattgattagagtatcacaaacagactatttagaaacatggaagtctggccaggcatggtggcttatgcctgtaattacaacacttcgggaggccgaagcgggaacgtcactagagccccggtgtttgagaccagcctgggcagcatagcgtgaccctttctctaccaaaaaatttaaagcattagccaggcatggtggtgtgctcctgtggtcccagccactggagaggctgagacaggaggatcacttgagtcctggaggtcaaggctgcagtgagtcgtgatggtgccactgcactccagcctgggtgacagtgagaccctgtcccaaaaacaaaaaacaaaaacaacaacaaaaaaacaaacttggaagtcactatgcagggaacagcaccaataacagaaacagctccaagaaagtggttgctttgggaagtggaattggtgatagatggtgctaaaaggcatgtaattaataaaaggagccttttgcctcacctgcattttaaaaaaaattttgtacatgtattactttgtaaagactaaaagtggtttggaaagtgaaagtataggatatactatctgtataattacagacattttggcatagttaaaagcagggtttcacaaccttggcattgattgacgtttgtgtcaaataattctctttgttaagaggacctgtcctgtgtgttgtgggatgttccgcagcatctctggcctccacccactggatgccagtggcattcctccgccagtcctgacaaataacagtatctctagacattgcccaatgtttcctgggggtcaaaattacctgtaagaaccacttgttttgaaggatttttaaatatgtcattgaataaacctcaatatataaccctgctgtttgatattggtaatacaggaaacaccagcttccttacacagaccttgaaccctggagcaaatgaagcggtttggaatcctctggcactggaacacccgcaatgctcatgctggtgcatgtattagtcagcgtctggctcttggcccggttaattcagagctcactaaaaacagaaaagggatcaggaggaaactgcagcttctctgtcatgcttagtggcttctgaaaacatattttagatttttcatgttgctttcatgatggtacaacttgaatttctctggagttgaaatgttaatcattatggcaaaaatattgcaccctttggatgcattccagtgctcaggtggctgcggacagatcctctctgtctctctgcttccctccacaattcttttgcaagttcttagttaagttattgtcaagtgtttttccctagaattgacacaggaagtcaacaggaaaatggtatctcagattttttgatgtggatgaaacctcataaatagtttaaaaccctcatttcacagctgaggaaactctggtgcagagagggttttttacaattaattgggagcacaatggggcctggaactctgttcttctgttttactctttccttttaaaatacaacatgtgtgcccagtaatgctggaggaggatgatagaacgggctggggaagggctagggcatctggcgggtcatgggagtttgtcaggattttcgcactgttagaagttctcagcatcctctgccaggggcgtgtacccttagtaagcttagagaaaatggcacagagaggcaggaagtgtagtttccatgatctttccaggaggtgctcctgtacctcagttcctgatggcccagaactgggtggagagtgtaggctggtgcattggcgtgtctgacagggaagaccctggcctccttatcttgcagctcttgctaccagggcactcatggagccagcgtgcaccgccactgcagctgttcttgaagaagtggccagaagagtgaaattggcccgttgaggaagggtgtggagctgcttctctgtgggtccctgcatgacttccctgttccttcccctgggatcaaccttcctcaccccacatggttcagcagatgagggttaagtctgccccagcttgggggacgctggtgtcccactcaaaccggttgtccagtattttggtgctgcaccaggagagtgccatctgcagtctgcagggctgtcttgcccaggtggccccttcttccctcggatggatggggcatactgttctgaccaccatgtctccttccaggccacatcctctttcgtgagcactgtgagggcatcaccccacatttttagaaacctcagcgccccatcttgcccccatcccttgcctttggcaccacttaaactacagcctcattctcttcctcctcgcctgagttctccagccaactcaagtgccacctcctccatgaagcccctgtaggtttcctccactgggacaaggacgcgcagagatgaaaggcagagaagtccagccctgggacttccaggccgtcagttcaatcctttgagcctctgtctcctcctctgtgcagtggggcagttcagtgctcccccttagtgctgtggcacgctgcgttgattggcctgggtgctgttgcggatgcccagcgagttctctgtctccctcctggttcttgtcccactccctgctccctgttacagcctggaagtggttggacggtttcccctgggagtcttgagaacccccaaagacgccatgcatcttcttgtcctcttttcgtggcatgttctgtgttgtgtgtgtgtgtctgtgcaacgtgctgtggcattatgtgtgtctgtgtttgtggcgtgttgtgttgcatgtgtctgtctgtactgtgtgtgttgtgtgtgttgtgtgtctctggcgggctgtgtatgttgtgtgtgtctgtgcacgtgctgtgcggcatgctgtgtatgttgtatatgtctctggtgggctgtgtatgttgtgtgtggctgtgtattttgtgtgtctgtgtggctatatgcggcgtgctgtgcatgtcgtgtctatctgcaccgtggtttgtgtgttgtgtctatctgcgtggtgtactgtgtgtgttgtgtctatctgtgcagtgtgtctgtgtggtgtgctctgtgtatgttgtgtctatctgtgcagtgtgctgtgtgtgtgtgtgtgtggtgtgctgtatgtctgtctgtgcaaggtgctatgtgtatgtcgtgtctgtgcagtgtgctgtgtgtgtgtctgatgtgctgtgtgtgttgtgtctatctgcagtgtgctgtgtgtgtgtctgtgttgtgtgctgtttgtgttgtctctatctgtgcagtgtgctgtgtgtatgtctgtctggtgtgctctctgtatgttgtgtctatctgtgcagtgtgctgtgcgtggctgtgtggtgtgctatgtgtgttgtgtccgtctgtgcaccttgctgtgcatgttgtctatctgtgcaccttgctgtttgtgttgtgtctctctgcacggtgcactgtgtgtgttgtgtctatctgtgcagtgtgctctgtgcggtgtgctgtgtgtgtgtctgtgcagtgtgctctttgtgtgtgtgtggtgtgctgtatgtgtgtgtctatctgtgctgtgtgtgtctggtgtgctgtgtgtgtgtctctgcagtgtactgtgtgtgtgtggagtgctgtgtgcgttgtgtctatctgcagtgtgctgtgtgtgtggtatgctatgtgtgttgtgtctatctgtgcagtgtactgtgtgtgtgtgatgtgctgtctttgtggtgtctgcagtgtgctgtgtgtgtgtggtgtgctgtgtgtgtgtctatctgtgcagtatctgtgcaatgtgttgtgtgtgtgtggtgtgctgtgtgtgttgtgtctatctgtgcagtgtgctgtgtgtgtgtgtgtggtgtgctgtgtgtgcacgtgtgtggtgtgctgtgtgtctgtgtggtgtactgtgtgtgtgtctatttgtgtaccgtgctgtgtgtgtgttacatgtcctgagctcacgccttctgttttcacatttgactgtgattactgtcctttttgagatctgagtaacagggacagggctgggcccgatgacttaggcctgtagtcccagcacttgaggatcatttgagcccaggagttggaggctgcagtgagctgtgatcgcgccactgcactccagcctaggtgacagagtgagaccctggctcaagaaacaagaccaaacgaaacaggaatgggtggccagttctgccacttcctttttatttgtgaaatctaagcacatacataatccaggtagttgtcacggaaaggggccataactcaagagaagtggtgccctggagcctaaaggctttcccattaggataaattagaactggaaattgtcataaagacaatgcagggtttgtggatttcagctggatgagtaaagaccagcctgggcgtgaaggattttcatagtcagttgctaaaggtggtgccccaggaaggctatttggcaggcgtggggcgcagtcctggcatggggtgggatggggctggaggtgctgctaatctatcttattaaaacccaggaagtttcacaggcgccttccaaaccacagctcgttgatttaaagatgtgaattccacgtgtgtaagccaacagaacaattgcgttttgtggtctctggctgatgaaaagtccctgatgaagtgctgtttggtaaaacgattcctctccattttcctcccttccaatctgtggttcacatttattcaacgttcttttctttcaaacagcatttgtgtgtagccaacacacatgcatatggagtgctgcgaagtctctgtgcattatctggaaacctgctttctccagaaaagctgactatccacttcccgtgctctcaagcccaagagacaggaatgggacgtggggagcgcgtaccctcttctcaacaagcaggttgaaaatccagtgaatttctttatgatggaatttgaatcacgtggacattcattagaatatttgggcaggattaagcccttaaaactggctctagattatggttataaaatggcctcaaaggaccctgaaactaatgaaagaattcttccatttctgacatgcttcactccctctggctctggctcttatcccaaatcaaagaatgttggtttttttagtgtttcctttataaacaaggatggtttccagattttttttttctttttgtttttttttttttttttgagatggagtcttgctctgtcacccaggctggagtgcagtggcgccatctcggctcactgcaagctctgccttctgggttcacaccattctcctgcctcagcctcccaagtagctgggactacaggcccccgccaccatgcccagctaattttttgtagttttagtagagacggggtttcaccatgtcagccaggatggtctagatctcctgacctcgtgatctgcccgcctcggcctcccaaagtgctcggattacaggcgtgagccaccgcgcccggcccaaagtgactcttatactccattataattatgaatttggaaaacaataaggatattatatgagtctgctcaggctgctgtaaccaaagaccacaggctgtgtggcttaaacaatagaaatttcttttctcacaattctggaggctggaagtccaagatcaaggtgccaggaaactcagtttctggggaggcctctcctcctggcttgcagatggccgccttcttgctgtgtcctcacacggcctttcctcggagcgtctgtgtatgggtggggtggaggggcaagcagagagcttgcacacttcgacaatatgaccatctatcataggcatcaatttagtttaacttcatttcatttacagggtgttaaaaaggaaaatcatctgcataatttgagctttttcatagtgagttctgaatctaatttattttgagttattacagaagtctgcggatatcccaccttaagatagccatatgcacaattagtcatttcttaagggatcccccaatgtgaaaagaattccccgagaaaagacgacctgaaagatcttggcctttacataagtgtacacagaattatttttattgtgataaaatatacataacataaaacttactatcttacacagtttaactgtacagtttagtggcattaagtacactcacgttactgtgcaggcatcatcaccatccttctctaggactttcccagctttccaagctgaaactctgtcctcattaaacatgagctttccattccttctctccccaccaaccacctggcacccactgttctactttctgtctctgtgaacttgatgactctggatacctcccgtaagtggaatcctacaggatttgtcccttttgtaactggcttatttcacttggtagaatgtcctcaagattcatctgtattgtagcatgtgacataatttccttcctttttaaagctgaataatattcccttgtgtgtatagaccacattttgtttatccattcatgcatcgatggacagttgggttgtttacaaggaattattttaaagccgaatccagggtggctggcttgtgactactatttagatgcagacagtgattccaggtggtgcgtggtgaaatcatgtcacacccccgcggaaaactccacagctttcctcatgtgccctttccatcacttctctgctgctttaggaactacttttcttctgaggtgacctctttctgttcctttcagtttttaaaggaaagaatagtagaagtattaaaagcagcagcagaagtccacatgttaaccctgtgccagcccacatccccttgtgatctctggcagtggggtctcttctgctagcttctcccgagcttcctgccaaaaccctgtagccggccttcgccatgtccctgaatttgcttttctttttccaccctctacaaccttcctttcctgcagaagtataaactttcaatccgtgtgtataaactttggggacacttcgcaatcagcatgatgaagttttatttttatgtgaaaactcttgatgattctgaaattgtggtgtctgtaacttaaacatcatctacaaaatcactgctctatctttggatgtgagtttgttctagcatgttatcacagtaccgaattccaaagaaactgctgtttacttaccaagggtaggctttcaactcagatgagtttatgactttatttacatggaatagtcaaaatggacttctgacatttgctgcaaagtaggacaacttaattgatattgatggatctactcatttattcagcagataacaaagcccttccgattgcaggtgttgtggagagagcaggatattcatttgctagggttgccataacaaagtttgatttgatttttggttggggatggaaactgtgtaggaggcaagcgtggagcttgatgtgagctccttgaaataatgaaaaaccagttacaaaatctgtattacctgtagcagtacacattctcccaaagcattctgttggcattttaaagtcctttaaaacacacagctgctttctgttgcttcaaactaaataaggcattatcttcacttttccttttgttaacctaaagaaaaaccttcatttgtaaagcaaatcatcacagcaggaggattttctggtttatgcactagggtgcatttaatctttattttacactgctgattaactttatgattcaaattttaacttatagtttctttttaaattaattacattattgggtgctttcatgtttttgctaaaagccttcctattagaagcactacaattgacagtgatggactgacctttaatatttttttgttatgtgaccagtgtttggtttataaaaatttttctctaaaacaccaacttttggctgcaaataccaccttttcacttgggttcttttcatagtgtttatttacatgggatattgtcactttgcacgctgtagctatttgtctttgtcagcaaatgtaggtaaaatattaatcttgtatgaaattcagataagcagggaacagatggatttatggtgcttgaaacctctgaactctgcagctgtggcaagttgttgaactgtaaataaattctggacggtggctagcaggggctggcgtgacctcatttgccccacaatacctcaccgtgccagggatgcatttcctgccctgtgccacctgtggtttggtcctagtgctttggggccgcagagtggagctgggctccctttgaggaagtcatcagtgctgagagccctcctcacgggtgagagtccagtgggatgtgtctgagcagcctacgctgggcatgggccggggcacgctgtgtcccaagcatgctttaggggtcccagtggcaaaagcacatttgtggttgtttaatctctggaggtggaggatagccccagctcctgggtcagtcagctggcggaacagggtaggccaggggagacagcactccaccctgctgggcatcttattaaatgcagcccagtatattcaatgccggcatcactacttcatgggaaaggatgcagcgcttacagcaggtagtggggtagagtggctgtgtggggattttcaaaatggaggctaaagtgatgcactttggactcgctggaaagtgcctggacctctggtgagttcagcctgggaggtcagagcaccacaaaatttgcttgctgtggctgggtgcagtggctcacatctgtagtcctagcaggagctcagtagtccaagctcaggagtccgagaccagcctgggcaacatcctgtctccaccaaaacaaaaccaaaaacaaaaccaaactggcttggtgtggtagtgtgtgcctgtagtcccagctactcaggaggctgaggcaggaggattgcttgagcctaagagttcgaggctacaagtgagccatgatcataccactgcacttgagcctgggtgacagagtgagaccctgtctcaaatgaaaaaaaaaaaaaaaaaaaaaaaaagtacttgttgcctggccacaggaaggtctgtgtgttggtttgtttaccttcccgaacctttgctggggagactttttatgcccccatatgccccagattcactaacaagaaggaagtgttctgttctgtgtaggatgtgcagaaacagccttgaaaatgttaccaatcaccgaccttctgaaacgagcttctgtggatactgggaaagcactgggacaccattcccctcactcctgcctctgcttccccagggtggaactggcctgtgcttgatggtgccagctgtcataaagaagtcattgagcatccctgcatttgcactgtgtacccagcaccatggagggatagccactttagccaaagcagtttttcagctttactgagatgtaatttacataccttcagactccctccgagggtgtttttttgtgtattcgcagagttgtgcaatcatcactatctgagtttagaacatgttcagtaccccatgcccactgtattagtctgttttcacgctgctataaggaactacctgagactgggtaatttataaagaaaagaggttgaattgactcccagttctgcatggctggggaggcctcaggaaacttgcagtcatggcagaaggcgaagaggaggcaagacacatcttaccacagcaaggcaggagagagagtgagaggggaagcgccatacttctaaaccattagatctcgtgagaactcactcgccatcacaagaacagcatgggggaaacccgcccccatgacccaatcacctccaccaggtccctcccctgacgtgtggggattacagttcgacatgagatttgggtggggattcagagccaaaccatatcacccatcagcagtcacttcccattcttccctccctgtcccaaccggtgcaaccagcaatttactttctgcccctatgcatttccctattctgacatttcaggtaaatactcacaacatagggacttttgtgttctcatttcactgagcattgtgttttcagggttcactcatgttgtcccctgtgtcggtgcttcgttccttttcatagccagattatactatctgttcatcagttggcgggcgtttgggctgcctccactgtttggcgattgtgaatagtgttgttgtgaacatttaagcacacgtttttgtgtggatgtatgcaaagtcattttttttgaaagccacttactacacgattggctaacttccatcagagaaatgttgtttggtggagttaaaaacagattatctgtgtactatattaagttgggtgaggaatgatgaagtgtaaattatacttacataaatattataatgctgtgcagaaactcttaagctatcattcttttagaaaatgaattttatgagcttgggacctttttgttaaccaatctgagaaaagtctgttgtcagtgtggacatattttacctttaaatggaggaggggagagaatctttcaaaaacattaatatcagtgagattaatactaatctgtcaagatgacccagtgaacagttggctatcaaagtattataagaaggtttttaaaaggaaagtgtctattttgtaaagatcttgagtaaattatgcttttaagtatgttttgatattcccccccctcctcccaaagtgtagcatgcctgagcgctgtcatgtttaggaggtgatgggttggggttagagggtgattgactgttagcgaagtgggttgggatgaacaagtgcacttgagtacgcgctgcacagtgtaggcatcaggccacgtcagtgtgtctctgcatttgggcagatgccaggcctattgcaggcagcataacatctaggaacgggtttatggatgaacctgggtaactctgggagcacaaacccagaccacacccatcgggagagattgacctgagtgatgcgctaacgcatatcattgagatggggccagatatcttgcttagatgaataattggagttcatgtcaaccatctgtcctttcccataatttaaagccaacttctatattttccaggttcatactttttttttcattaattgcatgtaaagttgcggtgaacaccttctttcttgacttcctgtttaaaaaaattacagttcttaaaattataagcttattcaggatggagtggtcagtttgtagaaaaactagctctttagatcttttaaaagcactacattaaaaaaaaaaaaaaaaaaaaacatcggacgtggtgggtcacacctgtaatcccagcactttgggagtccaaggtgggaggatcgcttgagcccaggagtttgagaccagcctgggcaacatggtgaggccccatttctacataaaattttaaaaattagccgggagtggtggagtgcacctgtagtcttagctacttgggaggctgaggtgggagggttgcttgagcctgggagttcaaggttgcagtaagccgtaattgcaccattgcactccatcctggatgacagagcgagactctgcctcaaaaaacaaacaaacaaaaacaaacccagagaaactcaaaaaccaaaaaagaggtatccttattttcccaggcctcaatgatgaaatgtgcccagtgttcatttgaatctgcccatcaattagtcttttcctgatgtctcagagaagcatgcatgatgtacggaatgtcttgggtgacctagagcggcatccccaataggactgccctgtgaacatggccccacattcggctcttgggcacttaaaagatgtggccattgtgactgagaaactgaattgtgaatgttatttaattttcacgtgtttaagatgtggccagagcagacagatgaacagtctggcttgatggataactgcagggagtttcacgatgctggtaggaggcacagtgagcttctggaagagccggccccacctaggcctgattttggtggctgctcaaaaccgctggtactgaattcctttagaatagtgcttctcaaagcgggtgactttgtatcctccccaccctccaggggccatctcacaatgtctggagacatttttggtggtgacagtgggtgcttctggcatctggtgagtagaggccagggacactgctcaacatcccacagtgcacaggacggcctcataacaaggaatcatctagccccatatgcgccacgatggaggagccctgctttctattccgaagaccagcagtcctaagatacgatgtggacagcacagacccagttttctaagtgaagagataaggcttgagcaggcagcagcctggtaatgccaaggccaggacagttagccaagtgtctgagtccatggagcttctcgggcagtgttctcttttctcttcagctattccagtttgtattaagtgtaagaatatgaagttgatgtttgtcgtgagtcaagacggtgacacagaagcagtctttcgtgctttggtctaatagctttattgttaaaggagagaaacagaaaactcctctttgcctctgcagttttctctgaaattgaatttagggaaagctgaccctagaccatgcgtgccctttccaccagcatcgctgtgggttccactcgtgggagatcgataaggaagtggggatgaccacgctgcacagaagtgttctcatcacttttgcgcttgcttatttaacccatgattgttagaaagcgtttagaaagttggtctttgcaaaccagccctgttaagtgctgagatgaaattcttaactttttttttccttcttagagataaggcctcactctgtctcccacgctggagtgcagtggcgcaatcaaagctgactgcagcctccacctcctggactcaagcagtccccccacctcagcctcccaaattcttaaaaatgctaacagtaaccctcacacacaaaaagtgctgccgttagagatggcactggtattgagaagcacgtgctgtcagtgttgcaattggtaatgcacaccacacttgggcatagaaattggaaatccaactgcgccaagctggagcctgcagaaaggagcacgaggagacgggacagcaatagagctctgtcgacggcgctaagtagaaccagacgctgcaataagacaagcgtccccctgtgctcagtacaaatgggttgcctgtggcagatgcaggggtggctttggcagagagacggctcctggcatcgtggaattgaattggctgtttcttttaaagatactgcaaattgcggcagcatttatcatcctaaggaagcccgcacagcttgccaaacagataatattgatgatgataacaacaatgataaaaggaaaccatgatgcctctactcaatgaaaatcacttttatcttatttgcaaaagtcagaggtaggacagatgtgtcagcgtcttaataagacagttattcaaggagttaaattgaaattattcacatacccaaaataagctatttggcaaacctggagacccaggggcctttggatctatcttagtgtaaaatttcttgaagcagagacctagtaggtactctgttgcttatggttccaggcaatgtattgttttttcttccccctaaatatctgtgaatgtgtgaagtaccctgtgtgccagagatggaaagtaaaaccacagaagcggggtgcggggagatggcagctaaattccttttcagcagagttgaagcatcttgttgtaagagtctagctccacaacagtgggatgcaggaaactgtaacagctgaaatacccaacagatgtattcaccatcagtgcattgggaaaccctctcaaaagtgtcatcacaaatgatgatcttaacttttgtatgacaggatctttaggtcacccaacagtaggtgcacagtttctatgatttcaatttttaccacttctggagacttgtcttcccatttcttgtatcagtgccttactgatagagttggaaattggaaccaaagtaattagattggctctccagatctcttacatgagccaagaaaggattcaaaagcatgccctgtttccttcttgacaggctgggagaggaagtgaccgggaagtgaattgctaagatgtggtcgtcattttcctttacaccacagagcctctgcgtttgggaactgcaggttcatccgagtcaatgtcagaagtgccttgtgtctactgtagtgaacatcctttgtttccatcgggtcctgtgggaagcagcactgcttattgggtggtttgagggtgaatgctattttacaacttgtgacccccttgacacactaccttttcattttagcatggagcacagagccatttctcccctgtgctggattttgaatgttctttcaaccaccgtgatagaatgtccaagaaaggaacaaaggaagaggcaactaagggaatctttcagtgggttcataagccatgctgctcctggctttgacaggagttaaaatcatgggtatccctaaaccactatcattattggagttgctgttactgtcgacgtaaagagtcaaactctgtaaaatatttgaagagatttattctgagccaactctgagtggccatggcctgtgacacagccctcaggagatcctgagtacatgtgcccaaggtggtgggggcacaacttggttttatacattttagggagaacacagcttggttttatatgtgaacccccaaaatctgagacgggtctcaatcaatttaggaagtttattttgccaaagttaaggatgcgcacccatgacacaacctcaggaggtcctgacgatgtgcccaaggtggtccaagcacagcttggttttatacattttagggagacatgaaacatcaatcagtatatgtaggatgaacattggtttggtctggaaaggcgggacaactcaaagtggggagggggctcccaggtcataggtagacaagggacaaatagttgtattcttacgagtttctgattagcgtctccaaaggaggccatcagatatgcatctatatcagtgagcagaggcctgtcgttgaatagaaggggaggcaggtttgctctgagcagttcccagctggattttccctttaacttagtgatttgggagccccaagatttattttcctttcacatacacatttgagggagacatgaggcattgatcagacacatttaaggtagacattggttcagtccagaaaggtgggacaacttgaagcaagggtgcagggggaagggggggtgctttcaggttataggtagatttaaaatttttttgataggccattggttgaaagagtcattaccaatagaaaggaatgtctgggctaccttaagaggttgtggtgaccagtgttttatcctgcagatgtagcctccaggtagcaggcttcagagggaacagattgtaaatgtttcttatcagacttgaggtctgtgatgatgttcgtgctggaggggcttaatgaggcatgcttgacccccacttcccggcagtcatggcctggtccgtctttcaggataaatttagttggccttggcccagaggaggaagtccattcaggtgcttggggggctttcgaatgttattgttggtttacattatgattgtcattgttattaaaaaactaagggctgtagagaaatggttgcagcatccatcatgtgtccctaggaattgcacatagctaagtgagaacctcacagaaccctttcacgtgcagcccgatgctgtcactgttcataaacaattgtattttgccttcctgaaaggccatctgagttcattaaacttgcatgcttccatatctatacattcttttctcatggcctctttgtggatggtttgttttaccatttgttgtccatcagcttgaatggtagggggaagagttcacaccgtgccccctgtgtagcagaatagcccacagttcaggcatggctctccagcaaggagctttctagggctctgatgctcaccagtggggggattgggcacccctccgcaactgccaggggacattgacaatgtctggagacattttgggttgtctcagtagctgtgtgggggatgctgttggctagtgggtggagccctgggatgctgctaacatcccaccatgcacagtacagccccaacagccaagagtgatggctcacaaatgccaacataagaaacccattctagggtacctttcatttgcttagtgctgcgagaaggtttatctgccaaagatcatcatcttggagagggccaagatcctgtatcctgtactggacagatatgcaggcattcaaattctgaaacgccgttggaaacatgaggctcggatcacagaagcctcctgtacatagagcaaatgagagctggaggcctgctgcccagcccagctgagtcctgtttcttatttcggttttcctttagattccaccgaagtttctctgaagaatgctgactcaggctgccccttttattccatttctttgcagggcagtttaggtgaagctggaacacagtgttccctgaggaagcattaggacaattagaccctgcctttgctaaatgaatgtatcaagaaccttcaacgtctttacaagaagcaggataaccattttgcagagtactgtgcttagtagcagagcatggcttctgttacacagtttcagtattgcaaaggtccccagccagtacagtcccacccttaattactgcttcagagctgcaagttaacgtttaaagtgttttcacagtagcttgaagtgtgatctcccatattacggtcatatccttggacttagcccatgttacataaattagatctttataagcagcacacttctttgcaagcaatttgcttccctttgggaatctgattccatagaaaacagtagtattttaaacatgttgattctagtacttacagttctattcacgtgctcctggtatagtacatctaataagaaagaatcccttatttttacttttatccaaatgcatgtatgttctttcagcatgagatataatttgtctgatcaagtatatagggagatgagattaagaattaagatttgtttcaagatatgagattaagaattaagatttatttcaagaaactcaattgcatggttgctcgcataagccactatgcagtggcagctttaatgaatggggttccaatgttttccttactgttttcaagaaggtagtgaataaaattagatgttaaagcgaattgcattgtgtgaagattgggacagatgccacatatatagttcagatgcttgcctgccagtccctgagatatactcttagcttgttaatatggaaattgtcaaacatattcagaagtatacagaatatcttggtatattcctgtgtattcttcactcatctccagccactgttagcgtgtcacgagcttgtctcatcgtcccctcactgttttctctttagagtaatttaaagcagatctcagacatcatgtgatttttacctataaacatttcaagttgtatccctaatatagaaggatttttttatgatactattattctgtaattgtttcctgtttgccttaacgaaaagaccacagactaggtggcttaaaatagcagagatgtattgtgtcattgttgaggaggtcagcagggtggtcaggcggcagcagggtggcttccttttggaggctccaagggagagccccttctgtgtctgtcctccaggttctggtgcctgcaggtgccccttggcctgtggctgcataacgccaatctctgtctgttaggaggacactgtgtttagagcccatgcaataacccagaatacctcatctcaggattcttaatttaattacatctgcagtgacccttttttcccaaatgaggtcacattcagtcttttactatataaggtcatattcacagagtccagggatcaggttgtgtacttaatcctgtttctttcgtgctcatgggaatgtatgagttaggggaatacagattatctttgtgttgtagggttttcttaagattatgatttattgaaaaagaaggtcaatggcatataaaggaaaatgtcattgataaatataaaaagaaatgcaagttttttaggccaagcagaatgcttataggagccagtgtcttggattaaaattatatgtgaacctcaagtgttatcatctataaagtgaaggtagccgtgaattacctcttagattgttgtgaagataaaaatgaatacagcattaacacagtatataaatgctaagcatttagtaattatagttcgcctctttttttctggaggctcaaagttgattgtaaatgtcaaaccaagaaataatactaggtactagcaacacataatgcaaaggaatgattcctgtgatacatgaagaactcctataaagtactaaggaggatgaccagcagcaggccatgagaaaaatgaaaaaagacatgaacagttttcttaaagggaaataatgaatagctctaaaatgtatggaatgaagctcaatctccctcatgacatggggaatgcagatgaaaagtgtaaggtaccatttcacctttcccattagtagaggtcagaggtgtgactgtgttccgctggcaggagctcaaataaaagcgggtgttgttgctggcaggcattgcaagaggtccagcctctttggggagcagattggcaaaagatatctgacctagaattgtcacttcttgggatttagctcatggacatagtgtaaatatatgcaaagaagtactcacatgatattcaccaaaggcattgtaaaagcagaaggatgaaagcaaccacccacagtgaacgtgttagattataataaaggcatagaatctatcaaacaataggaaaaaaagcataattctgtatatggaatgaactccacatgacgctcttgcatgtaaaaagcaagacagatacctgattgtgagtagagtttaatacaagttctatgtcaaagtgggaggagctatatgggctggtctaggtagaatatttctggaaggaaataccaaaaattggacttccctgttggggagaggtggattttagagatggggtagtagcagcttctcaaaaaccaagagaaagcttcgcatttacaatgggattattggaagcaataggaaacacccatttttgtaaaatctgtgagaatgtgtatacttggtaaaagtatagatattcagccattaaaaggaatgaagtattcatatatgctacattgtgagaattgaggatatgctacattgaaagaaaccagccacaaaagactgtataaggttccatttgtggaaaatactcagaaaaccttgggggaggaggggacaggaagtgtctgtttagtgggtattagatctcctttggaggagaggaaaatgttttggaattagatacagaggtggcggtgattgtataacattgtgaatgcccccaaatgccactaaattgtacacttgaaaatggttaattttatgtcgtgaatgttacttcaatttttaaaaaaatccaactgcaaggagagaagattctctagggaatggcttgtcaaagcatccatgtcaaagggaccatttaaaaatttccagtctgaggtgggtgcctttgtgaaaagcaattaaaatgtataactagaagagcaatcatgtctcagacaccaacgcaagcacaacttgccctaagttttctaagcacttcttacctcattcattcatcaccagagacagacagttcccaggccagaatccgcacctggatgcaacttttaatacatggatctagagttgtgttcttccagctctagaagagctccatgccacccccctcccctcccccccccgccacagcttgtcagaaatgcagatcacaggccgtctctaggtctgctgaatgagaatttgcattttagtaagctgcctaggcagctcagaagcacattaaagtttgagagggtaatttggggacagtaaagtgcagtcggaggaggatggttttgtggccctttggactggtcacttaatgactgtgaccctgggcaagggactgggttcgttccctaggctcctgtaacagagtgccacagactggtggcttaccgtatagaaacaaatgctctgcagctccagaggccacaggtctgaaactgtggtgttgtggggttggcacctgttccaggcctctcttcttggcttgtagaaggctgtcttcatgttcacatgaccttctgcctatgtgcagttctgtatccaaattccccaccttaatgacatcatcttcactaattacatgtacggcgaccttatgtccaagtcaggtcacattctgaggtactgggcgctaggactttaacatgtgaattttaggggaacacagttgaacccgtagcagtacttaacctttctaatcctcaatttcgtcatcttaaaaatgagtaaactacacattaatgtgggtaccatcaaaaaaacaaaaaaaccaacccaaaaaatagtaagtgttggcagggatgtggagaaattggaactcttatgcactattggaaggatcataaacaggtaaacactatagactatagttcagcagtttcttaaaactagaattatcagatgatccagcaaatccacttttgggtatacatccaaaagaattgaaatcagaatctcaaagagacacttacacactcaggtttagagcagcgttatttatattaaccaagaggtggaaacagcccacatgtccctcagcagatgactggataaacaaaatgtggcctgtccacacaatggaatagtattcggccttgaaaaggaaggaaatcctatcacatgccgcaattttgtatgaaacttgtggacattatgttaagtgaaataagccagtcacagaagagaaatactgtataatcccactttcatgaggtatctaaagtacacaaattcgtagagacagaaagtagaatggcagttgccaggggctgggggaggtgaaatggggaattgttgaatgggcatagagttggagttttgcaagataaagagagttctggagattggttgcacagcattgtgaatttaacactgttgaactgtgtacttaaaaatggttaagaggctggatgttttgggtcacacctgtagttccagggctatgggaggctcaggtgggaggatggcttgaggccaggaattcaagaccagcctgggcaacatagtgagaccccatcttttacaaaaaattaaaattagccaggcatggtactgcatgcctttagtcccagctacttgagaggctaaggcaggaggatcgtttgagcccaggaggtcaaggctgcagtgagctatgatcacacagttgcactccagcctgggtgacagagcaagattctatctcaaaaaaataaataaataaaagatggagaggagcgttacttttttgtgtgcaggaacgattgctgactgcagagcctggctggctaaaattagatttgccttgtcagtataataattgtaggtatttttggagggaaggatgcctggagcccggctgggttatttccgcccttggagtgagccagggcagcttagagggctacccgcgtgcagccctggaaggtaccgaaggagccctggaggcaccgagcgctggaggcctcatccctgagcaggttgccctccttctggtcggatggcagggcggaaacccatctgtgtcgggagtgagagctgtctgctgtccgcggcttgcgcttggagcttttcctgcagtccagggagagcagaggaggccagtgacttccatgaaaacacccccagtggtggggagggaggcggcatcccttggaggtagggatggggcccctgctgtgacccattagaggcaaagaagggcttggaagtttcattttgtcttacatgagtgtgtgtgccgagttcacattatttgcacatctgtgtttgtttttatataatgataaggacatcagtttccattgataaactataaggaagatgtgccatgtttaccagggccagagtgaagagactgaggtgcttgctttgggagaaaaatttgagggggtgacaaacaccacagacatcaagataaattatctgtgtgtattttaatagctttattgagatgctgtgcacagccatacaattcacgcatttgcagtgcacagttcagaggtttttactatatccacagaggcgtgcacccgtcaccacagcccagtttagaacattttcatcacctggggaagaaacacccacccagtggcagtcacttcccaccccacccccacccctgccaccgtgcattctgctttctgtagatgaatgcgtttgtctactctaggaacctcatacaagcagagtcatacagtgtctgtccttctgtgtctgacttctttcactctgcgtgtgttcctggttcattcatgtggtagcacgtgccagacattcctttctgttacacagtactgtatgtattatatatgtacacagccggctgttcatatccacgagttctgcttctatgaattcaaccaaccgtggattgaaagtatttgggaaaaataataatgcaacaataaaaaaatacaagtttaaaaacaaatagagcataacagatatttacatgacattgacattgtattgggtatgatacataatccagaggtgatttaaagtgtaagggaggatgagcggttatatgcagatgctactcccttttatctaagggactggaggatactcggattttggtatctgcaggggtcctggacccatcccctgtggatgctcaggggcggctgcaccacatttgatctatgtgttcatctgtcagtagatgtttgggttgtttccattcattttttggctaagtgaataatattttaatgtgatatttaaaaaattaaaatgaatgcaagaaattccatgaggaacaaaatattaattttaagtaaagaccacaggatcagtatttctgaagtttccttttgcctcaggatccagtatggctccatacattactgatcctgtctctctctctaacattttgatattttgtcatgtactttttgcattcattttgattttttttttttctttttgagacagagtctctgttgcccaggctggagtgcagtgatgcgatctcggctcactgcaaccaccgctttccaggttcaagcattctcctgcctcagtctcctgagtagctgggattacaggcacacaccaccacgcccggctaatttttgtatttttagtagagactgggttttaccatgttggccaggctggtcccaaactcctgacttcaggtgatccacctgcctcgacctcccaaagtgctgggattacaggtgtgagccactgcgcccgtcctcattttgatttttaaagataatgtattacactattgtttcttttgatggttgaattttctggcatccccttcaattttgcaccagaggtaagtgatcctaatccctgccctgacattttacactgtgctgtgaataccccagggcatcatgaggaataaaatttgaaagtgtatttcagtgagctaacttggctggacagaatacccatgggttatccttaccagtggtgccatatttatgcctttcagcagtgttgtgattaaactcaggtccagtaaaattatcattatactatattagttttgtagaacttctgtaacaaatttccacaaactgaatggcttggcttaaaacaccagaagtatatcctctcacggttctggagtccagaagtccaaagtcaagatgggggcagggttgtttgcgtctggagcctctacaggaggatccttcctgcctcctccagctcttggtggcgccaggctccagttcccttgtagatgctacaagggaactcttgtttatagtcgggatagaaattacacaaaacccggtcttgattggggataccttttggagtactggcaagttgccgcatggactgagccttccgatcggagtttgctgtcttgctggtgatctgcctggatgccggtgcacacactaatccctgaacacactaagcattgcgcttgctgttgtttaacttttcatccatgattgaattcaggagttctttttttaaaatggccatttttaaagatttctaattgggagtttttcttctgaaaagaatacccgtaaagcaaactatttaaattatacactgagagacgtatgttcattcttgtatccataacagttaagaatcattacctattactagcataggcacaaagcgtctcctctaagacatttgttaattacaaaagggacaaaagtagtgacatgtggggaagaaacccagcagataccacctaggtggtcaaggtcatcatcatcatcacgatgagggcatgttgacaccctgtgataatctgagaaggactcagcatcactcctgtggtgttcctgccaaaaatgcgtaagagtctaatcacgagaaaaattagacaaacccaaactgagaggcattctgcaaaacacctctcctgctcctccaaagcattaagagtgacaagggaagaacggggaaccatcacaggtcaaaggggatgtgctgactataggaatgtgggctcctgggagagagaaagggcggaaggagaaaccggtgaaattgggtaagtctgtagttcacttacttgtgctgtgccgggtcttaactttcttatattttgctaattgctatgtttgtgtaagatgtcaacataagtggaagctgggtggcagttatatgcaactctgtgctatttctgcagcttattgtaagtctaaaaattatttcaagattaaaagtttttttttttaaaaaagtcagatgaaaacacgaataagtaaaaaaaacataaaaagagagaaaaaaggagccatttatatgattaactttttggttggtgtcgccataagttttttcagttcggattcttagtaaaggatgtggatcaaaacaaatcttcatactaaaacatcagcagagaccttatttcatttgaacaaaatatcatgaagtcaggattcgttttgcatttgaatcttgaacatttaagttttttaggaaatttgtggtgctcctgtccttgaaaggaagcccacatatgttcaaaatgcagtatcttttaaatgcatttgaattttttaaagttttggtgtttgttgtttttggttgtttattgctttgatttttcatgagcagtgctgttcaggggtactattattgtcagttttaaatcactgctgcagcatacttcatttgatcttgagacttgccatgagtcttactgtgggggtggggaggatggggaaagaaaccattgagtatgagttggcatgtcccacagaacagcgggcggacacttcagggggctgtgcctttctcagagactcgagggctatgcccaaatcgttatgcagtgtgtatgtgtgggggggatagttggggggacgggtatggggaaaggagtaatctaccagggacgacccaggacagatcccagagccaggaatgagggttggatcttgggcaaggccatctctgccatgactgcttgtgggaactcctgcttactccccgtgaccctgagcaaaacttccaagtttgaagcctcaattttatgctctgtcaaagaaactagtttttcaccctccaccagaggatgaagtatcattctccacgtgaagcactcagcacagtgcctgtcccctctgcagacatgatgccaatctgtgatgatgttctcttctgtcagcattttacaaagcagatgagagcgttcacttgcacagcctcctgttgacctttcttctctcagacgccttgctgtagatcccaatcgactgcttttccttggccagccgattcatgcagtctcttgcttacttaatactgttgatatatttaaattattgtttaataaatacttgttattctggagtatatttgttcatccaaggatggtttactactgcttgctttgtgcaggttataacaggtaagggggtggaggtgtgtgcagagcatcagctggtcatcagccatcttgcgggagtgcccagaggggggaagagcaaagcctaccccttctacggagtgtgagggaggcaggcttgggtggaggcaggactgcaccagccttccagagctcagagaggtgacacctgagccaagtgacacacacatgataaagaggaggtttctggagtccagaggaggaaggcatccttggctaagaggacagcatgaactcatagggtacctccaggaatttttcccctgggcagtaggggcagagaaaggtacccaggggggcaggggataaggactggcatggagcatgggctcgatatcagcctgctgattttaatgaaagccgtttggtcacctgaagaacagctttgattttacttctgtaatctaaactcttttgagttggaatataaaactcagtgttccatgtgacaaaggggtttttaaattggtcattcccttaaacatctttacattttcgtatctgttgatgtcatttttttccccattgctgactcctgttcctgtcttctatttctgctcttgacttaataattcttggcttcttgacgtttatcattgccgactgctctgaatcctcatcttcccttcatttatttccatttgtccgctctgtttactgcctgagatgttgaccttttttccaagcatgcactaagcggcattttaaagaagcagcatcatgtcatagctcctggtagtggggctgggcctattcatcttggggcttctttatctaccttggttgtaggtagttaagaaaatcttaacccttgggtcattatttctatagtgggtcaaagagatgaccacgttactaaaactttcatgtctagttgcatattctgttttttttattgtggtaagatatacattacgtaatacatttgtaagtgtacaattcagtggtatgaaaacattcacaatgttgtgtagccatcaccctcttacacctaaacatttttccattatccttctccaaaactctctgctcattatacaataactggcccttccacactcccctccccacactcagtccctggtgacttctcttttttctctttatttgcctattctaggtaccccatagaagaggaatcatataacatttatccttctgcgtctggcttatttccctaagcataatgttttcaaagtccatccgtgttatagcatatatcaaaatgtcatcgtatttttgtggccgaatactaatccgttgtagggtcactcacacgcacacacgtagagtagctgtgagtacagtgcccagattggtacagaaaggccacagtgcccatgggtctgtccattttacatgctgtaccgtgtgcttcatgggaaatatatttcttctgtgagttttcttgtacattgcttgtttccagacttctaaaggggtggttgtggggatgtggtgctgtgtctcaggtatactctgcttatgaaatagcgggtgtgatggaagggtggagaaagggagttgagtaataatgttcacctggggtcgggcgcggtggctcaggcctgtaatcccagcactttgggaggccgaggcaggcggatcacctgaggtcaggagttcaagaccagcctggccaatgtgttgaaactccgtctctactaaaaatacaaaaattagccaggtgtgacggtgggcgcctataatcccagccactcaggaggctgaggcaggagaatcgcttgaacccgggaggcagaggttgcagtgagctgatatcgcaccactgcactccagcctgtgcaacaagagcgagactccatcttaaaaataataataataataataataaggttcacctgattgaaatagcctctgtattgaagaacaccagcaggtgaagttcgcttagcagatctgagcttcctgttaccctaaacactgccaaccttgacctacctctgaaagccagtgggatgaggtctagggccaggtgggaaccttgggaaaggcatgccctactgtttgaccaaggggatgaggaggctgggtactccagtgatggagaccctttccccaccttttctctcacctctcctccacccagtgccctttcacctttcctttccaaccccacacccatccttccgccccacttccccatttatttctctctgctctttcatttccgtggccagccgcctcccaagccctgccctcaagcttcccctcccttttctttcatgcccatagcctacctggatctcctctccctcgtcgggcccacctccctccacccttgggatcctggtcaccccctccactgcaagggggagaagggctgcactgtgtggagggttctccctaccttggctgtgttctggggatttcccaccagcccttgcgctgcactggtgatgcccgatgtagctgaaactctgccccgctcggggttactggcctgggatcagcataggagatgggtttaaaacaggatgcagggaggctgctggcagacagttatttgaggaaatgcatttcttaggatatagctttcaagaaggtgctgttattgtgcgtcacacatagagtggctgtaatgcgccagggcaaatgaaaattatgtttataaaatagggcaccttgtcaagattaacttgtgtgaaattcccaagaatatacctcaaacagttttttatgtcagtgcatgatattgtagtaactctcccagttctagatatctttattttaaaaggaatgcttgtgtgcagacacatttttaggtggaggttagtatgttttagttctcaggatttctaggagaataaatagccataacttgataggattggtatgaatagtacttggtcttgggaagttttctccatgaaaatgtttcatgttgacgttttgctccctcccgtcttggttttacactcattcttcacagaactgtcatttataggaacttatcccctggccatctctataggtgtctttcttgcccagataaggtgagaatcattttggaaaccaacttcttgagaatccacaagaaatgggttttagccacaagggatcattgcattgcattctataagatgagagcttctacaagaaaaaattctggagccagatattttagggaagacagggggctgataagtgaattgttattttaaatggttttcatttcccctcatcctgatttagaagaggagagaaaactctccttagaatcagtgggtagtcctgacttgaatgggtttattttctttttctctcttgaattgtcggtgtatacccgtgtctttcttggtttatccttcatccccattcctccggatacccctatttgcatttaatctgtttggtcacataacctctcaagtagcgatcttggaggtttcaaaacttaacatttcattttccccgctgggtcaactaccagtctggaagcaccagggtttccaaggttaggttacagtgaaggcacaggggacatcttcctgtctcctctgcagagccagcgccactgtgcagtggggtgtggaccccggctcctccccaggctcccaggcctgcagctggcacaggggtccccagaacctgtgagggggtccttccctctgcctccctgagggacttggtgattcttagccctctctaacagagggagaagacgctgtcaaaaatgtggtttgcccaaacccacatagagctgggaaaggggccagggactcaaatagcagagatttcctggccatccatcagtcaggttacatcagtatactccatgtggattccactgggtgccggcctggtggctgaccctgcctttagagggaactcattattgtgtatttgaagtgtaaatacctcttttcccagatgttaatcttgtttcagatattcgatggagagggttcacataataaataattccctcctgagtcggcttgcgtggctcctgagagcagctggtcagggcccttcttgtcggtgtctcactggcttttagcaaaatggagacgaagatgaaagggaaaccttaactatagcttgaatccttagggtggactaagcactcaaagccttccatgcaaagcagtgtggcttataaattggaggcatttttcttattattaggacaaaccagcacccgaattggtttgtcaccagtaaaagaatttaaaacagtgcccgatttgcacagctgagattttggcaacagtatcttacacatctgaatgggtggagtaagatggagcatcattctgtgatatgtttaaaataatataccatgaaatgatgcagtaagtgttggagatatcttccagaagtcttaggtcatttgttttcatgtttaaattgtttccgcaaaggcattctcttcaacataaggagagctaaaaatcaaatacacagaaattttgtaagtgtgttgtttttttcttttcctgtttagactttataacattacactatttacctgggctaaacaaaataaattattttgtacataaaaccacaaggagatggtttagcctacttatgggaccaaactgttgtattagccagtgtgggagaatattgcagagatgtgtggcttcatcaatgaagattagatgtaaagtctttttaaaatatatgagaatgttgaactaaagatggttcagatgggactttgctcgagttgcttgagtctagaaggcaaaataaatgtttgtaattgttacataggccagccttccaaaatcccagctatccatagaaaacaaggggtcagcaaaattggccatctgcctagactggtaggttgtatgggtctgaactagaggcagtctttccccaggggacatttggcaatatctagagacatttttggtgtcaccttgggggaggggtagtactggcatctggtgggtggagaccagggatgccgctcaacatcctacaatgcagcggtcaccgatagcccaccctgccccaccacagccaagaatgatgcacccagtagaagcaccatccctcttccactggtgacatccgaacatgtctacagacactgcctaatgcctcttggggggcataatcacccctagttgaaaaccactgccctaaactgagactctgaaatcaaccacttaatctcctttcctctgagctcaggggagggacgtgactcctgcgagctgccttggctttttgtaggggcacagatagaagccatcccccaacacggtgccctgggttctgtggtggtctctgagaacccatgaataaggatcccagggaagcctttctaggtcgtgctgctttaatattattctagatgccgatttaaagtcataaaggaagaagagctaggactgtgctggaggaccctaaagcccatggcccatggtttcctataatgctaaccatgcccggagtatctagttataaataattgtgctgaggtcatgaatatttgactttggttctcaaatattcctaagaaaaaagtcatgaaagcccctgatggtaaaaggaggagagctgagacctaagtggataggagactcaggaaaaagcaagttagaaataaagttcaacaaccacaggagaggagaaaatgggtccaaaagacttgggctttaggcacatcttacctaaggacaaaaaagtagagaaaagatcaaatgttgagaaaagattgagccatgcggagaacgggcagggtgttgaagtacctgctgctctccttaaacccagcatgctgttcactgctttattttagagagtgggtgtagtggtctgtttcagaagactcaagtctacactgcctctgccactgaggttccttttgactctgcagaagtctttacctttcatctcctttctgaaatgctgtgagcatttttcctcccagagacattaattgggaacagcagtgaatgcctagttccttgcagtcctttggcccacacgcatttccagctgcccactggccagactggattctaaatgccaaaagctacaggcgctgacagagtgcttttgaaaagaaagaaatgcatgaaatgccccgaatttatgggaaatatttatacccagcagtccttgagccatgcgtgtcctttaggaacggtgctaccagacagccgtcggcatggccttgctcctggtggtgcaggctctgatgttccactgatgtgagcccaagagaggaatgaccagtcagcctgtaaccccagctccagtgttgttaatgagtgtcaccgatcaggtttcagacgttagtcagtgtcccggctccagtgttgttaatgatggccacggattgggcttcatgcgttagtcagtgtctctgttaggagctgaattgtgtccctgcaaaagggatgtatttaagttccaaccccttgcatctcagaatgtgagcttatttggaggtgggatcttaaccgagtgtgactggcttccttagaaaaagaggaaatttggacacactcgtacagggaaaaggccatgtgaacagccacctccaagccaaggagacaggctcagaacagattctccctcacagccctcagaagaaaccaaccctactgacgccttgatgtctctgaattctgcactccagaaccgtgagagagtcagtttctgtgaagccaatcagcttgtggtactttgttatgttgggcctatgaaattcatctactgttactagcctttcccaaatatttcagtccatgaaatgcacccagcatggcaactcttcaacttacagaaatggaaaagagaaagaatactgtgcttcagctagttttctcattacccagaaatgaaaaggcctgacctctgaaaccttgaggaatctctttttaagatgccagagcctgtacttctgcctgatccaagcagagtttgctcgctaccccgggcatcacttctcactgcccaggtggcactggatgatgtccaagactggccagatctggatggattccataaatagctcgtgctgtttctggtcagtgaagaaagaggaaggcaaagccacgtgcataagtttgttgtggatgccataacaaagcgctgctggagtggctaaaacgacagacgtttattgtatcccagttctggaggccagaagtccaaaatcaagatgtcagcagggctcttcctcctgagggcttgaggcaggatctgtcctgtgcccatcttccagcttctggtggctgctggcagtctttggtgtcccttggcttgtagctacatcacccagatctctgccttcatttgcacatggccttttccctgtgtccaaatttccatccccctaccttttttttttgttttgttttgttttgttttgttttgttttttgtttttttttttagacggagtctccctctgtcgcccaggctggagtgcagtggcgcgatcccggctcactgcaacccccgcctcctgggttcaagcgattcttctgcctcagcctcccgagtagctgggattacaagcatgagccgccacacccggctaatttttgtatttttagtagagacggggtttcaccgtgttggccaggctggtctcgaactcctgacctcaggtgatccgcccacctcagactcccaaagtgttaggattacaagcatgagccactgcaactggccaaatttcccctttttataaggactccagtcacattggcttagagctctctcctaatgagtttacatctgcaaagaccctatttcccaataagaagttactcccaggtactaggtgttagggcttcaacatacgccttgggatgggcagtcttgaatccataacaccgtcaattaaaaggttctgctttcattgccgccaggttgggaaaagttgccagggtgggcttggtggaggagggtctctcagcagggcagggtcattgcagggaaaaggagagagaaacagagacacacaaaagcagatagattgccttggcagaggtggccagactagagtctttgagttttgtagagagatcaattgattacttctagaaatgtcctcttcaaagtctctagttttctctcccatttccttatacaaggctctggccatattactacttctggcacagttgattcagtgacttttgcatataggtttccccaaagctaaagctaaaaacgaacaaacaaaaaaagattattcatgaatatgccacaaactttgcccatagataagactttgtgattacaagcaaaatctgattggaaaataaaatacattatatgttagaataccaggaaacttctttttggggagcgtctttatgaaatgaagccatgctaacctccctgggactgctgatcagaatgtgctccaccccaaagcctcggagagggcaggacagccagtgactctctcctgtcagtagacacactaaacctgaatccaggatgggaaatcaatgtttgacacagctgtatctctttcagttggatcagtaacactcgctcactcactaggacttccatttgcttttagctgcctgcaatgaaaacctggcaagacgtcttagtctgatccggctgctgtaacaaaataccgtagactgagtggcttataaaaaatagaaatgtattgctcatagctctggagactgggaagtccaggatcaaggcactggcagttttggtgtctggtgagggctgctttctcacagacagcatctttttgctgtgttctcacatggtggaaggggtgagagcgctctctggggtccctttgataaggcactaatcccattcatgaggccccaccctcatgaccgcattacctcccagaggctttacctcccaacaccatcatattgtaggttaggtttcaacataggaatttggtgggcgggggggggggtacacaaatgtccggaccatagaataggacattacagcttgaaaaagcactagagagaatgacgttgttcctttgtaacacagaaaagcattcacctctcaatttagatgagccattttgaccccagttggttctgaaaatccttgttgacaaacaaaattggagaggaccatagcctgcctgcttttcccgaggcccggggaaagctttttcatatgatgttattataatgttaggtgtaacaataaatgaaagttttgtatggtctgattgggtaggacaggcctgaacacaggcaaacccatctgcacagcatgctcaattcagtcagtgtacaaaccctgtgtcatgggagcagagagaagggtctgcttccattccggaggatgacagaggcttaaggacggtgctggcgtttcagctgagcctttaagaagtggaattttatccagaggtgatcttcttggaatagagagaacaaacaggtcagggcatgcagacttgattacaggtgctctggggaccactggaatttttgttgaacagaggatgatgaaataaatcagtgttctagtgtgttacctttgggcagtggcgagatccgagtctccatagtgaacaaatcagtgcacagaccagggcagaagtgcaggggaacatggaacattcagggcctggagggtggtacccaggccaacactgccccctttttccagctcccatctctgtccacatagttgggccagtgtagacatctgggtcatatagggaggcattccagtggccccatgtggtttccatggagatcttcaggaaggggttttggggtgagagttggtatctcgtggcaaggacacactccctgggctaggtacatatgggtggttttcttgtcctacagattgcaaagatacaggggtagctgttctgctctgggcagcttctgtagagacaggatgtgtatttgcttgcctgctcctggaagccagtcactgaggcagacctctttactcgtccagaagcatgacttggggatgattatagttcaaggacataaggcctagtggtgtctttcatcagcgccccccattttacatttctgggatccccctttctcttttactctgatctggcctcccttcccacccctctggccactcaggtgaggagatgccagatcccaggtgggcaggaaggaatcccactgaatgagatccttggaattgcagcgtagcctggagctgtatgttcattttagatagaaatattgacactattgacactatttggccgggcgcagtggctcacacctgtagtcccagcactttgggaggcaaatcactttgaggccaggagttcaagaccagcctggccaacatggcgaaaccctgtatctactaaaaatacaaaaaaattagctgggcatggtggcacacatctggaatcccagctactcgggaggctgaggcacaagaatcctttgaaaccgggaggcggaggttgcagtgagccgagattgcgccactgcactccagcctgggcaacaggtcgagactgtgtcttgagaaaacaaaaagaaagaaatattgacactatctgtccgcaaaaggtcaaaggcataattacaatatgattttgtttccatttttctttttcttcttatttcatgcaaatgctgtctttttgagagaagtggttataagcacagcgatattctatgctatgtacagctctcatatatagaactctctagaatggctcaagttaccattaagcctcaggtgatatcaaggttataaaatgtaaaatgaatgatcatgatcattaagtagaaatcctggctgtgtcttccaagttctttttctttctttcttcctttttttttttggagataggtactatctgcatttcagcttagcttgccgccagtgttctggtttcttgaccatgctgagtaattttcagccacaccttgtatcccttagaagcccttcttgattctgaggtacggggctcagaaagctttgtcgtgggaggttgtaaattaggaaacatgaaaatcagatcaacaacagtggctggtcctggctgcagggctcatctgcctggagtagcttgaagttgaatgttaatatatacttttaaattgcagttgtttaattaggtaaagtgcacaggtgactttctcacactaaatggatgatgagtattgggaagagttgactaaaatttctctatcttttgcccatatccaactctcattgaattttaactcttatgagatatgtgctatttaataaataatgagtctgagttttctcccttttggaaatgtcaggaaagtctcaatgattttaagtatcttttattttataatagcaatagaatctagaatttctaaaatcaaactgagttcttgattaaatgttgaaatgcttgtcttcatccacctgggagcagtcgttgtgaacgagaagccccagtgcataaatcattgaatgatacattggagaagtctcagagtaaaggaagatttgtttacttttcagacatcctggaaggtgagcatcaaagcaggtgagtggctggctcttggattcaagcttccctgatcctttccagaagtgtatccttctcctttaagagaa[450 bp omitted]cagaggttgacacccaggactagagctcagtagaggggccgtttcctacctgcagttcccttggaagagaaggggtgaagcttaccatgttggtggtggtttgtttcctggggctgctgtagcaacgtgccaccaactggctggcttaaaacatgtatggtctcccagttctggaggccagaagtgcagaatcaaggggtccgcagggcccagctacctctgaggcctccaggggaggatgcttcctgcatccccttgctgcttttggtgttgctggcggtccttggcttgtgggcacagcactttcctctctgcctcggtgactacatggcctccctgggtgtctctgtcttcttgcaaggacaccagtcatgttagattatggctccaccctgctgcgatttgacctcattttactttaactaactatctgcaatgaccctttttccaaatgaggttctgaggtgctgcacgttaggactttagcatgtgatttctgcggactcaggtcaccccataacagtagtcatgccccaccccatcccactccacccttctcccaattcccctggtatactccagggtggctctgtggccacacatgacccaggcccactggccattagacactttggcagggtggccaaagaaattctttgtgctgaataaaattaatgtgtaaatgcggcggtgctccaagggcagtgttgcgtgaaagggcaatagaaccatggctcctgataaacagaagcctgttaagcagcaaggtcaaaagccagatgcagaagtcagaattagccgggtagactttttatttcactttcccccccttttttttttgccagtggactgccaactgttctcttaacagaagggcagtttttgagtaaatgaagcaggacttgatctgggttgtcataaattgtctctccctcaagaggtaacttctcgtgtttgccagttcagaggtgtagggagacatctctgatgtgtagatgtcctagtttggggtgcagggtggctttgggtctgagagcctgctgttggccactgggtgcgcgtgggcttctccacatgacaagacgggaatgctgtgaaggaggccgctgttccgcttgggatgttggccgagcgccgctggcctgtgtccctggaatcctctctgattcaaccattgaacattaactctgtgaggtcacagccaccagcggggcttctgagcccggccctgttctggccatagagggtcaggaggagaagacgtttcacccttggattttctgtgtttggaatccaaggcctttcccgtggagtcttgtgaggttttctcgggaagaaatgatcctctgggagaggcttgggcgcgaactgaaacatctttcaagacactgtggctcttttcagggaaatgctaagccaagcaaacatccactcagaaatgttctgtatttggaagcctcagagtgttaggggaagccttgaccctggaatgtcatctcctggtggtggcggcttcacgtggtaaacaggaggtaacctgggtgtcatgtcacccaggtgacatgacacagggccacacaggatcatcttccagtggcagtggtgaagataggggatatgatttcacatcctcattagagcccacacatgagatccagctttataattggaatcccagataatgagcatgtgaacgtccgtaagttccgcctattctgggtatgatgtcacactcataaacaagctaagcacacaaactggaatttcactttggaggaaaaaaatttcaattctgttacatgagataatacaagtagtttaaagccacagagggtctctttcgatcaggtagatctattcttctgtgctcatgcaatatgatagaagagcttcttgcatctttatgtcaagaatttgctaaaataaatcagacaagtttaggatttacctcatagtaaatcaagaactttaagcaggggcttttcttctaattaaaaatgtcatgtataccacttagacatggaaatgcttaggtaagtggagcaaattattctctggggatttagaaaaaagaaaatcagtctggtttctatggctgcatgaatctggaaggtaaattattaacccagtagactaagattttactaaaaacagactaatttgttgtggcaagacagttccagtctgtgtgctagggcttttgtttgcatgcttgcttgaaggcagacaagtcaaattaaacaataattattggcttggagggggagcagatgtattggattagtttctgtgccacatttctctcatttccaccaatgcactccagtttcagcccttgtatcagttatctgttgattgctgtgtaacaaatgaccccaaaactcagcaggtgaaaactacaaacgttaatgatctcacacaggttctgagtgtcatgaatccaggtgcagcataaccaggtggttctggctcagggtctctcgtgaggttgcagcctgcgctgcagcctttgagacctcgtgtggggctggggggtcagttccaagctcccttagggtgtggctgcagcagaagtgatgcaccatgtgcaacaattctcttggtcctgtggatcaacctggtgaatgtgggacaggccggtactggagtgtgaatgccagggctcacggggaccgaccgtctgagaagctgcctgtcacgtctctctttgtcttttacacccataaatgggcaccttggtcagagaataactccttttgagtccataatcgtctatcagaaaattctgggaaaattacttgttgatttagccacgttcatggcctatctttggagccatcagagcccacaaatggagactgtcaacagcttagcagtcagttcattagaaagtagtgttactgcagcctgggtgacacagtgagactctgtctgtacaaaaacattaaaaaattagccaggtgtggtggcgcatggctgtagttgctggaactcgggaggctgaggtggaggatcacttgagcccaggaggtagaggctgcagtgagccatgatggcatcactgcactccagcctaggtgacagagcaagaccgtgtcccaaaaataaataataaaaaaagaatgaatcacataccaatttttttgctcttaattgcatttttgaacagaaaaacagttttccctgcaatcaaatgcaaacagttcctgagcccctaatggacgagcgtcctcagctcccacctgcactataaatttgcgttaatcttccagttaacttcagaactgctgctgtctctctatgttccttctgcctcaagacatataggaaatgttggcctttccctttcaaaagaacaaaacagttgaataacctactacagtcttctgtgcaaagttagcttcaaaaattatcaagaatgttttctccaaacattcacaaagtttacagagttttcccttttactcaggatttcagcccctttgttgctcttggctctcacagcaccaagatcgtctgtccactcgttcattgggcagatgtttattgaatacctgtgtgtgccaggccctgggccctgaagtcagggccataaacacagagcacagtcctaagggcaaacgattttctcaacagggatttgaggcctgtgaggtttgaacaaatgagcctcgtgagtgccagttctggacactcggcctgacttatcggacatttcgcagattcctaagattttagaattgggagagaatctttgagatttgcttgtagcccttacattttctagacaaggcagaaagaagtccagtgggatgaggcagtgctggtgctggcaccgcctcaccctggcacttgcatcgcctggaaacaaggcagagcccactggggcccccagggtccaaagcctccaggtacgtgtctgagttctagcattggagttgccgctctcacccttgccagttgctttggcatgaagcttgatggtaccagtgtgtttctgtcttcacagcttgtggccctggccctgagacctgaggcttggatggcactcccacttcttgctttaattcttccctggagagttctcaccttccctgctttccaagtccagctgagatgggcaaccaaaatttcccaagggagaaaatagctgaaaatagaagtagaacatgaaagaggatggcttttcttttttctttttttttctttgttccttttatttttttaagttgatttatttatttatttatttgagatgaagtcttcactctgtcacccaggctggagtgcagtggtgtgatcatagctcactacagcctcaacctcctgggcttaagcaatcctcccacctcagcctcccacaggtgcatatcaccatgcctggaattttttttttttttttttccaatttttgtagagacagggtgtcactgtgtttcccaagctgttctcaaactaactgatcctcccgccttgggctcccaaagtgctaggattacaggcatgagccatgtgcctggccgagaatgtttttcaatttgggcttgttcagtggttttcacatgattggactggggtggtaggttttgaggaacgagaccccagaggtgaagcgcccttctcaccacatcatatcaagggtaggtactgtcaacctgactcaccactgttgctgttgaccttgaccactgggtttaggtcatgggtgttgggttgcgattaatgtttttccctttccatgtagtattctttcaaaatccccactcgggtggaggaggggtgttaagcatctcttcctggaggttgtttatttcggttttatgttaaaatatatcagtgcagatccattcacccatctcttgatagaaggagtaggatttttcttgggacagggatcctttattcctagtttggagtcagcttcccccattccggatggtgcagcctctacaatgtttgtctctttgaagcggagtgggaattgaaagagatttatgaaaccatctcggtatagaatctatctaggattttattttcttttcccaaatcccttgaggcaatctgtcttggttaagtctctaaaaaagcagtcaaagtggtttttgtcgaaaaaataatttgggggtactcctagttcaccattttatataatattcaattacttttcgtaaatgcaataacaaggccaactgacataagcgagtttgaagcagtcagcagtttgggtgtttcagacccaggtaggcagctgaggtgggagatcccaggggaagctcagggagcagctgcccgccttggtcagttcagccaggttaagtggaggccttgggaagagagtttctcctcttgagtatttttagaagcagcagatatcagccataaatatttaatgttgtgtttctaaactttagcgtcataaaaatacaaaaaggtgactgggcgggggttggtcagtatatacctaggggagaaaagaacttcctcaacacatcacactgcataaggaaaaccgtcttaaacgttcttagaagaaaagtcagtaggtaaacagctatcgtgtaatctgatgaatacccaccggaggaagtattagtaattattctttgcttgccagggttttcataattcttttccaattataaaaattaatatgctgtaagcagtttttaaaaataaaagtaagcatgaaaagaaaaacatctataaacccacccctagaagttttgccccagcattttggtggtgtgttttcttccaggtgtgtgtgtgtgtgtgtgtgtgtgtgtgtgtgtgtgttgccccagcattttggtgtgttttcttccaggtaggggtgtgtgtgtgtgtgtgtgtgtcctgctgtattctgagctttgtagtatgccccttccacttgaccttctccaggaagcatttgatcatccagcaacatcgattgaaaatgtttgtatgcatctctttcatgaagtacatgttccatcatttatatcacatgtgttgctggagatttcaattgcttccattttcctttaggataaattgctggaaatagaactggagggctcttgagaccgattaccatattgctttcctgagaggctgtgcgggttgcgtggcagtgaggagggacgggggtaagtggaggggctggggcacaggcctctccaacacttcatgtgaacatggtcagctgagccaggaatgcgtgacatctttatttttccccttgcatttctttaattcctaacgaggtggaatatttgatcacatttgtcagctatttgcatttctttttccatgtattagacctaagcctctttgaaaggtgttatctcaggttctttccaatattgcactttctgagtttctcttgaatcccagttattttaaggattgcagtgttggagtttcagctgaaggggccatgtctgatgtttgctggtccattagcctcctggcctgagccaaaccatgcatcttcatgtcagagctgcatatgaaacaagagctaagtccagaaagcaagaagaagctagcagattgattttcctaggtggggcctaccagggcacttctgttgttgactgtaccactctctcctgaagggccctggttgtgtactgcagttgggactgctgacgtgttggggtgttacaagagcatgcggaggctgctcctctcctgtttcctggtgtgctgatcaaaagactttttatagaatgacagttgtaggaaaagcacagattcttatgttagccaataacggattattttttaatgttattataaattggcaagcttactaatttgtttctacttgtcattagccaaagttcagtgtttcccaaggatatatgtgaatgtgtgtctgtgtgtgacatctgttgtatttttcacatgaattaattgagtatctattatgtggcaagctctgtgctgtctttgaagcactgaactgtcttatgatacacacaggatgaggacaggatcattttctatatttctgtgaagtcctttttcaaattcccattcttttgctgcttctgcatctcctttgactgctttagggcatcccaggtagaaagcttacctaatgtcaactccagttctttcttttgtagtcttcattttaagcatgatttctgtttttctttttccctttaaagaaagcttctcaaactttgaaatgaaaacaaatgaaaggagagggaaaagattcagaaattattgatagattgctaaaaacaaatgctatgataattttgggtcggagcatctgtcgttttacagcacaacagatttagcttcttaatgatgtttgtatgtttttcctcaaaagtgtattgactaggtaggagttgagccaagccttgaatgaatcatttcctgccaaattcaatagactgagcaaatcctcggagaaatggccatatttctctaacactgggttcctttcagggctcaagattccattttctctcaatactttgctcctacagactaggagtcctcttcatgctacagtatgcagtgtgtatggaaactgtgaatggagaagcagccgttcatgctgccaagtttctttcagaaggtggctccaggtggatgactttcagtctgaactcagtgtcaccaggcatgtgtgtgcccacacactgccactttaagctgtggacaaacagaacggatattctcccaccaaaataaacatacaagcaaaacactctgtcttcattcagcatcatttgcatcctataaaataatggtttctccttgatgcccacctttcttatgggtggttcttaattagttccaaacagaacttaacgtggccatgatattccacttgctaaaacaagggcagtcgagtgttcgatttgccatcattgattagacgcatgcagtcacccagtgctgtttgcccaagcatctgtaggcggggattccccagtgctgattccccaatgcttgtaaggggcaggacttaattaaatcttaaagtgacagctgaaaatgtaagggtcaggaagtcatgtctaaaaggggatttagtataacaataataacagcagtgactaagactaatcctggctcaggcattttgtttggggtcacctggtcttaattagcagcactctgggatttgagtggcgctgtgctgttgcccacaaagcccatcagtggcaccattgcctgtgtctttcggggcagtctgttagggagggggtggcacaggtgttggcacggccatccccattttatatgtgagggaacctcagccaggcaggatccttgcctggatgctctgtggggagccctgtgagtttgtaaccctccgtgcagcctgccaggtcagcggccccaaaatggagagatacagagggcaccaaattgtaaggcagagcgttggctagtgacacaagctgcctttcgatcgcctgggcgttctgaagcccgcaaacattcgcctggaccttggtcaggtgtctcacagaacctacagtaattcactgttaagaataacttcaaacacagaaaatcgctttttgtttcctagagaaggctagtcttcagcgagaacaacttgtgatttttaatctgtttcacactggtcggggaggggggaagaaaagatgttatgggcatataattaaaaatttgtcggcagatacaattacaggaagaatcatgtggcctaaaaaactgaaagcctccatatgcctcttcatcttgccagctacagtccacaaattgtagagcctgcgggcactgtggaagccagctagatttgctctatccagtagcagcagattgagagccatacatggaatttatacttttctagcagccacaggaaaagagtacaaagaagcaggtaaaatttatattacaacatcttttttactgtgtattaaattattattgtaatacctattttaatatataataatgccataatatattttatttaacccaacgtatccaaaatggcatcatttctacaagcgattcctattttaaaaattatccgcaagatattttatgttctttcttttttgtacaaagtctgcaaaatccagtgtgttctttggtcagtgatgtctgagatcccaagttccaatgtctgtctgaaattatgaaaatcaagtcatgggagatggataccctattccctacgatccacttatttcacattgcatgcctgtatcaaaacatctcatgtactccataaatatatacacttactatgtaaccgcaaaaattttaagaatatacaaaaaattttaaaaactgaattaaagagcattgtagataattgtatttttcaaaaaataagtaaaatatctggtatataacagttaaaaaaaaaactgtattatcaactctgtgaccttagaactacctttttacattttcaaagattaactctccttaaaaaaataaatgtacaaattattaccaaaaaaaaaaaagaaaatcaagtcataatgtgaaaaataatttttaagctgaaagttacactgtttctaggagttttaaactaggatagtttgtggttattaatctgtttggaagtagtccagaaaaaaatgctatgggtcaataacttgaaaatgtgcatgtggactacttaaagaggaatcgtgtggcctaaaaagtccctgttatccctccaccctgcagactccaataggagaatttccgctgctgcagactctccttggtggccaagctgcccagcactctcccgtcccaccaatggtgtgactcctatcactgagaaacagaccccttaccatttcatttccttttaattaatttaaatttaaaaatcaacacttccttggttactggaatgttgggaaccatgtgggtgtgtgcatctatattttccagggtctattttgttacctataataccagtcatgtatttccaatgaaaatttaacttgtgaattgagatatagtacaaatgtaaaatacatacactgtgatgatttaggaaatttagtaggaaaaaggaacgtaaaagatctcagtaattttttaaatagaatacaagttgaaatgatactattttggatacactgagtaaatcaaaatctatcatgaaaattaatttaaggctgggcgcggtggctcacacctgtaatcccagcactttggcaggccttggcgggcggatcacctgaggtcagcagttcaagaccagcctggccaacgtggtgaaaccctgtctctactaaaaatacaaaaattagccgggcatggtggggcatgcttgtagtcccagctacttgggaggctgaggcaggagaatagcttgaaaccgggaggcggaggttgcagtgagctgagattgcgccactgcactccagcctgggcgacagagtgagactccatctcaaaaaaaaaaaaaaaaaagaaaagaaaaagaaaactaatttaaaattatacataaggcttgccttagatttctgttgggttgtgcagatctagaccacagttgtcatgtaacaaaggaaggagagtttgaaattacaggctcacagttaatgataaaattccaacctaaacccaagaccagacattccaaacactcaagtgagtcaatctgatgatttgtaaggcttaatgttgaaccgtcttcaaatgtgatgacctcatcctaactctttccaagctcccactttgggtatatcaagaggctgaatgtggtggctcacatctgtaatctcagcactttgggaggctgagtcaggaggattgcttgaggccaggcatttgagaccagcctgggcaacacagcaagaccccatctctacaaaaaaaattagccggatgtgttgatgcacacctgtagtcctggctactcatgatgcttgggttggaggatcattgagtccaggaatttgaggctgcagcgagccaggatcatgccactgcactctagcctgggagacagagcaagaccttgtctcaagaaaacaaaacaaaaaatgaattggccaagagaagtcaaggctcatctgacttggaagggagccaggttctcagtctatactgcttttctcatcctggcagcatccccatgagataaaaatgattattcccattgtacacttaaggtaaaaggtctcaaacagatgaaataattgcaccatgactatagaaactagtaagagtcagcgcctgaaattaagcccagggctgtctcctttgacactggccaaaaagcagtaacctcttttgatgaaggggcttacttcaagctttgtttatgtgatgaaaacaccccagggctccagaaacttaacatttggttccacatccagaaaagtaaatttacaaaatggtactgcaagtgataattctcgttgacctgggattgctagggtataagcattctgggaatacctgggtttctgatcaggaagtcattcgcagctataatggtgatcctcagtcaccgggactctgggattgctagggtacaagcactctggggttacctgggttcctgaccaggacatcactcgcagctatagatggaatgctttaccccttttctcctgtgttatatgacatcggttagcaccttttaacctttttagaagataggttggaagttgagttagataaatcaacaggtagctgatggcctagaatataactttctgtagctttcaaagtgaggatgaggggcatcttgttccctaaactgcttcctcatgatggggaacctcagcattgtcttgccttgtgtctgagtacccatgtaaaattcagtatttcattcttaaaagataaaggggaagaaggaataacaatagacaaagagattccaccctagtccccatcctcattctggtgaaaagttgtcattactaagacaatcacacactcgatggagaattgtaggctgtggacaacagagccatagatggtgtactaatagctgctacaaaggacgcctctgtcctacctttcatgcccagctttgagtatatcctgtctcttgctcattaccgatgctgagttttagccctgtaaccagagtcctctttctttttccacagatgggactatgaactgtgttttaatgattagagggagtagtgaagattttcactgtgaacattttcaccccctttcccatccttggccagagatgatctcacatggtcttggcaggtatctttttacaggagtgcatgttgtttatcttgggagctttttgcacagggaaggcctttgtcttccagctctgtgaatccttcttcactgcgtagcaccttgcagaacatttgcacatattaggctcttggtgaacacttagaatcctcagtcatttgcattcacgtcatgtttccataacacattgaatgaaccagcaagtatttattgaacatttactatgtgaaacacagggaagacagccatgaacagaccagacacaaatcttacgtgctactggataaaaatgtaccccacggatgacactttgggtattatgatgccaacaatgagaacatattaaatcactttggtatttgcattagattgtgtcctgtaagtttcagattggtgtatttgccaaagaacaattgtgtgtaccccccacccaccagaaaagaatacagtaaaagtgctaaactattgaatatttttaaatggtattatatttgaaacgtgtgtttgtaattttgagccatgtaattagaaatctagggtttatttaaattcttgtttgttttagagaaatatgtaaagccacatttccctttatataaagtacttggttgaaaaaacaatttttttctaaagaaaaaaaacactctttagtgtacttttgccaattaaaagacagtacagagaaattgattcctcctggagtttgtgtagaaattagaaaacataatgcttttccctaggcatgaactcgcttaaaactactgagaagcttatactcacgcaggttgaatggagtgaatagtggtttagagaattgagctgattaataagaagtccctgattttcttttaataacacgttctgacccaataaggaaaatttgcactatgttttcctacagcgatggtgctgttaaaacttatgcaaatgggacaactttattattactaagccttttacagtatgttgctttccagggagctttgtaaatcattataattgtgtttcctcagtgtatgggttctgaatgctcctgttgtcctgtgaggtgaatttccatttggtgaagatgatactgttaaatggaggtttctaccccatagaaattaagaagagataaatgcagacagacccagcccttggaaattctgctttgtgatgaattatttccttatacttatggtgaacttttttacccgtgatgtgcacaggggcccagaatcatatatgacaagtccttccatgtggactacatccatatgacaccatgttcactagttggagccttggaaatccagtgggaatggtgagatagtgtgaacagctccaaggcaccgtgtttttaatgtaacccattcgtttctggctgaataggctagttgttgatgtggtgggcattatgagatagtgttaatggttgggccacggcatttcaaagagatgccttataagtcctgagcccattgtgcgtctctgatcattttggtcttcatttgctccccttgcccaccgtccttccacagagcattctctggaagcgctcagggagcagaacagggcaggcccacgtagaaaatggtctcttgagagtagaaggtcaggttcgctgagatctctgactcagaccacccgtacccatgctttttgttgtgatggagaaggtgctctcatatatacacatttgtgtagtaattactgcatattgatagcaatgttactgcacctgttaattaatataaccaaatggcatagctacagtgttttattctagttcaatttaggagagtatatttgttctcaatgggaattgatctggggagacccagagagtggggacatgagggttatttgtggaggggatgacacagcagcttcagaaaacagaaacattaatgcattagactgctgacctgtggggtcacacttccttcagtgatgcccataagagtcttggagtgccggaaagtataagcaacgctgagttcctgccagtatcacaaaggtgtgttttggataagagaggagccagaaagattacacttgtgtagaaagtgaaaactgagtttgagggaacagtcacattctcatggcaataaggtgggtagaatgggccgctcagcctctgcactgtggtcagctggagctggaagatggttgtggtggggctgccgtgtgcacggtgggaggtttagcagcatcccaggacccaggagataccagtagcaccgcctcccccagttgtggcaactgaaaatgtctccagatattgccagatgtcccaggatgccatagggggagcatgcagtatcattgcctgttgagaacctctggaataaataggtaaatgcatacaaatataaggatcttagtcttgcattgggaggcggcgtctgacatgtaaagacaccactagagcacactgaagtaggttctttcagagcattgcatgcatgataccctggagcccaaggagaaaatgatcaggccatgcctcctggaatcaagaaggcttgacttcacggcctggaggagataagttttaaactgatccttgaaggtagaggtaggtgaggaactagatgaaaggatcagtattaggtgggcttttaaaatattttctggccgggcgcggtggctcacgcctgtaatcccagcactttgggaggccgagacgggtggatcacatgaggtcaggagttcaagaccagcctggccaacatggcaaaaccccgtctctactaaaaatgcaaaaaaaattagccgggcatggtggcgcgcccctgtaatcccagctacttgggaggctgaggcagaagaatcgcttgaacctgggaggcggaggttgcagtgagccaagatcgtgccactgcactccagcccggacgacagagtgagactgtctcaaaaaataataataaataaataaaatagaatttttctgagtattttgtatgctgttgaaaaatttatcacttcgtagatgtatctcactttgtctatatctaagaaaaaaactatgtgcataaatgaatttttattagctagttaatctagtcagtggaatggagtattatttccagagttccacttcatattccttggtaatattgagacgctggttgtagtgaaaatactcttaattaaggcatgttgtaggttcagagtttagatggctgaatttcatgaagggtcttcaaagcattgggggtgtttggtgtacggtagtgattttcttgtgttcatttgacattttaaagtgatagacgtttaaccttgggctttctcaggactctagaatatgaatgatcactgttaactgtttagaaactcatgatgtaagcccatatgacttatggatttatgcacattctaaacagataagcatcatacaaatataacttgagttttctatgaaaggacagtgagacaccaccccccgcaagtctggcctgaacattggtggactgggaatcataaaaactgatacatacatgtcttactttgtgtttgtttgttctaagcgaaagcatgtgaatatgcagtcatctgccaatactttgtgggccagcccaggcctctgctctgaggatggcccacagcctggagtgccccagtgatcccagcactgtccacacccgcggtgcatccctcctggcttctagtttccagttaacttaagcaaagctgcacagacatctcactgtacatctctctagatttatacctcccctctctaccttcccggtcttgctgcccacacctgtcctcaagtaaaaactgattcacacttaccctgtctctcaaacattcaatgttattttcattttgaaaaaaggctgtgaccctgtgtgtactcgtacttcatccgtctgtgtaatatttaaagtttgtagttaaaatagtgaggacactgagtgaaatggggctgggagcagacttggatcggctttgggagatggtgtaggcagcgatggggacaggtggaggtgcggaccggagtgccgccctctagctgcgagcttacatcctcatgcttgggtgtctgtccttcagtttcttctccagtgccacgtcacctacctgagctgcctcaggtttgctccctgctgctgtgcacacgtaaatcagtgtctggcgggaaacaggcagacgcctttacaagaactagttgccatttatctttttattgttagacctcccagtaatgtgtgaagtctagtaattgcctgtgtgtcagactaactcagttgtaagctctacattatggtgctattaatctcttcaatgtaggcaaaatggggacagtggctcccacagcaagcccatctgctctacccatgtaagttgggagggatgtggtaccgtgtggcttctacttctccatccactttacggttgatgttcatgcttattgtaaaagccctgcaagacctagagatgctgtgagtcctcacgaaggaaaatgcagtgttccgtggggttgtgctgtccactacaggctcttgacttctgaactttctgaagtttgtatatttatccgggaactcatacttaccaagctgtattttaagtttctttcctgagtcaggcaccctccaagctaagtgctgtggctgcagaggcccctgccctgatggagcttgcctgttacttgggagacttgtagcaaacagaggaacaaagaaacaaaataatctgatgacagtaacacatcctgtgacagagacgaacaaggtgacatgggttggaggggtttgcacattagaggtaagaagactcctgtgaggaagagatggatgaaccgaagtgtgtaagatgcagccggaagagccaggagaagagagtttcaggtggagaggccagcacatgcgaaggccaggcacccaggaaactgagggaaaacacaggccaggccagcatggtggagcgagtgaccaacagagcagaggtgtgcacggtgaacaaagcctacagtgctttgccggccataatactaagaggatgagtgtggacctgaaaccccccagcagcttcctaccacactaaccagtggctggctgctggctgagggacggactgtgatgactcccactgggtcccaggcagggagataacctcaccttccactagcatagctcagcggagccaagaaggggagaggacagattcaggacactccagtgcagaatgtcagcggacgtgcatgtgtcctgccaggggagtgaaggtgtggcatgtgagcacggagtgggagggaggtgtgacttatggagactacaggctagaagagagacgagatgccatggttgggtgggtggaggtctctgctgtgggcgtgttgcgtttgagatgctgcttggaccttcaagtggccaagtcatgcagtccctgcagggataggtgaggagctatggaggttgggggctggagacatctgggatgtagacctggagactagattcgttcactggagagacccatggcggtgtagtcagcgaggggcactcaaaggtcgggaagatgcctttcagaaactcagggtgcccaaagcatttccaaaatcatttaacacctccttgcattttcacagggacttggaacctcttaggagataagaatatagggaaccagccatctggagacttctgcagagaatatacattaatatcactgtcttattctcactgactccccacctttttaaaataagggagatggcctagactaggaattttgcttaacttctatcctcctgtcctttttttctgactctgcagttttcatctgaggtagagagaaatgatgcactctgctaaattagacctgaatatctgttgtttttcttagacttgtgaagtttttactaacaaccacaagcacagtcctgaacatcgtataacagcatcatttgttaattttttgaatgaattttgtgattaaccttgatttaacaagaacacccagcccatttcccaacgacacaaattaatacaaatttaatgaaccgaagtgtgcccttctgctgccacgtagctcagttctccagggatggaagctggcctgagaatttctaagtttgacgaacattcagatgttccagaaactatcaagattctgagactgtttctaggaaaggccacaactctactggaaagtatatcagaatgacatttttgaatctgaaaagaaaaaagtcctgtacatttttaattttagttaagagtttgaatctggcttaatatattcttaacttgctagtttgaaaacaaactggtcgatgctcattttcactctcataactgtttcgatatttctgattttttttttttctttaaccaacagaggggtctttggaagacatatgtgcttttaagtttcaattttcattgcaattttgtttgtggtaaaatgcacataacattacatttaccattgtaagcatacagttcagtggcattaagtacagtcaccatctacctccagaactttttcatcttcctgcactgattctccatcccccatctccacacccccggaaaaccaccatcccactttctagctcttgttttgactactctggtgacttcatatagtggaatcatacattaattgtcctttcatatcgggcatatttcacttagtgtagcgtcttcaaggttcacacacctgtgtcagaatttcattctttttttttgtttttgaaactaagtctcactctatcacccaggctggagtgcagtggtacaatttcagctcagtgcaacctccgcctctcaggttcaagcaattctcctgcctcagcctcctgagtagctaggattacaggtgcgcgccaccacaccctgctaatttttttgtgttttttgtttgcttgtttgtttgtttctttgtttgttttttgtatttttagtagagatggggttttgccatgttggccaggctggtctcgaactcctggtctcaagtgatctgctcaccttggcctcccaaagtgctgggattacaggcgtgtgccactgtgcctgaacagaatttcattccatttaaaggccaaatatgtcattgttcgtataaacagcatgttgtttatccactcatccgttcatagacatttgggttgctattccaaaatagcttttggctattgtgaatgatgctgctgtgaacattgaggaacaagtgtctgtttgagtctctgcttccagttcctttgcatatacctagaagtggacttgctggatcacatggtaattctgtttactcttttgagggcctgccatactgtttttctgaaggtttaagtttttgtgagatgtgataaaggtagggtccaaccgtgactcctatgatttgatgcaaaggttaacccactgtatcctgcaagccaaatttagcccttgctaattttgtacaggcaacatgctaaggatatttttaatattttcagatggctaaaaaaattgaaggataatatgtcattatccatggaaattcaatgaaattcagatttcactttacatagttgaagtttcattggaacacggttatacccattgtctgttgtctatggagcagactttgtatggcccatggagtgggatttgctatggcccttcgagaacaaatttgcaggcctggcatggtggctcatgcctgtaatcccagcactttgggagggtgaagtgggaggatcatttgagcccaggagttcgagaccggcctaggcatcatggagaaaccctgtctctacaaaaagtacaaaaattagcggggcatagtggtgcatgcttgtagtcccagctacttgggaggttgaggtggcaggatcacttgagcttgggagatggaggctgcagtgagccgtgattgcaccactgcactccagcctaggcaacagagtgagaccctgtctcaaacaaacaaacaaacaaaacacatttgcaaacctggttaaaatgataaggagttcgacaaagcttacttacgtctgttgactgctctgcccaactccgtgggcttttccaagggtctgagtaggtgcatcaagctgtccacctaattactcacaccatcctacacattatttgtcacttttttgcatgtaagcaccaatcccagttgcttaagcctgcagggggcatttccttcagtaggagatgcagagtgtaaaaactccaacccatttgcatcttgcttatttcaggtacatttcctttcctgtttataattccaaagtgtggcttcctatcatgccttttaaggaactatctattcccattgactaggagataaatctctgtatagtggaggaaccaaactgaggaagacttctcaaaattgttctttttatcatacacttttttggaacgaagtttatagccaactaagaggcagtcttctatttttaatctgtgatatttctgtaaagtcatgtaaatgtcataactgcagtgttttcaagttgttgttgtttttgcaaagagctgttctctgcagtgagggctgagtgtgacttgttaaaaatgaaattcacatagcatccgtttcctccgttagcttctttcacttaaaggacatcttcaacatatcatttaagggcaacacttggttcatagtgtttaatttgttgtcaggaatgtcagcctcagaacttcttaatatacacacccaactctactgtaggtgcctatataatttacatttaacctattattttattttattttattcatgagggtgatcttaggacctgagataaatttgaacaggatcaatacaaatcaggctatgtttaaaccaggaagcagaattaaattctatttttcttgtatttgggttttgcaggaaatggggcatcgtgttttctcttttgaaattgtgtttgaagtgatatttgcatgaagaagcagcctgttttctattagactggtaaagtgggaatagtagaaaagagaaaggcgggatttgggaaatgtgacatgaagacgttgttaaataaggtatgcgtataactaaatgtggcaagaacaatgctacttagatacggaagctgctaaagtattttaatgttctctttacaaaaaaaaatttaagaattttaacatctgctagagctcaatctagtctgaattttttttctcatctgacctttttcatttttcctttctcaaacacacttgctcatttaaaaaattcagttggagaaccaagtaatatgtttccatttaagaaagccacagataaatattgttccatttgaaactacagcttcactcacttgatacttgtatgactattttaagttccttttaaaaaaatggctcaaatttatccttttgggagggactggtgaaaacgtctgcaggttcatcttggtttttaaatttttatgtgtttaattgtggtaaaaacacataaaagtttcatcttgctttcatgtttgcttttaaggtctgagaatattaatagaacaaaaggaacacaacagcattccaatgaccagtgagtgtagctgttcccactgtgtggttatattgtttttttacaagcctacatatgtggctttacctatattttaatatgtgaattcatacagtgtaactataaagcattgtgctcacttagtggcacagagaggttaagttactgactgggggacatgcagccctcagcacgaaattctgggatttagccgagaacagcctcactccaggatcatgctgcttctcagagtttgctagcttgcattgttagagtgtaatttctggaaaacaaggccatactggaatccggaggagagaaagatggcttacactgggtatgagtacagtgtagttgagatgtgcaaacaagatgtaggtaagataaaagaaaatgcaaactaggccgagtgcggtggctcacgcctgtaatcccagcactttgggagactgaggcaggtggatcacgaggtcaggagttcaagaccagcctggccaaggtggtgaaacccccgtctctactaaaaatacaaaaaattagctgggcacggtggcaggcgcctgtaatcccagctactcgggaggccgaggcaggagaatcgcttgaacccggcgggggggcggaggttacagtgagccgagatcatgccactgcactccagcctgggcggttacccttttttggttgtttttattttttattttaagataggtcatgtggtgtaacgggaagctgatgggacttagggtcagacgacctgggatcattcctggattccaatctccctggcaatgtagtaaaaggtctccttgtctttgagatgtcgggacggtgatgcagtgaggggcagggtgttagggaagactaaactcatgtaacacgaagcatgacacgtgtcgcgtgtgtctctttgtaccacaatatccttggacatacatattcctgacctggtaagatgagattctgtatgttttttgagacctcagcatcccatgcccagacactaaagtcacaggggaccatcagagtcccctagtagtttggaaattctgatcaccagtcagcaaagatatttgactgttggaaattttttaaatggtgagctctctttttctgtttcaagattcggtcatcctttctaatagtagacacggaagtctttttgacaaaggtaatgctaggccctgcactggctgacactccatgcagtgtactgtccttccatagcctgtgccgttagtttacagaggtcagtagtacctgcccgccccacagggtttgtgtccaagtgcttcatcgtggtagaagtggtttttaatgaaacaatagatttcttggtcttgcttcaagtgaaatccctgaagtgtttgctttcccgatgatttcatgctgtaaactgcctatttgtggccatggcccatgagcataaagcagcatcattgctattcaggcacataaaagccagatagaagaaaacctcactatttagccatcgtgtcagagagagccaaactacatgtctttctgggccctggtttttaggggattgaatgtcacccagaccttgagtcttagttatcagtgtcgcatatcaagaaaggacactgaggaatcagaattcttacaagggtggcaacttttattttatgaattgaaaaatattcctattcagcggctgtagtcacacaaaactaggcctgatgtaaggttccacacttttaaaaagcattgtatatatttaactaggattctgtagtcatttatattaggaatattgttgctagttgttttgcaagtttccagtagctgtaatgcaactagggaagcatttacatattgaaggcaggagccaccaataatgtacggattttaacagtaattagggtatctgggaattgcacaggtttcattctcgaaaagttaactgaattgcacagatcaaaagtgaaattgattcactcatctaaacatgcactctgttgctttcttggtgagaggaatgacccacctacttggtcttcatggagctcggtctcctcatctataaataatatattaagtgttgatctaagaatctatgaatctgaattttacataatgagagagatgtacatgtgagtgaaaagcaaaaccctgtgataactcatttttgttccagctacaatattgtggactctgtggactaactatagccaagacttatctgagtcaggaaaaaagtatcatagaaaatccaaaaattaattgaaggcagttgtttgtaggtacagcccaagtgactgcataaatttcacaccaactaaaagtgttaaagagtaacaagatgaaggggttagaatgatttgtgatggatacattgtgcattggaaattgtttgtaagacttccccaataattgtgtttcagttgcccaattcctgtttattctcattgtgcagaagtaagttactactcccttcaatataaattagtgtaaattgtgaattgctttcgtctaaaacaatgagagcacccaacatgaagccaggacttggggttcaaatcctactacttgttacctgtgaagccagcctagattgttcacttacactcttcagaaagcagcctctttatctacaaaatgagaataaacagggctgatgtgatggttcagttatataatggacataatattaaatagactctttctttctgaatgggaaagtgaggagttactgtatttagaagatgcataaccagccttgctgttcaagaatgttaggaatgaaaacagttgatatgtggttctcatgactcaattaaaagatgctatgtttgtgtaaaaattaagaatacatttctgctgaacttgtggaagaagcttagagcagaggctgcctgtgcattaagactgagaggacttggaaagagaagatttttaatgttttccttttacattagggtttcctaactgtggcactgttgacatgtagggctggagaactatctgtgggaggtccttcctgtgcactgtaggaggttcagcagcatccctgggcgtcccccactggatgccagcagcaccctctccgtatggtgaccaccataagtgtctccagacattgtccaatgtcccctggggggcaaaatcacgcctgcttgagaaccactgaaaatttccccaatataaacatgcattacttctgtaattttaatagcaacttaaaaaaaaagatgtcatttccaaactgacaaggctagtctgtacagcttcacatattgaagactcagaagagttggactttttttttctttttcttttcttttttttttgagacggagtcttgctctgttgcccaggctggagtgcaatggcgtgatctcagctcactggcaacctctgcctcctggattcaaataattatcctgcctcagcctcccaagtagctgggattacaggtgtgtgccaccatgcccagctaatttttgtatttttagtagagacagggtttctccgtgttggccaggctggtctcaaactcctgacctcaggtgatcctcccaccttggcctcccaaagtgctgggattacaggcatgaggcactgcgcctggcagacttggatgtttttacgaggcgttttgggcttgtgttctgtaagcatcagcttaacagaaagtgatgttgcatgactgccccaaagactcctggtggcagctgtgaaagcatccagggaccaaaacctgtgctgaggttgccctcaggcacctgtgggcctgtcagtggggccattctaagtaaccaagacaaacctgctctacttgtggaatacggatcttcttcttctgcatgttagttgtctagggtcaccttgatgatattagtaggttatctgttctactttagtaatgtgttaggagtgcacagcttaatcaatctaatatgatactgctctaaggtagggctcagcaaactactgcacacaggccaactggcttgcagcctgcttttgtaggtagttttattggaacacatacacatctgtttgcataaacacacccatttgtttacagattgccagtggcttccaggtacacgtgactacgatggctgcaaagtccaagatccttgctatttggccctttagagaaaatgtgtacctaccactgctccatggttctggaactttctccccttctgttgccatatctaggtatatctcccatctgttaatctcagtttcagaaagggggaggatagtaaacagcatagccaaacaagacaaattatgatagagagcactgtgaatatttcaactttattcagtgcttttagtgagtatgcgtgtgtttctctgcatatcagatgcatgtaacgtgtaccagagtgtatttattaaaatgcctggctcatgtacttgttcatgaaagaagcaaaacaccatcgttttccttgatttaaaaaaacggtagcagcatttgtgctggagaactttgatagaacatggcagttgcgtgtaggatattggaccagacaggctgttggggccagagttttaagagggtttctctagaaacagaccgtactaggattacatgggaagtgagtgtggaatacttcgggatcgctgatcgccggttgtatgggagtgaggagcaggacggggctcagtggggagctttctggaatgccagtcccgctctttcctgcatgtctactacccccgtccaagcacttccttggctctagtatgtcctcatgagcagggcccatgacttcccggtgttatcttctggataatttaatacagggttcaggatatttgttaagtcccataaaggtgttttaagtgaacagctgaatggcaacctcagtttgatgatgctctgtctcctggaggggcctaatgtctggctgtctccagtctccttctaacagaccggcatcatcgtgtcgtgttaagttcgcttattaattctctaccaaaggcatctgcatttagtgtccaggaatcactcgatgtttcgtttctttttatgttttctttgcctccgaaatatcttccacagattccctaaggacgtgaggaatggaggaagttgtgaaggaggagaactgtaagctgaatagaatacagtcatccctcggtatctgtggggtattggttccaggacccctgtatataccaaaatccagggaggcgcaagtctctgatataaaatagtgtcctatttgcatataaactatgcacatcttcctgtaaactttaaatcgtagattacttggaatacctaatacattgtaaatactatgtaaataattgttatattgtttttaaaattgtttttattgtattgtttttattttttaaaaatattttttttctttctttttttgacacagggtcttgctaagctcactgcagccccttcctcccgggctcaggtgatcctcccacctcagcctcccaagtagctgggactacaggcgtgagctaccacgcccagctaatttttgtattttttgtagagactgggtttcacaatgttgtccagactggtctcgaactcctggcctcaatcagtcctctcgccttggcctcccaaagtgccgggattagaggcgtgagccaccacacctggccttaaaaatattttcaatccgtagatgcagaacttgtggatacagagggctggctgttcatattttcaaagactatatatcaacaacatataatcaatatataacatatatgagatatatggataatatatatatatatattcagtaacgatatacatgtattcaaagtagtaggtttgttatagacagcatagagaagactctggctttttaaatccagtttcacaatctcggcctcttatttattttgctttgatttttattttatttttgaactttttaggttcaggggtacatgtgcaggtttgttacacaggtaaactcgtgtcatggggggtttgttgtacagattattttgtcacccccagtattcagcctggtacccaatagttatcgtctctgttcctctccttcctcgcactcttcacccggcagtagcccacagtgtctgctgttcgtgtctcagccttttcgctggagtggttataccatttaccacttgctctttgttttctctttgtaccacttactctgtgtttcctttttcctcggttcctgtgtgcttttgcataaattgcggcttttttgtgactatacttcacagtaagcttattagcaataactcattgctttattttttagggtgttgctctagtgttgacaattttcatgtttaaccttatcacaatctatgtttgaaagatattttacttcacatataagagccttacaacaacaatgtgctttcattctccttccattcttagtgctttgtgctacatttgccgtatgttttacttttatacatgttacaaacaccataatacgttgttattaattttgtactaagaagtcaattatatggaaaaggattcttttaaagagaagaaaatatttttatgtttatatttactatttctgccacttatcatttctttgtgggaatccacattttccatccgaagtttttcttccccttcatggactcccttcagtctgtcttgtaatgcaggtctacaagaagtgaattctctctgcttttgtttctttggtaaagtctttattttgccatcattctttgaaagatatttcatctgagtgtagagttttgcattgatacatcctctcagttctttaaagatttcattgtcttctgccttgcatagcttttgacaagaaatttgcagtttttactatcatttttcccctggatataacttttgggttgttttctggctgcttttaagagtttgtcactgattttcaagaaattgattgtgtcttgttggggttttctatgctgtttatcctgcttggagtttgtttagggttttgaatctgttttactttccttaactgagagttttacaacttgatttgatcttggaatccttaaaatgcgtttttggtttttgtggtttttttgagacagtctggctctgtcacccaggctggagtgcagtggccgcgatcttagcttaccgcaacctccgcctcccgagttcaagcgattctcgtgcctcagcctcctgagtagctgggactgcgggcgcatgccacaacacccagctaacttttttgtatttttagtagagatgggatttcgctatgttcgccaggctggtctcggactcctggcctcaagtaatctctccacctcggcctcccaaagtgctgggattacaggtgtgagccactgcgcccagccaaaatgtgttttaagtaacatattttatcatctcagtactagtgttttattaatgaacactaaaaccagttagagaaacactgatgaaaaccagtgtttattatttttacatatttttataactccatattggctccttggaccttttagagttgggttacgagaaagcaattgggcatttgcctggtattatgtagagggtatgcaaacacggttagcttgtggaaaagatatcagtaacaattgcctgtgtaaccgccagctttatgggagtgctccagtagtaacatttttgcttgtttcagctataaaagctattaccacaatctgtctctctcattttgtacagtaatgatccatgaacatactaaagggaaattgatggcatacccagggttaccatttacagatggcagtactgaaatgttaatttcaaaaacattcaaactgtagttttcttctgtagacatgggacaagcaatttttatcatttaatcatgcagacttggttttaaaagaaaactcttttaagatgttctttgcttttaatttatagccttctagtttgcttataacatatatgcttatttttaaagaacattaaaggttaggcctaaggaatttgtgtgcaaaattggtcattgattattaagaaaataatatagaacctttttttatgtcataaatacaactttaaaaggaaggggactcttcagagttgcctctgaggagcacatatgaaaaagaagggcagaggtttactgcagtggtaaaaaataatccacctagatcaagactattccaaaagtgaatttaaaaagaaaaaaagatgagatggtaagatatgaggaaataatgaatgcattgtgactttccacctccccatacccattttcatagtttggtgagtagaaagagaaatgaggatgctggcccaattttgattcccagtggatgaggctcacacagaactgccctgcttcttgacactattatgatattaaaagtaacttgtatttttataagttattaccatcttggcacacttgcattcattttagtcaagtactgtcacctttagatttcaagcttgcagagtcttaaaaaaatacacattggagaacacatagtcttttaacagtaaaatctcagcttattagaatgtttagtgactgaggtattcagagtcagtcagaaaagtatctttaggatttcagcatgtggagatgtctttcatagagaaaccggggagagtcaggcaaaccctagcacgttgagcatggcgtatcctcatctgcacgggcacttagacacctggacaagtccattagcagtaaggcaggatagaggggttcacaggatacgtgctgcccaggatacgtacgtgcagcccagagctgggaggaaatcatgaggaccgactagacatttattgtacagatgcatgactggctggtatggcctgggatatgtcagtgaagatacaccgtgaggttgtgggaggtaggattcacagtaaatcctaaattcttcatctttgcactcacgacgcacaatagctgatcaaagcttttagcaaactgcagcaaatgaaaaggcggcagaacctcatggtgacaaatgcaaaccctggagtcggactgcaagcattcacaccccagctccaccagtccccagccctaggacctagacatggagctgcatgtcagtgtgtccgttccctctgtgtgagaacgggatagtaacagcgctccctcacacgctcctgtacacatggaaaccaccactgccgtcggacacagtgtatgctgtagaagcacttatggtactaagcacattaaatatttaaaattattaattagattatttaatccaagctcaaagctctcagaacagagccaggcatgtaacaggtacaatatacatgttagctattattattattatttaatagagatggggtcttgctatgttgcccagactggtcctgaactcctggcctcaagtgatcttcccacctcggcctcccaaagtgctgcaattacaggcatgagccactgcgcccagcctattattttttaataactttatgtaacccggtgttgccaattgttttgaagtgtggagccgtttttcagatgacacatactaaacatctactaaacagcctgagaaacggcactctgaagagcatgccttggcaaacactcccctacttactctaaaactccagtcgattggcttccaagttcacttggttctcatttttcctggcaacaactctgcaaattattacccccatttgatgaggtgctggctgagaaggccccttgcccaggtatgtttccgacctgcctgtgacaaagtgttagattctgaaagccgggagtgctggcctcggttagctgagtgataccagcgtggggtctttcgaggctgcaggcaagatgtccgcccacctaaaggcaggatgggggctggaggggccgtgtcccggcgcctccttcctgtggctgctgagttggtatggctgtaggcagggggcctcagtcagtgttgtaccgtgctggcctcgccacgagcacccgaaggaattttatcatacaaatttgattctgttttatcaagagatgccagtagcacctccacttccagttgggacaccccaaaatatctccagacattgcctaatatcccctgggagatggcggggggtgtggggagggggcggcagcgggcactgtctcccctgctccagaacactgtattgaaatacagaaacgtgatgccaatcccatgcttttatttgggattaaatgtgtaatccatatgcttctgagtgggaaaaaaaaaaacttggctccaagcagaaaatggtgcatcctttgttgtcattgggcaaatgcttggtagggatttgatctgtgtagaggaatgctcagtctgcagtggcagccaggtagtgagcatgtgcggccctgcacacagcatgagcttgtcagacagacagtgcttgccaagcagggctctggcatgcgcttgttgttggctatggctcttccatgggcaggctcccggctcctccttgtgcatccatcccctttgttggccaccctgcctgctggccttaggccttctgctcctttccccaggtcctggctctctccagcttggcctccctccgcccatcctgtgcacctttcattcctgggtaggaggagactcaggtaaagaaggataaaggcagaacgatgccaggcaattccactgctagccattgccccaaggacatgaatgttcatagcagcatggttgacccaagccaggttcctgtcagctgctgcctggaaaaacacaacgtggttcagccacgcagtagcatagtattcagccataaaaggagtgaagccctggaacgtgctacaacatggatgctctgggaaaacatgctcagtgaaagaagccagatgcaagaggtcacatattgtatgatctcatttagtgccccaaatagggaaattcatagagccagaaagcattctgtggtcaccaggcctgggggaggagggaatgggagtgactgcttagtgggcaccagaactcctttccaagtgattgaaaatggtttggaacttgacataggtggtggttgcataacatctgaacgtaccactaaattgtacactttaatttggccaggctcagtggctcacacctgtaatcccagcactttggaaggctgaggcaggagcatcacttgaagccaggagttcaagaccagcctgggcaacatatcaagacctccatctctatatttaaaaaaaataagaatttttttaaaagaaaaataataaaatggttaattttatgttgttacttttattccaactgaaaacaaagcaaaacaacaacaacaacaacaacaacaacaacaacaacaacaaccatgtatggtccaggggaatgtctatgttgggcctgaggtgtgctgttctggtttttcttaggtgaatgggttctgaaggctgcatcaaaagaggagtctttaaagttgctaattctttcctgataggaaaagaatataatttctcaaaatgactgctttcgaggaatgcccctttctgaatttgaaaacatagtattaaaaagaagagtctctcagtgctttagattattatttcttgtattcgatgtaaaaatcccttacagtggttttacaagtctgcagaggaattcacaaagcacgattgaaaagtgatgtacaggatttatagttgaatgggaacaaaccagctgatctgcatataggatgaaatttagctgagggtgctattgagtttggacaacatttggctggacctttgtaactcttcagctctatgaaacaatagttgtgtgaagaattaaaaggtggaaaatgaactgtaggtggctggctcacatatgcctaggtctatttccagacacagcgaacagtgaaatgacagtgtcggtgaggcaccagttcaaggaaatacacaaagactgcctactcataaatacagacacaatggggtgataactggtgcttgcacttggagatctagaattctaaaacatcggaaaacaatagcagaccattctgtgtccttttctttaaaactatctcttgaaattttcgtgcttcccccaagaacatcctcaaagatgccagtaaaaataactccacaggaatctttctgaattccaatatccatgtgaaaaggctgcattttattctgatttttcacaatagaattaaggcagacatgatgaagaaatgaatgtgtagaggacttccgaaatctgtattaacgtgtgtgatcagcaactgtaatgttttgattgattatatatggtacatctttcattcattaagctaactttaatcaagtatgtgttatgtgtcaagcctggactgtagaaatgaacttgaagaagaaaggactcttcctcctgttcgggtagaaaaggtataatgcgtgttatggatggtgtgaccgaaggaaacaccggataccatgaggaaaattgagatcatcacccagggattctgtattctacttagggaataggctaaacatcaaaatacagcaatttgagacaaaggcaggcggtagtcccagaagggtaggtgtcaaatccccaagagcatcggcggatccaggttcctgttgtgttactatcctgccttcctaagggtcagacaggctctcaagcaacccccatgaccacaagttgtgcacatcctttcccagctcctctcacctaccattggcaagaactcagtagtggaacacctggggtctcttaatgaggtgtgcttgtgtgactaaaagaaaaagaaattttgggggaggagcaggctggtggatgtgcagtttctaaattatcttgtattttatttgattacagtgtttgaattcagtgttttgaagagatgtatgtagcactgcaagctctattctaacctactttctttggagaagcaggtacatgctgtgttgtgtcagcttagagagccccttcaaaacctctccatgttcaatgtggagggactgtcactatacatgcatggcacaccacaccaagaacagagggctaccagaaaattagaatcccttttatatttgtcacatatcagcatttatttagctgtaaaaataaacagcatatggcatttgttaaaatcgtttgtatttcacacaaatatttggcaatatgtaaactttcttgccagggctgtttattgtggttctatttgcatactaataatggggaaatcagtaatgaccaggtgttggaaggtctgatttctcatttaaatgtattgtttctagcaataaactaattatttttgacatgtttcataaccagaagaatgttattaaccaaagtcataattcctatttttgtgttgatcacacacagatgataagttaattatacttattgaatttaacaacatatataagagataatctcaaatttcaagactctcatttgtgggttaccatctgttttggaccaaagaataggaatttgattgcaagctttcttctgaacagcttgtaataagagctgtttgtatattaattacttattgaattattgtggattttaatgttttaatttacaagcaatttggaacttattgtggtgacagctgctcatattttgatactttatggtatttagcaatttcatcataaggctattttttcccctggtaatttataacccaatcctgaaaacagtaatttggtctctccagctcactataaggagtattgtcctgtttcatccccactgcagatttttttcatagttaaaagtatattttataagcaaaatcaagattcctttgtgcctgcttccctggtgccctttcatttctattcagagttacagatgaatttagtttcactctcattattttacttcagtggtagattttttacaaattgccctggttattactttcatcttgaatatccttatggtttttgttttcaatgtactgtaatgcactttaggggcctgtgaacctgcttgtaggtttttttttaatctccttcctttaaacaacataactataaacatgactcagtgggaataatttgcttgaatttccttaaaacacttgagtttctatataaactccctaataagaaacaccttcactcatagcttcacttgtggacttcaattatattaaacctggtacctttttattatcactgaagactattaaataagaatttagagaaaatggtggacatttaatttccttagttcttgaattcgtagatgatagaggataattgatactctctaggaggcaggaatcattcacaaccaaagaaattttataaggtaaatatcattaggtaaatggtttactgattagtgtttatagtgactgagaaataaaaacaatttttgatataaaggattatcattttatgagccataaacctggcttcctcataaatcagtgcaaatggaacacttgtgaaacagaaatgtctgaagagtaaatgaaaagttgagacgttagtgggtgcctttggttttcttgattttagaggagccggaggagaaaggattctgacccgtttgtgtgtttttatgagcacagtacatgaggatgcatatatgcacacaaatgtgcctggtagagttattggaaagctagcccaagcgatggggaatgtttagctaaagcgtgttgtcttctcccgagggtgtgcacaggttcatgtatcagctgaataaggccctgttccaaaaactgatatttcaagggaaccttaatttatctttaaatttaatgtaatttaaaattaatttaaatctttaaattatctttaaataatagcagtagcaatagctgagctaacattaattttatctattttgagactcttttatttcagaacttctacatgcataatgcctgaccggccacttttaatttctcctttctttcactttgcaaacaaaaccttacaatctgtgctatggactaagacagaaattaagaaccaataaaatgtgttaagttttaattaggaagaagaaaaaacctaaaggaacgggatggttgagaggtaaacacaccccaatgatttttaagtcttttgtttcaaacctttccctttctccctaggctggtccctgcagacggcttcccatttttatgaccggatgctgggaagcctgctggtccacaggtccatacatgaagtcaccataaggtaagcagcccagcatgccattggatccttgcccttgtacctgaaatccgtttgaggagcagaactgcattttcccaaaatggaaccccttctgttttaaatgatgttgtcaggggaagtgcccggtctttctccttactgaaggttgaaggtagtagacagacaatcattaaatcattgcgagctgcatagtcaattccaaatgagaaatttgcctttttactgacttctgagaattttgggttgtgtttttgttttgttttgttttgtttttgtttgtttgttttgagacagagtctttgctctgtcacccaggctggagtgcagtggtgcaatctcggctcactgcaacccccgcctcccaggttcaagcgattctcctgcctcagcctctcaagtagctgggattacaggcacctgccaccacacctggctaatttttaaaatagtttcagtagagacagggtttcaccatgttgtccaggctggtctcgaactgagctcaagtgatccgcccaccttggcttcccaaagtgctgggattacaagtgtgagccattgcatctggcctgccttctgagaattttggatcctgaaggagctataacaaatttttctgggtcttaccaggcgaggatgacaccttctaaaatcaacctctcttgtcaacattatcaattacaattatgcagacaagttaattataattgggtgcatgagtatagattttatttggctcctatatcttaattctatgctttatcagtttcttaatatgatttgtgtctgtctccaaattgatttgctagttaactttgaaacttattagaaaatcatggagattactatgtgtaaatctggtgagatgctaaggtttcctgactagcacaccaaacaattgtatgtgcacaggtgtcaagagttgagaagcccgtagcccaaactaaaactgagacccatgccccaaaagttctgtaaaagttatcttactacctttcggtacgtgtgattttaatttcactttacttaattgttatttaattttctgtttctttctctaatgcctttttagttaaaaaaacaaacaaacaaacctgtagaacttgggcagttttaaagtgtaaagatagaattttgaggaagctttttgatttactattttaagagaaccaactagaactaaaatgatagacttaaatttaattaaaataagcagcttactgtttgaggtacttttgtttaaagccagacatatgcatatgtaggttgttttaacaagttaaatatgtataagtattttaatgaaaggtgtagtctgtttataaaaacaaaatttgtaatgtattagtgaatttgaattttctgactggctttttcactcagtataatgttttcaaggttcgtgtgcattgtggcatgtgtcatttctttttatgtcagaatattccattgtgtggctagaccatggatagaacatatttgattcatgcatcagttgatggaaattggagttgtatttcccttttggttattattaaaaatgatgtcatgaacacacatatacaagtttttttgtgtggacatatgtttcatttctctgtggcatttacttaggagtgggtcatatggtacctctgttgaacattttgaggaactgaatttttccaaagtggctgttacaccagtcaatatttttcgaaatgccattgaaccatattttaaatgtcagagggaagcagggaggggatctttctcttatcaatgttttgagtgggtattagttcagtactttgggaacataagcttcaatttcattgaatccagcacacattggatttctcctctgcgtgaggtatctgtgtttggctttatacctcagtcatttatacatgactgagtgtttttgtagcctttgataacttgtatggtttatacatgcagatagtcatttggcattatcctcaaaaatggtactctattgctgtagttcattagtaaggttgggaataacctacataacatactctttctgcctatgctgcgtgctgcgtctcagaaagtgagggcttctaacggtttccttgaggtgtgtgtggtttcaacacatgtcctcctttcaaaggcatccatcgcagaccctggtgatagtgttttttgtatctcagtcttaaaggggttggtatggttatgaggaatgttcacattcaggggcgttcactgttgaagttctcaggcaggaagattccaagccgagaagggactaggcagtccgttctcggatgtagaggtgggaaaatctgtggtagagcaggaaggactgagagcaggctcagcaagcatgttctgtgatgggcccgatagttaggggcttaggcttcgcgggccaggcggtctgtgcggcagctgctgtactctgccattgcagtgtgaaagcagtgtaggccctacagaaatgtatgaacatggctgagtgccaagaaaaccctatttatagacactgatactgggttgcagtttgctgaccctaacctagaggaacacaactgttttctttccaccttttctaattgtggccttttgagttggaggccacctggaggtgaggctccgagaggcccacccaagggccatgatgtgatgaagacagactctaaattgtgattacgtagcgaaggcactgcagatatttgggggtcaggacttttacgtaaggaatttgagggcctttctgccacataagagggagtggctctgggcctgtgtaactgccctaacttgggttctcaccctgggggagtctccacccccaagataacctgggaatgtgtggagacatgtctggttgtcaccactgggggagtgggtgctactggcatctagtgggtagaggcccgggatgctgtcaaatgtcccgcagttcacaggacatcctccccaacccctaaatgtcaaacgtgaggagattgaggagtcctgctcaccgctgcttctgtcagccctttattttgtacttgttgtcagtcatatggctgtggaattataggctatggggcattaaattacaaaatttagtacctgtgtttgctgacataagtgtaaggatggttggactctgatctaatatttgggttcatgatgcttttagttttttccttttttaaaaacgtctttgtcattcatttaaatataagcctccaaaattgatataggccaggcacggtggctcacactttgtactccctgcactttagaaggccaaagcaggaggatcacttgaggccggaagtttgagaccatcctgggcaacatagtgacacccccatctttacaaaaaaagtaaaaacataataattagccagaggtggtaacacatacctgtagtcccaactgctcaagaggttgaggcaggagaatcacttgggcctgggaggttgagccttcagcaggctatgattgcaccactgcactccagcctgggcaacacagtgagaccctgtcactaaaacaaaacaaaatgctgatataacactaagatttatatgagatccaggccacattgggggatggggcaccgcctgcctttcgaactgtagggtacgcttcagagtttatttttcacaacttcacaggccacatcatatgtgtaggtgaacccactgctgactccatctactgccagaaagagactcatcatggtcaaattaaattcttcatatgtcagtgaaaaatcagtgtcttagagatatcatgaccagagtgcatgtattcctgaaatttgtttgaaggcccggtgcacattgtgtagaaactgtgttcagtctatctaaaagataattaaaatccataaattaatttctggctggaaaataggtcataatggatctggatatcagaagtgctaggttaaagaccacggtcatcaggaaaataggatgagctcctgctccgtggaagcagtagcatcagtgccttccaaggcagtctgctctgaaatcttgggcacgtgcatctgtgttgaactgtggccagaggaggagaggatgaaagggaggcagtgctctttttcttacatgcattgtccggctcatgtgatgtgggtttccctggtagtggcttgctcttgctaggtggagcattttcaagagggcttccttcctgtcaccatagcatctgccgttgacgtgcatgtgggctttggatgaaagccccagccagccactaattaacccagaagggtggcagggcacagaaaggaccttttctgaatgcctcatcatggggattttttcttttcttttctttttttttttttttagatggaggctcgctctgtcatcctggctgcagtgcagtggcacaatcttgggtcgctgcaacctccatttcccaggttcaagtgattctcctgcttcagcctcctgagtagctgggattacaggcgtgcgccacaacgcccagttaatttttttgtatttttagtagacatggggttttgctatgttggccagtctggtctcaaactcctggcctcaagtaatcagcccgcctcagcctcccaaagtgctgggattaacaggcgtgagccaccatgtcccgtcagggatgattttattctgtgaaaagcggcattccttttctaacacaaaacctctcctctgctctgccctcccaaccctgtagcctcatttcctatatagttgttttcatactgattatctctgaagacattgccaggtcgtttttgtttgttttgagacaaggtcttgctctgttacccaggctggagtacagtggcacgatgtcggctcactgcagcctccacctcccagggtcaagcgattgtcgtgcctcagactcccaaatagctgggaatacaggggcatgcctccacacctagctaatttttgtattttttgtagagatgggtttcactgtgttgcccaggctggtctcaaactcctggactcaagtgagcgaccacgcccagccgacattcccaggttttctttacgttttaataaatatgagtagtccatgttcagagtagaaactatacaacgtgtagaaagatacacatgcaattgggagccgtgcttttcccacacagtcccctgtcatggacattgcccctgcctgaaatgctgttttcctggccgcatcttatgccactagtttattccatatttaaatggaggcgtcactgctcggcattggaactctagtaacgaagaaataattctttgattatatttaccatttcagaccattgactccaagtaaataaatataaccgtaaaactaatgggaaattttttactttgcggggaatattttcgtactgaaagtattgtatatctgattgtgggtaaatggagagaagtgtatgaaagaaagcaagcaacataaaatatttttatgcatttctccccaaacttttcctctgtatgtgttttcctacaggtttgggtcaaactgtaaccttgttggccctcttttctgttttgttgtcgccccctgccacccaatttgggacatatcataaatatctttccattaacctagctttgaaatttttaacttgcactggaagaccacagcgtttaatgtcaaacaacgtaactttaaatcctagcttcgctgggatttaagttggttatcttccctaagcctttatttgttaaacctataaaatggtaataagagtaatggtcatatttatctcttggagttatgactggtgagatcgatcgtatcgtgcacatagcactcacacctgatagctagcatacaatccatgccgtgtattggtttctaaaatcatcttcatggcggcctgatagttcccatatgtgttcactgcaatttatttcatcgtgctgtcactggacaatgagattgtttcgagaaccacacattgtcttctttacaattacataggatgaaaagatgtgcaaagtggtaaaacaagcctgtgtcagcccccaaataagctgctccccaggcagatgttagaaaaggtgtattgggatttatatgtaaactttatacatacatttaaaattctgtcttaagctggttactgattgtgaaatgaaaataaactcagtttacatctgagcagagaaaagagccgctgcctccaaatgggcagagtttgctcgtttccatgaagcaacttggagaaagaggtgccctttagaggctgaggtcagttcaagcagatcttccagtgaccctggctcggtccagtctgcatggagacaagccccaaagacctgagccttgtccaggccatccctccaagcaatggattcttccagcacagacgccaacagcctgactaatagcagcctaactaatgacactcactttctcaggtgccttcagaaaccaagggctgctttagaagatctttaagatgtttacataacagggcaaatggctgaaagataaagcttcccctccagtgatgtcagaggagctctgtgcgctgcccttcctacaatacacgcccccttcatcagctcgtgcttccttcgctgtttcagaacacggctggcctcttggcaagaaacgaacttgccctttctgtccttaactaccagcaccagctctccagcaggccccatgtgattctactttttaagataattaaaacagcaattaagattttgtttggggccagtgttctcccacagaatgatggcatattgagtgctctaactacatactcaatgaaatgaaactcttaaacagccatttctcctgggaccgaatgctgaactgttttgtgaagggaactgcgaattaataggacttttggccaccttgaaaccaaggcttaaaaaaaaatactataaataatctccccttcagcttcttgacggctctaaaccccaaattatcacttatattgaattacttatctttagcagagaaacttcaaaaatgccatcagcccatgctcgtttgttcttctttgccttctttaagcagcacagtgagagaatgttgtggctttaacccaaagtggaaggtggttatttcgtttttgcgcaatcacaactccaaacacctcaaatcaacctaattgaaggtgtctttaatcaaagctgggtcaggcaagaaaataaacacagttgctctaattaagactcccctctcatccccctcctgtttggggccaaggaggagctgtgagtgctgccaaaactctcctttattttagaactggagaaattggaaaacatccacaggagttctcagaactcgaaggctggaagcggatgctgttcgggaaaccggttaggtgttagaatgcggcttgtgtctccagctgtacatactagaaaagaatgcccaaacacaggcctctggtggtagttctttttggttgggctttatgtgtgccaccttgcctgcttgacattgctgatgagccaggacgaggagtcgagccctgagtggtcatgggcgaggcaggtgtgtgtttccctgatcctctcctactgacctttcaggtctctcttggggaattgctggaggagctaaaataccagctcccacatactggatattttctgtgcatcgggctctgcataaaagcattgactcctcacactctcccctttacataggggctatttgatactcagtttagagataaggaaacagccatataactgaccctccaatcccagggctagatagtggtgcagctgcccctagaagtcagggtctctggcgcttggccaaaggctccctgaatcccacatctttacctgttctctgtggctctcaggacgtgagctaccttatctctagccaataagcctatacggatggggactctcaccctgatttaccctaactttattgtaataaagtcataactgtcataagaagtaatagttgcaataaaaagtagtaattgtaataaagcatgaacattccaaactccatgttatttgtccacaaaaatagttcttggcacagaagacaaaggcggactttttcccacagaatacatagctgtcgatggcactttgctttgaaccttggtgtagagggcagtcctcatgccctgggctgaggggtgcatgtgacacatcattaaaagtcaaaaatcattttcatagagcaggtcctccccacatgtacacccagagctcctgtgcttctctcctctttctctgacttcttccaaaatcgtgggtcttgtctccatcagtcaagaatttaacttttcttccaaaacatccccctcctcttctgtgaaggaaggtgcttgtggactggccttaggaaatgtcgcccagacaggaacggcacaccagtgtgccatcactcaagccagaaatgaggtttgcagtgaccttctctgtgcttgagagttctgctacactacgaataccactataataacagcacatttatttgtgggaaattaaacagcaaagccctgggtgggagatccataatttaccatcttcctgtgaaatttagttctggtcttagaaaaaagaggaggaggaggaatttttattcccagccttgtgtgtggtgaggtttgtctggaacagtggttcttgcagaggaatactggccaggagactcacttgagtcaaaaaactgaagaagatccatgaaaacaaccaccaccttcaagtgagccacttagagataagcgcagctaaacgccgggacacccagctgatggatggtttctcttgattttggtgtgatgaagcccacagagctgaagggcattaaatacagctgttagggttaggagtccattcagagaatattctcatgcttgtatctaataatctaagaatatatatgtagattctacaatttttggaattaggttttaaaagaaaaataatcatttaaaagctagcaaagtaagtgtttgttgggggagaaaagtttgatccaaatattaaatcagtcttaaaaaattaaaatatgtacttgagatggagcagtcagtcttaccaaacattacatcctggctcgattgcaggccatggatagtttttgttttgttttctcttctgcttagaaatcaaaaccctttagaaagttaacaatgtattggggaaagcattccaatccttggaccctaacttatacatttaaaaacaatgaatctgtgatcagaaagcagaaagccagagctgaagcagaagtttttctagttggaagaaagaaagatgtataatgcaaattagaggaacagataattaaaaatggcccgtaatccccatctcctcaggatcttatattctcattctccatagttctatataaacacatgcagagacacctgtatttatcacagatgctcctggggtggggaatattaaccaggctgtgtatacaggtgtttcatctccacgaatcagagtatctgctcttattttgaggcaagatctcactctgtcacccaagatctcactccactcactggagtgcagtggcataatcatggctcactgcagcctcagcctcctgggctcaagcaaacctcttgccttagcctcctgagtagctaagaccacaggcatgtgctaccatactttgctaatttttaaaatttttttgtagagagggcatctccctatgttgccaaggctggcctctaactcctaagctgaagcaatcctcccatctcagcctcttagagtgctgggattacaggcatgagccattgcgcccagctggtaccttttcagtggtcaggtcaccaagcagcgtctgagcctgcaccagttgccttactttataaatggagttcatttcaaacacaaaatgcttattttccctctaaagagcaatggttctcggccagctgcagttttgcaatgtgggacatttggcaatgtgtgcaggcatttttggttgtcaccactgcaaggaggttgggggagtccaaggatgctgcagaacatcgtgctgtgcctggaacaggcttgcttttttttttcccccagagtaaaagaggaaaggagctaggcatggcaaacaagaagggcagctgggaagctggggtgtttgccaggtcctgccagacatagtttcctctctgtgcctcagtttcctcatctgtaacatgcagagatgagatgccctccaagattggtcctttccagctgccctcactgggagggggcaccgtgccctgcctcccaggctgactcgtcctttgtaattctcttcctttccacgggactccagattcatgccggtcccactagccctgttgccctgttcctaagcctgtccagaaatccttgggactaagtgaggctgaagctatagcgctctgctcttcctacctttttaagaggtcttacattgtaaaacttcaatttttcaaacactcactggctcacagaagaaaataaaataaaaagctgcaattgtgaaaatgtaattgctcaactttagctcatgctccagatcagtgattttctcttttagccaaacttctttataattatttcctttatttttataatagattcttcaaaattaatttcaaaattccttatctaccgtctttcacaaatgtatgtatagcctagagaattttggtaataattttgtgatacatttatattgggatttgtagctgccagcctttttttttttttttttttttttttttttttttttgagaaagggtctcacttccgttgcccaggctggagtgcagtggtgatcgcggctcactgcagcctcgacttcccaggctcagatgattctcccacctcagtctcctgagtagctgggactacaggcgtgcaccaccacactcagctagttttttcgtttgtttgttttgttttgtttttgtagagacagagttttgctgtgttgcccaggcaggtctcaaactcctgggctcaagcgatccgcctgcctcggcctcccaaattgctgggatgataggtgtgtgccactgtgcccggcccaagccattttttcagtccattctttttgctcctcctagtaacccttcgtagcaaccagccttccattgttcagtcaccagaagttaatgatagaaaaccagagatttctagctgtgcaagatgtagagagaaacctaaactctatacatttgctattggcactgtgttgccatagtcactgcagcactcagcatcaccaaaagcctgcccagtgctgcaacattctttagatagatttttgttgttttattttgtctccttaaataatatttaatttttcattaggtcatgctatgatttcatagcttattttgtctctaatattttcttctgcatgctgtcttttgagagacctctccagagttcaagcacaaatcctaggacagacttgtattttgactgtcaaattttcattgcagtatgtgcaaaagtacagaaatgtcatcaaattaagcaaagaagataagaatttttgaatggcagtgttctggcaactataaaataaagtctattaagagtgcaaagtgagaggtggaatgtcgccagggcagctgcattcattatctcttgctggataacagacgaccacacgtttagcagcttgaaacaacacacattcattctctcaccgtggctgcgggtcacgggtccaggcacagcacagctggggccagtgctcagcgtcccacaaggcttggtccgggtgtcagccaggctgcgctctcctttaagctcaggggttttcttccaagcacaggttgttggtagaattcagttcctgtggctgcaggactgagaccctcagctccctgcaggctgcctgccattgcctggacagatcatgcaatgtggtgttaataatcacaggagagaaatgtggtcaaccttgccatgtaatgtaacctaacctagggagtggtgccccatctccttgacgcattctggaagcaagtgacagatcttgcccatactcaagggtcgggagtataccagggcaggactttgtgggggtaaggtatgtccctggcagtaaccattactttgaatcctcccattaaatgtaaaatatcttccaacttgaacatatactttgtacttttctccccctaaacaaacaaaaactcaatcctcattcaacaatgaaagttttgctgcctgtaaagatacttgcaaatgtgtgatatagacaccaaagacagttcccaaacagcctaaagatgtttagtgctggccgggcgtggcggctcacgcctgaaatcccaccactttggaagtctgaggcaggtggatcgcttgagttcagaagctgaacaccagcctgggtaaaaccttgtctctacaaaaagaaccaaaaaattagctgggcgtgctgatgcccacctttggtcacagctacccgggaggctgaggtgagaggattgcttgagcccgggaggtggaggttgcagtaagcccagatcatgccactgctctccagcctgggcaacactgcaagactctgtctcaaaaaaaaaaaaaaaagaaagaaagaaaaaaagaggccaggtgtggtggctcacgcccgtaatcccagcactttgggaggctgaggcgggtgggtcacgaggtcaggagatcgagaccatcctggccaacatggtgaaaccccgtctctacaaaaaatacaaaaattagccgggcgtattggcgggcgcctgtagtcccagctactcgggaggctgaggcaggagaatcccttgaacccaggaggcggaggatgcagtgagctgagatcgcaccactgcactccggcctggcaacagagcgagactccgtctcaaaagaaaaaagatgtttagtgttggtgacatcattgacgttagttgcagcctttctggggctgcccagctgtttggagtgagcagctcttactgatgtatgaattctggtttgttcatggacaacagagttctttccttgcttgttccctttgggctggtttgctcttgtgtctaaccgggtggtgtctaagaaaaccagactctgtcttggctgtctcacacagaagcccctgaacgttttcctgcccatcctccctccccagatttctgcctgccttctgggcaccagaagtcttagccagacggatgcagcggattctgtggtgaaacacaaatgacagaggtgctccctgccttctgtgttctggttttccaccaggagccctggcctccttgcagaaacatcgaggtgacatgtagcatgaccgagctcgctggcgcctcttcatcgtgctgccaccgccctgcaggaagaggggccatgcagtcagtcttgcaccactttcaacgtttgcgagggagaggtactgcggttcctcatgtggccaggaccgtgtggtcactctttgggggtgttgacatggccgcgggtgtactcggtcacctctccatgtgtccagaaaagtgctcagtgttgaatccctccacgtctgcctgagtgcactttgggattccattcctgccgcttatggggcgcgctgcggatccctgcatgcacagagctttattgaacgcaaagtcagttgtttgttgtcgtgctctgttgcccctgcttctggcttcattcatgtggtttttgctcaattcttccccggccttaggaaataggccaactcttgtttttttggaaaacatttcacctgggcatatttttctatctataattacggaatttttatgtaatcacataattataaaatataacacaatcagatattaattaccttcatgtgtataatagcatggatattattttctttagtcatctcaaaaaaaaaaaagagaaaaatacaagcagtgtttcaaaactctcttctctttttgaacagagggtggttcccacttcatcaacacctcatcgccgcgaggtgaggctaagatgagcataaccagtgacgaggtgaactttctggtgtatcggtatctccaggagtcaggtaagaggcttggttttctgtcggtaggaaattcatctacagcatcttacaagcagaaggatcaacgcttaattcaaaaccaggctgtagaagaagaagaagaagagctaagaaggttcttagtgctgatggggagaagagaaggttctggagctgtgccatccccgggtggaaagagggaatgtgttctttcttcccttgacacttctgtgcagatgaatcaggcaggaatcaagagcggttgtggtgaatgtggaaaggacggaagcagtgcggggctcttggcctccacctcggcgagggcatgcatgagctggtgtgtgtgtttgaacctcttcgattttgctccagagatttattcagctccccagcctcccctactccccgccccctaaatgggctgctaggcaattttctaaaacttaggaatcgtcgtagcatcttccaacatttttgattaccactgagacattactttatggttagtaagtaaacagccaatcacatgtgttcgttgttgacaagacagactttgagctgagcagctgccctcctccgccagcagggaagtagtgggaagaagccacggagcccagggcttgggttctaacttagaagatatgtaatttaagacctacaaaatgatattggtgaaaaacgtcctgatacccacctacctgttcaacttaaacaaacctctcaggtgcattggaaaccccgcccatgtttgcctccccgccttcctcgatgatgatgaccctggtggacttgctgtttgttatctccacgtgtttattacacacagccgttttcctaagcgacatacggtgcaggtggattcgtttcctagggctgctataatgacgtaccgcaaactggggtggcttaaaaagaaatatgttgtctcctagttcctgaggacagaagtccaagatgaaggtgtaggcgggtcggttccttctgaggggaagtctctcctgtgcccctgcctggctcctggggccttgctgcagtctttgaactccttggctcgtaggcacatcaccctcatctctgtgttcagatttgtccacatttccccacggtaaagacagattggattcggaatttaccctcctccaagacaatctcattttaactattgtttttgaatacagcaataattacatctgcagtgaccctgtttctaaatagtgtcacattctgaggtgcgctgttggtgaacactgcaacctgtgaatttgtggaggagggggcacacttcaactcataacagtcggtttgggattttaagttgggttttaagcttcgtgcccttgatatcagattgtatatattctggaacttgattatttgaaaaggaaaccccagttcctaggccccgtcctcccagagatgcatgtattcgattggagggaaaaccagtctacgatcctctaggcttgagttctctcacagctggcctggtagggtagactgtacgcattggagccacacagaatggctcgagctctgatcctcgaacaagtctgagtgaggcctgttcatttgagcctgggtttccttgcccaggcaaatgtgctcaaatacgtcaggcacgtagcacattgtaagtgcgtgccttccccatccaagcctgggtctctgtcccttgcgctcccagctagtgttattcatggaaagtacacattcttttctgcatatatattagatgcctgtgattggctgttgccagaacatagtataggaagttggtatacaaaacaaaatatgtactgcctcactctggaaatcagggaaatgataaccgctctgctaatacctcaacctcggctcttagaggagcacaggtgatctcctgcctcagagcccatagctttccagaggtgcctgcaaatggaaatccatgtaccaaaccctgcttccctgtcgacttgtggcatggaatttgagattctttccatttagcaacacctctgcacaaggacacgatgaaggccaaagagactcacagctcttgtgtaaacaagtcccaggctggaactgtccggtgtgaaggaccacgtgctccggtaacctggagacagagccatgctgctggctggtccccagggggccacggagcatgagctttgctggcttcttgaaataaacacagaaacccccatccctccccagaaaggtcggcttccttattcagtgtttgtttatgaagcttctgtaaccaggcagctgagagggagagttggagcacaacaatgcatagaccttggcaaatgtcaactttgtgtaacatctgtgagctccattcctgattcatcagtgtcactgaagtataataacacttcttaggcagagttgatattgaagagagagactattacaccttcttcagctcactgtgtgtattgtggaactttttagagcaccctacaaggttgtattcaaaggaagaagggagcaaagaaatacttaatgttgaaatgttcattctggggttattttctatgttcgtctcaagtcctaaagttttggttaggtcaatagtcattgagcccccatcaagaaagcacaccttctcagcctatcgctgtctcccttctaccttaaataaaaaggaaaacatttccctgatcatgcttcctcctcaagcacctgtactcttactcctgcaccccaccaaactcattaaaaacaggttctgcatctcagaagatgattcattcctcagctccctccactctggctttctccactagaagttgtcagtaaattctgggttcccagatccactgatcttactgcaactggcattcctccttccctggtcatccctccttacctgtgtgtggcaggaagcgggtgggggtgggcagtgaggcagggagtaggtgtttccctgcagtgcggcaggacagctgcttccctggaaggtctgctggaacactcaaccccaccttccaggtacagtgacggacaagttttccagagtcaccaagcatgtggcctgagccctgcttctctgccctggacccagcagaccaggttgccgctcctgtccatccattcatctccttcaccagtgcctctcttcctcccctctgccagtatccatggtgtcagttaggatgtattaggctgcaaggaggaatcttcagtggagcactgatggcctcagacagccgggaagcagggtgttgaagaaggatccaagacacatctcttcaaactcggaaaagaacctcaaaaacagatgtgttttgttctctgcccacaacaggcagaagtcaggtcatctggcttttagcaaaccacatatatttccctacctgtgtggattagtggattttcattgttgcccttgttacttgtccaaagcaagggctttgcccatcagaagcactcaatagctgttacccacaggcgacatctcatagcagcagactcatggcagtctgaaagaggaaactggttaaagcaagaatgttaagtagtagggaacttttgcattaccaagctctagtgccaaaatggatttgttggtttttgcatgagttcagcagtctggctttgacgagtgatatggtttggccatatctcatcttgaattgtagctcccgtaattcccacatgtcatggggagggacccagtgggaagtaaatgaatcatgggagcaggttttcccgtgctgttctcgtgaaaagtgaataggtctcacgagacctgatggttgtataaaggggagttcccttgcacaccttctctttcctgcagccatgtaagatgtgactttgttcctcattcaccttctgccatgattgtgaggcctccccagccatgtggaactgtgagtccattaaacctctttcctttgtaaattacccagtctcaggtatgtctgtattagcagcatgataatggactaatacagtgtgtgagtccattggcctctgtcttacgggatccattgcctggtcacttgtgctatctgggcagtttttaagaatcacatggtggccatgtgcctttcccgtgagctcgtgttaccatcccaggaggagagaagcaagggagcgagcccctagaaatgtgcacagcctgcacctgctgtagtgagcagctcccccaaatgctgggggagtcgtgagttgtgtgcccccgcatatttctgaatacagccagggaagtggaagtccattttccacttagtatggaaagagagaaaatttggcaagtgagtccctgtaaacatattatttcctctgggacttcatcccaaaatccaaactataaagaaaacatgttctcccagacccacatttttggcataaattaaataattcacaggaacttgcaaaacggtatgaggaatacagggggacagaaccacagattcaaactgaatttaactgagaaagagctgcctgcaagataatcgggtgatacattcaggggaaagggaggtactatgaaaaattttgttttttgagactcactcatgctgagggtctcactctgttgcccaggctggagtgcagtggcacgatcacggctcactgcagcctctacctcccaagctcaattgatcgtcccacctcagtcgcccaagcagctgggactataggcttgtgccacaagaaattatgcccagctaatttcttattttctgttttattttatttgtagagacagggtctcactgtgttgcccaatctggtctcaaactcctgggttcaagagatcctcccccccggcctcataaagtgctggcattacaggcatgagccactgcgttacctggccaaaaatattttttaaagaagtagaagatactgtctgaagaggaaagaaggaaggaatgcgcggagctggcttgagcatagtcaacacacaggacagttctgtcaccctcaaaattgccttgtatccctttgtactcagctcctcttccacccccaccctgccccggcaaccaccactgctctgtccctagagttttgcccttgcaagaatggcatagagatggcatcacatattgtgtggtcctgagagtgtgacgtctttcactcaaccttatgcatttgagattcatgcatgctgttgtgtgcaccagccattcattcttgaatagctaagtggtgttccattttgaatgctgtttctgcgatttgtttatgcatcctcttgtggagggacatttgcgttctttccaggttttggtgattccaacataaagctacaaaaaagattttcatacaggtcatttgtatgaacgcaggttttcatttctcttgggtaaatatcttggagtggggttgctgggtcgtgtgacaagtgtaggtttcactttaccagaaaccagtgcattcttttccatctaaggcagaggcaggacacgtcgtaaacatgactggttttatagacgtgagttgagtcacagaactcctctgcctgtcgcacaaggcatactggaaagtatgtaaagggacgttagctctggcgtatatatctgcaggacgctcatgaagtgtgattcttcctttgaggatttgcagctagccttctggactaatttcatgaacctgtcagggtcacagtttccatgggccgacatgaatgtagcccaggtcggctgaatgacagagcgtccttgtttgcataccttcccctccttaagcagtgccgttggtctaaccttctgcttaaaaatagaaaactctatacagcctcatcagccctccggtggataagcccaggcatctgggcaaggcaaaggccaggcttccagatagcaggattccgcaggctgggccctgtggcggccacgaaagctctctgtgcatttgcccacatacccatggtatcaaagtcatcgaaaacccagcgaagtatttccctacctggagctttgtgactgacgtccacacaccaccaggaacaggcagacaagttaataaaaaccatgtgatgatggtggtggcgacagtactgaagaaaaagaaacacaagtagaaatggaatttcactaacgttgtgtccggcacagggatgttaccaagttccgtgtccatgacggcagtaattttaaacactgtagctactaaaaggagcttgtcaccataataaatggtaaaaatccacttctcacacacgctgaattcccagagtgaggaacttctggcttagctctaaagatttaaagaccctagaggatggttgaaatctccttattcagtggaacttatgttctgatttgccctgattcgtagctgagaggccaatttattatacatttttcttgcctccattaacgtcaccaaacatgggttattcagagtgagagtatcactagttatcaaaagtgagcatctacactctgggcactcttgttttcctaaagagcccatttctgcacacctgactagctgggtagaagtaggcatgcttcttttatttacataacgtatatatggctctgtgttatatgtcatccttgctcataaggaggatagttgctatggtcccaatgtttctgttcccccgaattcctatgttgaaatcctaacccccaaggggatggtatttgggggtggggcctttaggaggtgatgaagtcatgaggagagctcctttgccccttctaccatgtgggaacacggtgagaaggcaccatctatgaatcgggaagcgggttctcaccagacacccaatctgccacatgttgatcgtggactcccagcctccagaactgtgaaacacacatgttgtttataagccacctactctatgtattttggtagagcagcccgaacagagtaagataatagtgaagtagtacatccacatgcccagactttcagggttgtgaatataacttagtgacatttgtcattcatttcgtgaagcttccatgccaagaaaatcattaataagaaagatttctacccagtgtggaggcccacgcctataatcccagcactttgggaggttgaggtgggtggattgctttgagcccaggagttcaagaccaacctgggcaataaatacaaaaattagccgggtgtggtggttcatgcctgtagtcccaactactcaggaggctgaggcgggaggactgcctgagcctgggaggtcaaggctgcagtgagccataattgtgctattgcactccagagtgggtgacagagtgagaccctgtctgaaaaaaaaagaaagagtcttgctgggtgacacacttcacctgcagtgcttctctctggtggcgatgccattcaggtgagttagcctcagaggagtgcatggaagagtgagtgagacctcagcggcctcctctttccacaacaaacccaagcacagagataaaaggctgtgctgagcgcccaccaacacgcagcgaggttatactgtccaaaaagagtacctggcagatgacccagcaagttcacagcgggtaagctggcgtgggtctcggttagagtgaggtggagcggaggggaaggttccctgttcttcaacactttctacagaaacataagactgagggtgaagtgagatcccctctgaaaaagcaccaggtgtcttgtgggggcctgatgctgagggatgggttgtagctcatgccctgtagaagagaacactgttcaaagccaaccagtctggattcaagaggggtcctgggagcttcagtctgtccgtgaaagaagcacttccctgaggcttccctgtgttccaatgcccttcatatcctaggcctctgaacagggtgctgtcagtcgagtgggattcatcatcctcaagtttttgccggagtggaggccaggctgtgtgctgggctgatctcctcctgttgcatctgtgagctgctgttgtgaggacagtggcttgagagagctgaacagaaagacatgccccctccttccaagactgacctcacactttaggggagcagtacagtgtcctttagaacacctcagcggaagcaacccagatgtccattgacagaggaaattccatcaacagaacgtgtccatccatacagtggaatatcatgactcagctttgaaaaggaaggaaattctgacacaggctccagcacggatgacacttgaagacactatgccaagtgaaattagccagccacaaaaggcaaatactgtaggattccacttagaagggatacctcgaggagtctaatccaaaaagacaggcagtggaagggtggttgctgggggatggggagaagcaggggacgtggagttgctatttaatgggtacagtttccattttgcaaaatgaataacgttctggggatggttgatggtgatggttgcacagtagtgtgaatgcacctaatgccactgaactgtgcacttaaaaatggttaagatggaggccaaggtgggaggatcactggaggccaggagtttaagacaagcttggacaacgtagcaagaccctgtctcaataacaaaaaaaattttcaaaaattagccaggcatgggctcacacctgcagtcccagctattcagaaggctgaggtggggggatcacttgaggctgggaggtgaaggctgcagtgagttatgatcacaccattgcattccagcctggacaaaagagtgagaccctgtctcttaaaaattttttttaaaaatggttagcatgatatattttatgttatatatattttaccacgattttagggggaggtcatggtattataggtgagaagttccatgtgtagattgtttttcagagtttagaaaattagtctcaaagggaagagagaaccacctgtattcacagtaatattaatattactaatattacatgataagggctttttcatagtcccatataagtgtttggggcaaatccctggcacagctagtatcatttgtaagctacattggtgtctgacaaaatccagttatttaaaaaacagaaaacagtggcttatttataatagcaatattctggacatatggccagtgtccatcagtgggcgtagttgaagcaagctgtggcatgcctgtgccgtggagcaccactcagctgtgaaaaggaaggagttgtgggtaggcacagcaagctggaggaacccccagagaaatgtgccgagtagaacaggccacgtcagaagattgcagactgggccaggtgcggtggctcatgcctgtaatcccggcactttaggaagcctaggtgggcagatcacttgagatcaggagtttgagaccagcctggccaatatggtgaaaccccatctctactaaaaatacaaaaaaattagccaggcgtggtggcacatgccagtagtcccagctactctggaggctgaggcaggagaaacgctggaacccaggaggtggaggttgctgtgagccgaaattgcacagctgcactccagcctgggcgacagagcgagattctgtctcaaaaaaaaaaaaaaaaaaaaggaagaagattgcagactatatgattccatttataggacctgcttaaagtgctgaaaatatacaggtggacaccagatcagtggctgctacagatctggagtagggatgggagcacgtgcgtacaaaggaaggttataggagagttcttttgtgttgaatgaagagtttggtaccttgaccagagacacagttccacagatctacacgtaggatcaaactgcatagattatacgtacacaaccagtgaatgcagtgcagaaaggatgacgatagtttgtgttccagtgagcatttccgtcctgcctcctacttagtggtgttgatcctctttgacagtagtgtaagatgcctagatgggaggagacaggatgaaaggtgcacagcacttcactagttttgcagtttcccctgagtccatagtaattgcagaattatttaattgtaaaaaagactataccaaaaatgtaattcaatgtttctattgtctgcaaagctttgtgtgtgtgatagatggtggtccataatgcaaaggcagccaagacatttttattatatttcgcaggtcattagccatattgcaggcctagggctgggtgggggtactctcttgtgtaatggattcgagtggcagccctattaactgagaaatggatggccacacagacactgtggggccgttggaaacagaagaatcagctggaagcaaacagcatttgtcatacggacattgcttgaatgtttgcagactggggactgtcgtttctgggtgggctgcatttttactgggggaaaaagtcggtgcatggcttcttccctgctcatttaccagtgagtcttagaatgcttttacaatatccacttagaaccttcagtgtggaggattctgttagatttatgtgttcagcctgagagaagtgggcagatttgagggtcttaacttctgaagatgttgtgaatggccacaacatataatgcattaactcaacattttcagcccattcattgagatcagggtttcttggccttggcactattgacaatggcggctggattgttcttcatcttggggggactgtcctgaatactataggatgttcagcagcatccctaacatttgcccactctctattacaatggagagagagtgggaagacatttgtcaaatgtcccctggtgggtaaaatcaatgtcagttaagaagcactgattcatatcctttagttgtaggatttttttttccttccaactggtttttcttgggaaatggagttttaatggcattctgatttctttgcccttcatcttgtgttctccttgggcttcattttgattcccttacctgcagaactcaaatagacgttcacggcaagcaaaatgcagtccttgttattattaaaattttgcaggtattttttcccttgaggaaggagaaagtctgccaaaagcattctctggcagataataaaataattgagagtagcagactttccatttgatttttcttttttggcttggctcctggtgagtaagttagttaacccggaaaagggtgttactgaaactgcctttgcaaatattgtaacggaagaaattatgacagtgagagaaatctgacatggctgactccatcttgtctctagcttcacaggctggctgtctttgctcattcctggttaaaatcaacttaattaaaaactgatattcaagctatatatatatatatatatatatatatatatatatatatatatatatataaaaggccttggtgctttttcgcttcttggatcttgtttaagaaaaatttttctttgtttttcttcttagtcagctgaattatttccccagtctgttttcttgccactcttgatgcccacatgagaggacctaaagtaatttctgacagcccgggactccttgggaaaaacacaggaggtgccacataccctgttttgagaaaaacctacgttttcctcatggaaccccaggaattgaaggaggctagatccctctcaaaatctaaggctctgttccgtgttacctgatgtattttgactttgggaggtatcagaaattactttgcaggaagaagagcttttagcctgtgtgtgtaataactaggtaggaaatatactttaagggatggctaatggagttatggaaggatactcagctctttgcacttttggattagagaagcatgctgtcagccacctagaaggtatggaaatatttctaccccacactgagagatgagactcccttgggggatgggctgattggctttggattgccttgcagtggaatgcagggtaaaagcattgcactctcttctcccattgcattcccctctttttggggatccaagatgtcatataaaaatgggacccttaatttgggggatctgtttttgccttccagctatgcctgcttattaggccctagaaactacatgctctcctggctctgtttctataagggctccaccctgaagccagtaatccaatgaagaaacttaaaaattgaaagataaaaaaatcatataactaccggatccccttctgtctgtgtatttatatgtgttgtgtgtgtgatgtttatataaaacatgttaatgttcctattagttgacttttaaagaaaaaaagtgctaaaaaaaaattgtcagaaaaatagaaacattaatgcatttaggtcacgtgactctaatctttgaaaaataaaggcaatttaaaatattattggtaaagtaaaatgtcttcaacatttatacatttggtctaaattaggcaggtcagatactgtttgctagatgctttaagcccataaactgcttctgtgatttttaataattgtttgacttgtctgttttacagccattggattctagataaggcctggggacacgtggaattagccaggtgccctagctaggctgggaagagtcagacattgtctgcagctctgtctttgtcctgggctctataatctaatacatggttaaaattgcttacctatcagatattacaccacaaattaaagctactgagaattaacattgtaatatactggagaaacaattttacttataaggtatacaaggaaaatagaatgtatttttggtaaaatgttataagaaggtatggaaatacggtttttgttaaagggaaggtaatgttgtctagttcaggggattttaaggatcgtcttaacctaaaagagcgataagacaaaactgcaagtttaaacaagcgggaggatcacaaggtcaggagatggagaccatcctggctaacatggtgaaacctcgcctctactaaaaatacaaaaattagctgggcgtggtggcgggcgcctgtagttccagctacttgggaggctgaggcaggagaatggtgtgaacccgggaggaggagcttgcagtgagctgagatcggccactgcactccagcctgggtgacagagcgagactccgttcccccctacccccaaaaagaacaagctataaagggtttgtgaaggattgatcttgtaaaggaagttctgtgtgtatgaggaagttggctaagatttgaaggagattatttcagtttttggtaaattaaacattaaaataaaagcacactgatacagggctcaaatctgggcccatgtgtctgaataatggttttcttaggaaattaatcagctgtttaacagaaaattataaagggttttaaaaggtttttgaaaattttacctgatggtcaaacgaattaagattatatagatttgtttataaggttttattaagaattgggtttaacattaatagtacacaaatgcaaaggtgaaattttgctttttcttttaaacaagattttcgtgtaatattaagggatacaaaaggtttttgtttgcccctttgagtaaatggcagggaaaaggaagaggggaaaggaaagagattcagttggcttcatgctgtcttcattgggtcctgttgtttggaaagctgaggctcctatcaaagtaaagattttttccttcgtaaaatttttgagttatcattttggctaaatgaatgacttaggtatggtgacctgggattctattttgtaatatctaatgttttaaacctttgatatttgacaaacttgccaagatcaaattctaggttatgttttaaaaaaaaattaggacacctaaagtccaaaagagatatatttggcttattcaatatattaaaaccatgcaggaagcattgtcaaatataaaatggtgtttaactttctttgggttatattcatataaatatgttattagtatgtgttacaaacttgtgtaagattcctataattctgatgtttcagtgtatgttatcattaataattataattgttatgttaaattgttgtgtgtcacagagacgaccagaattccttgttgattgcatctttatggctgtcctgagacttgtgtcatccatagacaattattgtcttgtgttgctccttttcagaaggcagttgttatattcagctataggactctgacaggtactcttgaatgcgggtctctgataagtttagaaattgtgccattggaataggaaaaaaaaaaaaaaacttttgggactctcgtggagagctgatgtgttaaacattgctaatccctttgttattcagaatcaagaaaatgttttctttttagctgtttaccacttttagcaattgaataagataaacttgtgcaaaatttactgtgagcaaaatttggagcatgttactttttctctacctgatttctgcagaatttatagaaactatttgagtattctcaacttatggcagtatagttatttgcataagtgcagtaagaatctgttctcttttgtaacagaacagaattagaaacactggttattttaccaaggctttgactggaatggcatgcattcaaatataaacagactgctttaaggaatcaaagttgacttacagagccaacaaaagcccctcaggaaaacgcctcataccttgtgcggtttctgtacagggttcctgacttgtggtaagtaaagaatgtcattttctggcgggcctagggagccccaagttatcttgagaccttgggtggaggaaagagcctattatggcaaataattcttcttgctgcactttatacaaataatcagtccaagcataataagactaagacttattttgcaagtaaatttgtcttactatgatttgtctttaataaaaatggggactagagagagaaaaattatgtttcaaaaaactataaacttcttgagttttcattatcttctgttaacactgaattctttgtgggctacaagtccccaaactaatgctttcaaatttttcttccacttttctaacttggactcagtaaaatgctactaccttgttcctgaggccctgcaagctgaagcttattcctcgtaatataggcgacaaaaacgtttcagattttcactgcctgcctcatctataacgaaagaggcctaacccacctgcattgccacctcctgatatgggaaacagctgtttaattaaacatctagtctcaggactaggaaactgacctaaaaagaatatgggatgatatatgtaaaatgtgttctttcctgtccatcccaatctgtctgtctaacaaccactggcccaaatctctctgctagccgccccatgtctgattggttctcagagatgttcacctgggtccctcagagcttaaggtccagtctacaaaggcttcggaagctaggacttccactctttatcctaggaccttatagctcactgttcacttcaatgctgtgccaaaactacagatgaccatcctaatgcctttgtcatgcaagccctgaaaccccaaccaggcacatgtgagtacatgcagacagctgcaaaggggttccactccttttaccttggggtctgcagctacacccactatgcccactgtcagcaggaagaagttagggcagtcgtctcttctttttccatcttcatagcccacaccttaagaataaggtgttataaaacccaaagggagggattgaaaccacctttgcaaaaattataactgagaacatgttgacagtgagagaaaactgacctggctgactgtcttgcttctagctcacaggttgactgtctttgctcattcctggccaagctaacctgggggaaaaatttagtttatagtttcaatgataatagtccttcccccaaactaaatgttgttgtaaaactaatgaaaggctaccaaattaggatgagaggggcttgaattctaaataatttaccattatgccattatgccataataatttgccattatgccggcagtcaagatttgcatcttccccttgaagatagcatcactgttgtagaacctaagattggcctttgagatgtcttttcaggtgttcgcatttctgacaaccagattgccccacttggacctgcgaacaaccggtcctgtggccccccctactgaggaatgactcagcataagaggacagctacaattccctatgatttcatctccaacccaaccagtcaggatgctccctaccccaccccactgctcaccaaactatctttaaaaaccctaatctctaagccttcggagagacttgatttgagtactaataaaactccagtctcccgtacagccggctctgcatgaattaaactctttattacaattcccctgtcttgataaatcagctctgtctaggcagcaggcaaggggaatccattgggtggttacattactcttaatatttgtgaataattgcatctacaaaaatgattaagtggctttgcccactgtaatcctagcagctgacaaattactctgtagactccactgtgtttcctagggccatggaatgccttcttatgcaagacacgtttccatggattcaggaaatcattttaatggttcagctatcttaatttaaacaaaagttcagggcttattgttcagctgagtctctaaaaatattttttgactgcagcggctcttttacattgctaatgtgtatccatgtttaaaaaaagaatctttatgaaacagtgaaggccagcatttctttgaggtgttggcagtctttgctttaggaataataaaggaaaacattagtttcatcaaataataaaataaggaagacctgaataaaatgtccacattagtagaggatgaaagtaccctgaaactctgcaaaacagtaatgtctcatgctttgatgtgatctcattaagtgagagcagcacattttgctggtatgttgggaccccccaagaccaccctcaggcccagtggtttgctggaagggctcacaggactcagtacctgccacacttacggtttattacagtgaaataatacagatgaaaatcagcaaggggaaaaggcataaggcacgaagtccaggtgaaactaggcacaaccttgcaggtggccacccccagtggagttacagagaagctgttaattctcccagaagaatatatgattggccatgtgcgggagagtggccagccagggaagctcacctgaaccttggcgctcagggtttttatttgggggccattcctgtgggcatgcggcccatgccgaggggttcagaaggaaaataggagaatacaaggctatccacaccacttcaggcccaggccacatggaaatctgggtgaggttctgtatctgtcgttggtgcatttatgcatttgttagatgtcaatgataaaaactaatttctaagaatgtgtaggagtgggtaagtagctggagaacgtgatacccaggcctttcatatagaaaagaatagcacatcaccctggccagctgtgtggcatgaacaattgatcctcctccaccaagtatgtccattctccctttgctaaatacagtggtgtaggtttgcagagcctctgctcacatgggaggttatgaaggggctaattgttcaattaccaaccctctcataactgtgctagttgcaaacaaactgtttgaaaagactgttttgctaaactgttctcttggtgtgattataaccatttacagtagcaaaatgcaggaatccagaagttcttacattccagatgttcataaccattccactctcctggttccagtgcagtttcagttgtacgatcttttctaagtttattgttctaaattaagacttgccattcttatgctcattaatttgttacagggagaaaaagcaattagaatgaaaatcagttgagtatttataaattacagttgtttaagtatacatcttgttcagtgtagtcaaaaattctccattggtattgacacccacaaaaatggtcagattctgttgaagatgcacataagccttaaatttcacttcctactttaaaaattggtgacgatgtgaaaatgtctaagagagtccacatttcctgttttagataagatgaaatagccactcaccaaggtgcctgtcttccgagtttattcaccgttacattcaagacttgcctgctctgaaattctactgtgaccttaaaagtgcccagcattgatatgttttatgccaaattctattccctttcttgctttccagaccgaacagcaagcgagttgtctggactgtcagacacaacactgtccctcttccccgaagtctctgtacatccctttgctggtgcctccttctccgttcacttctcaactactactgtcctcaagatgatgttctttttaccctcccacatctgtgcctgtagtaatatgtcactctcttcctcctgaagtctgagtcccatccccagtctctctgctgatcccccaagtctgagtgtccactcccaatctctccagtgactcctcccctccaagtcacggtgtgtatccccaacttctccattgccatccatactgatattttgaatgacacttcacgagcactctttaatgtaaacccacacttggtaccatcaccatttccctaccacagtctgtccacttcaaagacaagcttcctctatcctgtgattatgtcactctttgccttagtccattcgagctgctatgacaaaataccataaacaacagagatttttttctcacatttctgcaggctgggagtccaacatcaaggtgtgggagattcagtgtctggtggggacccgcttcctggttcatagatggcgccttctccctgtgtcctcacgtggtggaagaggcaagggagctctctggggtctcttgtataaggacactcatcccattcatgagggctccaccctcatcacctcccaaaggccccacctcctaatgccatccccttgggggttagatttcaatatatgaatttagaagggcggagagaagcattcagaattagcactgtttagtagaaaaacatcaggattgtgttcaaacatttttttccatgttatctttcctactgcctccttgtcttcagttccctccccaccacctggcacccagatatcctacccttgtcagtgttacctctatccccccatcactgttttgttgtagtaacaatatctcacatttgtcaagcacttgctgtgtgccaggcatgattctaaatattgacagatgaaactgtttattcctaccaatccctaggaagtagaaacagctccatcctcatttacagatgagaaacccaaggtactgagaaggtcctggcctacccaagtcacttcaaggaggtcatacagctgggattcagaacaccatccatctggctttggaatctttctcattttttcatttattcaacattcattgaaaataatgtaataaaaattatatatgtgtatctatatctacctatagatgcatatgtatatatgtatatatagctatcatgtgctacgtgatgctttcaaatacagttggccctccatatcctcaggttccccatccacaaattcaaccaactgtgactcaaaaataaattgggggctaggtgcggtggctcacgcctgtagtaatcccagcactttgggaggccgaggtgggtggatcacctgaggtcaggagtttgagaccagcctgtccaacatagtgaaaccccatctctactaaaactacaaaattagctgggcatagtggtgcatgcctgtaatcccagttacttgggaggctgaggcaggagaatcacttgaacccgggaggcagaggttgcagtgagctgagatcgtgcacttgcactccagcctgggcaatgagcgaaattctttctcagaaataataataataataaattggaaaaataatacattggaaaaaacaaaaataacaatacaacaattaagataatacatatatttttaatttttaaaagtggcagttttattagagcaagtatgaaaatatgaattaaggttgcaatgagcagcgcagcagagaaggggctgcctgccctcctccccccgcccgatatatatttcatgtgtgggacagggtctcactgcattgcccaggctggaatgcagtggcatgatcttgcctcactgcagcctcagcctcctgggctcaagcagtcctcccacctcagtctccccaagtagctgggaccacaggaatgtgctaccacacccagctaatttttcgtagtttttatagtggcagtgtttcaccatgttgcccagactagtctcgaactcctgggctcaagcgattcacccaccttcgcctccaaaaaagtgctgggattacaagtgtgagtcactgcgcctgacctatttattgttttttaaagacagagtctctctctgttggccaggctggagtgcagtggcacaatcatggctcaccgtagcctcagcctcctgggcacaaatgatcctcccgcctcagccccccccccccccccccccccccagtagctgtgagtgcaggcacgggccaccacactcaactaattatttttattttttgtaaagatggggtctcattttgttgcccagtctggtgttgaacccctggcttcaaatgatccttccacctcgaccttgcaaagtgctgggattacaggcataagccaccacacccagtgccaatcttagttctttgctcgttatctgaattttcaccatatttgcatacacctggagtattttcttaaattgaaacagttgctttttattagatataccaatacctgttagtttacgagtttcatttagttctattgttcgcataacatacatttaaatagctattaaatttcaaacatttgccctcacgctacttaaaattattttgagtaccgtcagaaatgtggaggccacaagagagtacttgaatgcagcagttgtcaccttttctccagcagcttgagaaagggcatagagtgctatctgagctggatttgaaccagaagtttttaggcaaagtaagaagagcacttcaagaaaaataaagagcaaaccccagcatttttgaggagaatgcgccatcttggtgatgcggacctaggacacatgatggcaggaaggaggaaaagatgctggcaagtagggttagtggcacattaacaccagctgagacacgggaacctgtccagttagaagccgttgattcattgttgaaagataaaactggatgtagtgtgagtaaaggatgacctgcctgcttggtgaaaaattagtaaccacagaggtggctgtcaaaaccaaccagcaaccagggaaaatgcttatagtgtgctaggtaaaagagaacagggatacaatattctgtgaccatgatgattatacatagaaattaagacgcacaggccaggcgcggtagctcacgcccagcaagtaatcccagcactttgggaggccgaggcaggtggatcacctgaggtcaggagttcgagaccagcctggctaacatgaaatgaaaccccatttctactaaaaatacaaaaattacctgggcgtggtggcatgcgcctgtaatcccagctattcgagaggctgaggcaggagaatcgcttgaacctgcgaggcggaggttgcagtgagccgagatcatgccattgcactccagcctgggtgacaagaatgcaactctgtctcaaaaaaaaaaaaaaaaagaagaaagtaattaagatacatagagaaaagggactggaagaaatcccccaatgtgagaacaggagttgtgttgattgtttaacaatgtgagttaatttctccatcttccaaattgctttctcttatattcccaaagtcatatcttgacttttgtttgagtgtgatttgcaatggtgctatccgtcgtaaatctctggtttagcattcatgctgtcttccaatttccaaatattgaatccagaattcatgagtgttccaaggtgctggagaccacactgtagggctggaggacatgagcgtctctgcacctagctcttcctagtagctgacttgcagcaggagctgaggcttctcctggcatcacctccactacaattctctgtgagcatttccaggaagcagcaccccctaccctagccgaggcccgtccaaggttgtctcgttgtcctagcccgccattgccctgggaggaagtagccacatgagtttatggcctgagtaatgcttttccctcctggatgctccccacatctagaggatatgaaaatagtcttggcaagggtgcctggtctgcgcttgtcagcggcctgagctgtattcagccaccacccttggggtccaggccagatgttatggcaaaaccgtattttaacgagatccttctggtatttcttttggacgccgtccgaggcagcttcattttacgctaaattccatgttatggtgggtcatctcaaacaggtctgcagcgcataaaaatgttctcactgcactctgttttctgtagcaaaatgttgttggaggttaggatgggagttgaggactgggccttgagggtttttttcatataaacacattaaaatggaaagctgatatgaacacgttcagtgatatagactgcaaaggcaaaaagaattctccccagcatatttttttttctttttaccatggatgtaattggagtttacatatgataagaactgcttcttgggcagaaaatgtaatcctctggtgagactaatccatcattgttgaagtgaagggaactggtagtgaattcgccccacagatgaagataggatttctaattccctcgccttttctgtttactgttcctaactccgtgagagtgtgcgtgtgtgtctgtgttttcttcaccatttgatttttcatcccggctcccacttcctcatccttggcctctctcgcatctttatttttatcacaccctccccacctccaccaccttgtcccagcactgagaggaaagtgggcagctttccaggcagctgcagtcctgctggagaaacctttatgatccaggaaatattgactgaggagaagctgtgctgactccgctatgaataaggaggttggaaaactgtcagcatttgcagaaacaaaaggaagtgctacatatacgttttggtttcataatgactgtattgtaaaaccccttctctttagcctactagattggacaagtgtgttaaccagtggctgtttggtatccattgatcatagagctagaccaacaaccaaagttgtttacctctcataaggtggcttttgcaggcgtgccaaaatcatattatgaaactcccagccacaaattctgacatgtattttcacttcctatccaataagggatatccccacccctttactccccgactactgtagtcataaaggtacactcctagttcctccctctctctttctcagcttctcggtccctgtgtgtgataaggtttcttgttgccctgtgtggcatggtgtggcacgccccagcatactcccttccttgggaactgagtaataaattctttcaatggcattagcctctttgtgttgtcactcagtcacctccataaattaaaacccttcaggttttgttggcactgtaaggtaatttattttctctacataggattttagaattgaaagggaccttgtagatcattgaattccacctgtccatgggtcagaaaagggagctggggaaactgttagggggcagatccaggccttggagcacctggttaaatgtgttctccccataagcctaagaaatggtaccaaattcttatgtcattgcatccaatatggtccttccttctttcttctcttctgtttctttcctttgctctcaagactggtgtatcactttgtctcccaggctgaagtaaagtgtgtttgttatattgcagtggttttttattcgtattattatcatcatattgttttttgttgtttttttctggatatttttgatctgtggttggttgatttggtggacgcagaactatcggatatggagagtcaactgtatataaaatcaggtcagcacacttttcctgtagaggagcagatagtaaatatcctcagctttatgagccatgtggtctctgttgcacctactcaactctcccattgtagtgtgaaaatagccatagacaacacatcaactcatgggtgtggttgtatctcaataaaactttatttacacacactggcagtgagccagacttggtctgtgggcctcagtttgcaagcccatgatctaggcaatgcacagatagcagatggtgtccctcagctttggatagctgtaagtattacaagtatgtgagtctgttaaatacttaataaaaattccagttttaatgttacaaattgatacccttggtatttgttttagctgaagatgcaaaaccaactccacagctgcctgagtattaaattctacttttctctgccaaataagcagtatttctaaaggccagtgattgataacttagcagattttgctgatgaatcaggccaacattagctgagcatagtagtacactgtataactcaaatggtttgtgaagtcatttgtgaggggtgtggtttagcagtgtcataattgcaagaaacgcaatacatgtacttggtttgttttaaatgtttatgttgcctagttagatgagacaaattcttatacagactgtttcctctcttgtgagactattacacgttttattccaaatggacaggactttacatggaagatcctaccatcctttataaaatgtcatcctttgtgtaagcctttcagtttatcatgattatactcttttttttctccctgggaataattttacctcatctggttatgctctgttactgtgtgttatgttatctaaggtctatgaccaattgcatgcagagggtggcttgcttttcaatagcaacaaccaagaaccaagcagaaatgtaaggagagtagagctgggggtagtggcctttcagggtgtcaattccccaaccatggtggggttgatgggacaatattggaaacatttttggttgttacaatgggagtgtgctactggcatctagtgggtagaggccgggggtgctgctcaacatcgtacaatgcatgggactgtgtcccccacagcaaggaatgagccagcctaaaagtcagccatgctgtgcttgagaagccctgctgtcaagagattcatcaggaatacgcctcctaagtaggtggcaagcctagcgtcttcaggaatgtctctaggctagcctactggtgacaccaaggacactaacccatcaccctcacacgatctttcatcgaggtaccaccaagctctttgttctcctgccctttaactacttctgcacctgccgcaggggcagtccttggtgcttcgtttatcattgacattctggtctttgttcctacggatgtcttgttgggcagaagagatgtgttcagagatgcgggaaagctgaggaggcacaaggcaccgaagtctcaccactctggcagactgcatatgaatgtgcccattagccctggagtccaagtgggaggggtgagatgctggcaggtgtggaggcaggcattaccttccgcagcaccctggcacctggttctggcaactgtggcctaagaggaagtggtcaagcagcctctagtacatagtccttgggcattgtcttagttagtatgggctataaccaacaccttagactgggtaatttatatacaaccaaagtgtattgctcacagtcctggaggctgggaagtccaagatcaagacgccagcagatttggtgtctggtgaggtcctgtttcacatggatggctccttctgtgtcttcacatggtggaaggtgcaggggagcttgcttgagcctcttttatagggacactgatcccattcacgagagtggatccctcatgatttaattgcttcctgaaggccccaccccttaataccgtcactttggggatttgtctcccacatacaaatctgggggggacacaaacattcagaacgtagcaggcatcttcctgtcccagaatgaatatcagaactagcaaatatcctagcagccatttcatctgacatccttattgttccaacaaggaaagctgggacagcaacctttccactcactgtggtctcctctccatcaaatgtgttgggggtctggctgctgtcccatctatgtgtctcatcagcacctcaaggtactttttatccctatatcacagaggaggaaatgcaggcccagccaaatgaagcgacatgggccaggcaccagtggcagaacgaggacagaacccagccatcctgcctgctgctgacattttctccatccagccctcctgcttgccttcatgagaccacatggccagaaatcagtaagaaaatcttgcaagcaaatggactgaaaaaccattgctctagaggccatgtagagatccattcagagaaatgcagctagtgaaaatttcagcaaataggaggacttctgttaaccatggcatggaatgcacatctcccaggtctttatgaaggtgcctaatttccagtcatgacctaccctctccaaaagaggacccaagctgatgaaagaccttcgaggtacccctgtagaactttatcctgcacatttgtcattgtgcatctgcacaggatattcctttcggcagacgactttcagctctttgcagaagtctcagacgccacatccttagtccatctttactggttcatctctttgttccaagaagacttaattgaatgtggatactgttgtccacacgatctagaaatgaaatctgtgttggagagcataatcatgtagagagataaagttatacagccaaaacatgtactcaacattaaaaacccagatgagagagaaatcaagggcacactccctccgtgggttagactgagctttgcacaccgttctttgtgagttgcctgagctgcacccacgctggctgctgtccagagctgccagtggtctagctgagcagccaggtggaaatggagtctgtgtccatgcagggaattcaagaattttggttcctgtgcttgtgggtgggtcttggagtgtaaagtaaaaagcggaatctcggagtcacatagtctacggttcacagtttagttcagcgtcatatcacatgatccttgggcgggttacctgatgtctccaatgtttgtccttatgtgtgaaacaaaaacagtaccaactccaaacagctgctacaaagactgaggtagtggacagagtgcccaggtttggttgaagatggtaatgtggtcagaatcggctctgtttcacagagcatgtgactgcaagtaccagttctgtggcccagtgctgcttgcgggaatgaatgagtcagagtggatgaatgaaatgtcccaggagcacgagactttccttccacaattgctccatcagccatgaggtttgcttgtcaggtgccgtcatcagcacataatgctgcattctggtgcattcagtagatgtttctagatactgtttcatggtggctaagagtggtttctggcacccaggcttagatctcagccccacccctacaaactgagcaacaggaggctgtcagttaccctcaaaagatctcagagactgattgatcaaggggaaagcggcagtgacagaatgatgctgagaagcttgaagccatttagtaggagccacgtgagtggcccccatcagccgtgagagtcatgatgtctatgagagaggaatcactgtggcccagagtagataaggaagattccatgtagtggatcgtcaagccaagaatgcagtgaggtcccgctttatccattgactggggtttttctcttccacactttgccaaagacctcaatgataaaagcttgcaggtaaaactctgtatagcattggcagagaatagagtcgttggtgaacccaagggtgggttgcttcattttggtaggagtgggtaggagaaaaggaaggtggatagagagaaagcaagttagaaggaaaaggtaaggttgttgtaaacagccttggcttatatcctccaaaaacacaggggcggaggaacccttggggataggggaacctggaagggcgtcctttggaacctaatgtaggcagttatagttctgtaaagaaatatgcaaggctctgtgcaattgattgtaaaattaatagcagctaccctattactctgttagataaatctcaactacacatttgatatgttctttacaacctggcggtggggacagaacagagggtggattgaggaggagggagagtagacagagaaaagtgaagtgtaagaaagcagcaaggagagcacagcgcagagctcgtctcctggaggaacattcccatctggtgagcgttttgtttattgcaaggtcagtttgcatttggataaggcgaggcagaagggcactgatacggaagcagagggaagccggctgccactgcccctcattggctgaatgaaaggcggcggaagaggagcacctgtccagcaaggctgacagtcctgcctcctgggataagcagattctcagcctgcagagtggtctaaccagggaggtagagtggctgctttccgaactccctgcttcctgctcatttgcctcatgcatggaagttgtaaacagtgtgagagttgaaagccacaccatgggaatgccttggtgtccaccccacctgttgccaggaaccgagcactgggggtccatgttcctcacacgagatccccccatgatgtccacctcccaaggatttcaagctcctgtgcaccctcaggccgcctctgcaccaagcaaagtgacccagccctgccaggcggggttgcctgttttaggaaactccctgcagcagcctaggcttgctggcagtgggatgccacctccctctctctccttgatgaagggctgtcgcagcttcctcatcacccccagacctccacatagatgccctgcatcattgccttctttccttgaagcaggcgccatccacaagagcaaggcatggctttctgtgtattcggtcctgacccccttcccaacagcttcattcaagagccttcatccaaagctgatctgaaaacacctttaaattgccaagcatcattgatagcagcttcctagagcggcagtgaaagagatgcactgggggaggagaggaaaagagccagcatcaattagcaaagagaaaattcccagtgttttgagaaaatgactcagtgccacaccagtcagtccaggacggcctcttctccgtcttcagttgttgagttgtgatacacttgccccgcgtgccaggaggactcagggtcagcgtttgctgttccctcatcttgggctgaagaaaggtgccctgtgtgctttcagggggtgacacagagaggcttcagcatgagcttctgcacagtcttacgaaccacggagttttggtggggagcctggagccaaatttgagtaacagaaatgtccaaccggggcatgcagggcaaactattgtctgttctgctttgttcttaataacactgaaacggttctaccatttaagtcccttgtttcatcacataccaatcctggtcttcctgggtctgaagtccctccctctctccctgccctttcccaccttactgaacccaaatcagaagcatccctgggcattctgcagccgtgtctgtccctgcaaattaagtgtgtttgaagtctgcgggccaccttcagatctcaatggctgcacctccctccttcaattcgggtctcactcaacctcagctttcccctcttgccacaggtttttcccactcggctttcacgtttgggattgagagccacatcagccagtccaacatcaatgggacgctagtgccaccggccgccctcatctccattctccagaagggcctgcagtatgtagaggccgagatcagtatcaacgaggtacgtagctgctgggcccggcccccaaacagcagagccctgggaagctgcaggagcttggaacacattggaagctaacatgcatttccctcaggcatttgggattaattccgcggcagggtgcagtggctcatgcctgtaatcccaggactttgggaggccgaggcaggaagtctacttgaccccaggagtttgagaccagcctggacaacatggtgtaacagcatttctacaaaaaacaattttttaattagcccagtgtggtggtacgcacctgtagccccagctctcgggaggctgaggtgagaggatcagatcacttaagcctgagaggttgaggctgcagtaagctataattgcaccagtacactccagcctgggcaatgcagtgagactccatctctaaaattaaaaaaaaaaaaaaaaaaggaagaagaagaaagtaagttgggttcttttccactttgtgttaataccggttgtgtggacacacagcagcaagcttccagtgcccctcccacatggctctgtgtttttgacttaaatgtagaatcactggctgttagttgatgtaaacacttacaccgccacatctgaaaaagatacggcagatcttcagctgctctgggcttcggagtggacgtttgccttgcacttaatgcagacttgctgtctcttcttgatttctggagcaggttggttagagaggggccccacacatggtcaggtggaatctgtatttcagcagaacccggcagagggcatcaccagaggctgcgtcagggcagagaggtgatggctctggtgttaatgaggatctcaagggatgccttcattaccgggctcgttgtagagcagatggggtaggaggatggaaaaataaatgcacattaaaactgtgcacttggcttggaacccctcccactttttacattggtccacagtgaggagttgtgccaattttataccaattttggttttaaaccacacacctcaccctctcttgtcccctcctattctggtctcatgattctgcagtgaagatccccttgacttctggggaataatgggatccacaacctttcttgccgccttcacctgagtccctattttatttttagagactgagtctcacactgttgcccaggctagggtgcagtggcacagtcatggcttactgcagcctcgacctcctgggctcaagtgatcctcctgtctcagcctcccaaagcactgggaccacagacagtccctgttactgatttctcagtcccctgcagcttcctccctctgcttctctttctcctactctgacccaggcgcgtgattctactgaacttttccatactgtaccgtcatccatcccacctggcagtcacattcttccaggattccctctgtcccgtctttctgggaactggtcttgcccttacaaacctttctccttcacagcatgttacactgctttaaaaaactcttttagaaaatcacaaagtaataatatcctgttctctttttcttttcttttctttttttttttttttttttttttaagacagggtctctctctgtcacccaggtgggagtacagtggtacaatcatagctcactacagcctcaacctcctggctcaaaagatcctcctgcctcagcctcctgagcagctggaacttataggtacacaccaccacgtccagataatttttttattttttgtagagatgaggtctcgctggtcttgaactcctgggctcaagcgatcctcccgcgatcctcccgccttggcctcccaaagtgctgggagtacaggcgtgagccactgtacccagtccctgttttctttcttgcacttctgcctgccatttttcgcaaagctgtggctttcgaaactccggtgttttttcctctcttgtgctcctttttccctggcaaaccccttcacactgtgtgcccgggatcttccactgactccttctggccctgtctagtttcctcactgcaaaacacacacgtgtgtatctaagaggacatgtctccaaggtccagccagccatcagatctcaaggcgcctgtgactctgtttttctctgctcattgccttctacctctcatctgttgagaagccttcatagttgccttccctcggcactccagattccagcactctaggggctaatgaaagactgtcccatttgtcacaatggtttctaatcattaaaaagtgagacgccaggggcggtagcacacatctgtaatcgcagcactttgggaagccaaggcaggagggttgcctgaggccagaagttctagaccagcctggccaatataatgagaccctatctctacataaaataaaaaaaattagccaggtgcagtggcacatgctcgtaaccccagctactcggaggctaaggcaggaagatcagtttggtccaggagtttgaggctgcagtgagccatgactgtgcccctgcactccagcctggatgacagagcgagaccccgtctctaaggaaaaaagagagacagtgtgcccgcggagtttaaatgaggacatgttgttactactttggacagttaccgcgttttgtcatgggcttgttcatttgggtgtgaacatatgaaggaggaagggggtgtgggagcgtcttgacccatcggtcaccattgtccactccatggccagaatcaagggccaagagtgcctgaggaggtgatgcagctagttctttacataggttgtattgttttctttattttgaatattgtcttgtaatcagaaatcatctggagtgatgtttcatttagttattcttcagctgaaacctgagcctttcagttcttcctcacttctgaagtaattcaggttcagagcatataaacatgtgtttgcacatccagatacaaccccaaggcttactgaggttcacctgattcgaatatctggcgtgtttcacaaggaaagaacctcctgctgtatttttaaacgtgtgtggaaagttttccatggtaaacggaaatcagagaatcaaagaatggtcaaaaaaacatgaatcaaaacaaaatgatgtcaattgtgtcatggctatggttagtctaaccctgaacccaaggagtcatttcaagtagcagcaagtgcctattttattaaatcccctggacagatggacttggaatccaggcctaaatgctgtgtgcatctcatttgggctctgcttctgaagcgttaccctcccatataatggatggtcatttgcagagattttgcacagtcgcgatagcacgtgggcaggtcttctccaccgcagcactcagtatttggggctgcgtgtttctctgtggtggggccatcctgggcactgttggatgttgagcagcgtccctgggctccacccaccagatgccaggagcacctctcctcccttagttgtaacagccaaaaaagtctccagacgttgcctaatgccccccaaggagtcacagtcaccccccgcccccgccacgttgagaattgtgccatcagggatagcactttctgtcaagaataaatggcctttttgtcctcaatgccccaattgggtttgacactcagaacaaccatcacacttagttcttaccaacagtttgtcgtgtccccttccctgcccaccgtgggatcccttcaccccaggctccaggtccatgccgcttcccccgtggccccctggttgctgggagccagctgtttacgccccacttccctgcgcttctcctgcccagagagcagaggccattcccagagccctcacccccgtgagctgacagctgtaccttggcttgcttccccaggatggcacagtgttcgacggccgccccatagagtccctgtcactgatagacgccgtgatgcccgacgtggtgcagacgcggcagcaggcattccgagagaagctcgctcagcagcaagccagtgcggcggcggcggcggctgcggccacggcagcagcgacagcagccaccacgacctcagccggcgtttcccaccaaaatccatcgaagaacagagaggccacggtgaatggggaagagaacagagcacattcagtcagtgagtgcaggggctctgggagttcggtgggcctctctgggttcattgttttcttcttgggcaaatccgaatgccttcttaaaaacctgcctgctataaatgtcttagaagctgctctctagtgtttgcttacgatctggccggaagaacttcccgttccattttttccatcacaacccttggacctgagcttcttcaccctcatcttcaactttaggaaatcgtgctgcgcctgctaatctgagaactctcatgtaacacatgattattgcccgtgataaacaaaagtgtttcattcatggacacctttagtctcagcctccagccttccatgttgagggtttttggccaaattatggtataattattgagcttgcagttcctgccaagggcactgggccccagagactgggcataggcttatttggtctttgcaaaaccccaggacatcagtccctgttaggtgattgcctgtgagtatgtggccagtcagagagcccaaaattctacccagagaacctgctccacttagacatactgctctatacacccgtagggacgccacttcagggtgcaagttcagagcgagcatatgtgccgtgcatggcgcaccgtgtgcgcgcatgcacttgcatgcacaggtatgcatgggtgcatatgtatgttgtacatgtgtatatctgcatgtgtatgtgcctgtgtctgtgtgcaagtgtgtatgcatgcgtgtgcgtgtatgtgtgcgtgtgtgcgtgtgtgcgtgcacgcgtatatgcgtgtgcgcacctgtgttcctgtgcgtgtgtgtgcacaagtttgtgtgcgtgtgtgtgcgcacgcacgcacacctgtgcatggtgtagtgtatgtgtgtgtgttcttccttatttgaaagttgttgccctcggagcagccatgcagcccagcagtccttgaagatcgagctgactatgacgttgctgtcttacctggtacgtcttggctccacaacttcctggtgtgtagagagccagccggctgcctctgatgaggctgcagcccgagccaagccctgtgacaagttaccatccacaggcaccagctaaaaaattcttggagaagcagatccagcatttaatggaaggttcacagattgttaataacgtttctattgcaatagggtgacagaaaggccacctgcctcaggtaaaaggaaaagacctcttaccagccttctattgataaggtccacaattgtggggcaggaaaagaagagtctggccctcctcctctgtgcatgtggccagagttcaccctggttgaacttctggaacagccaccccaacccccttctcaaaccctgcatcttgtgcctgacccacagcccagtctatggagacaggagcattggaaggccgcattttgataagaatgaaaatactggctgtcactcctgcctggagttaccaggccccctgccactgcgtggctggctaagatgccagtttccctcttgccatcaccagggacagtgggtctgccacatgcagaaagatgtttttcctctcttccagccagatgacactttcagagcatggaagaaacaccaacattgaagagtcccattgttgtttgaatcttttgtatcaggcttctcgagctaagcaggaccaccaggcgttttcttattttttacataaacagcactcctactcagtgacacgtaacctaagatcacattgcttctgtttcctgggttttccaccagagcacctttacgaaagacatatgacaaagcatgctcaattcctcaccgtattgtgaaactgttaaccatggctaattgtttgatgatcaggctatattgctcctttctcaggagcataaaccagggtctagcaaactttctttacagggacagacagtaaatgtcccaggctttgagggtcatgcagtctctgtcacagctgctgaagtctgtcagagtgcaaaaacagctgtgagagtcagctcaggctgccgtaacaaaaggccacacaccaggctgtttaagaatttgctctcacagttctggaggctggaggaccaagatcaaggtgtgggcagggctggttcctttgcgaggcctctctccttggcttgtagagactgtcttctctccatgtcttcacgtgctcgttcctctggttgtgtctgtgtcctgatctcctcttctcataaggacaccagtcccactgggttagggcccacccttgtgacctccttttaccctgctcaccttttcaaaagccctatctccaaatacagccacattctgaggcccctggaaattggggcttcaagatatgaattttagggggacatagtttagcccataacagtagccatagacaatttgaaaacatgggcagtggctgtgtgccagtcacactttatttatgcagaagcagccagggactaggtttggatcatgggctgtagttagctggccccagttacaaaaaataactgtcacccaggctggggtacagtggcacaatcatagctcactacagcctcaatctcttgggctcaagtgatcctcccaccgcagcctcctgagtagctgggactacaggtgtgcaccaccagggctggctaacttcttgttgttgttgttgttgttgtttttatagagatggggtcttgctatgttgcccaggctgctgttgaactcctggtctcaagcagtcctccctcctcagcctcctgaggcactgggattttaggtgtgagccactgcacttagcaaactgtttttattcctcaatgaaatttagagactgtcaaaatgtaaagaaacctaaaatatttactaaattgcactaaagccacgatttcgttagaatcatcagaggtaggccgggcgtggtggctcacgcctgtaattccagcattttgggaggctggggcaggtggatcacttgaggccaggagtttgagaccgaccctggcaacatggtgaaaccccgcctctactaaaaatacaaaaattagcctggtgtggtggcacatgcctgtaatcccagctgcttgagaggctgaggcatgagaattgcttgaacctgggagacggaggttgcagtgagccgaggtcgtgccactgcactccagcctgggcgacagagcaagattccgtctcaaaaaaaaaaaaaaaaaaagaaaaggaatcatcagaggtagtatttagtacataaaaaaaatgtttctggaaacaaaagagccctttaagtgtgtttctcttgtattggtaagccacttgtctctttgtgtttgctgtgacagataatcacgcgaagccaatggaaatagatggagaggttgagattccatccagcaaagccacagtccttcggggccatgagtctgaggtgttcatttgtgcctggaatcctgtcagtgatttgctagcctccgggtaaggatgtcagggtggggggcgctccagagttggggagatgggagatgcaagctgctcgcccttctctggagttctgcctaaaggaacacacactccccttcttaccccggtgtgtgggcagaccaaggaatgggtggctctatgagccacttctctacatgtctcatattgtggagaagccatagttccaagtcgttttctccatgtggtggtgaggaacacagcagcacttaaattaccaaatgcaaagatggcaaagagggaaacagggatccagagggatgaaaaagacagaagagcatgtgctgaagatgccctctggccagagagcaagctgtggagagcttcttatcccatttgaaccaaacaccagaggctcctgtgtttttattctgtagatctggagactcaactgcaaggatatggaacctgaatgagaatagcaacgggggctccacccagctcgtgttgaggcactgtatacgagaggggggccatgacgtcccgagtaacaaagacgtcacctcactggactggaatgtaagcatcttccaccccctgggcactttgaaattggtaaaatcggccagccaccaggcaggggctgcagcaatggagcccatgcagacataggaggcaggtggtcctgtgtgctcagcccccactctgatgggctgccagagaggtgttcttggcttctttttttattttgagacggagtcttgctctgttgcccaggctggaatgcagtggtgtgatctcagctcactgcaacttctgcctcctgggttcaagcgattctctttcctcagcttcccgaatagctgggattacaggctcatgccaccacacctggctaatttttgtatttttagtagagatggggtttcaccatgtcggccaggctgctctcgcactcctgacccaatgtgatccgcctgcctcagcctcccaaagtgctgggattataggcgtgagccactgcccccggccagtcttggcttctaagagctattaacaaggctgcatttggcaggcagtgagctgtgtattcagtagccgtatctttgcacgtgagcatgccttagcaaaatgagcctgtggcctcatggtgggaaggtaggctgggagccccaaggtagttcttctggagagatacgtcgtgcagcccaggaaaggtgattctccaccttgggatttcagcaccaggtgttctgtgcattgacacatgggatgcacacagtttgactgctttttattttctgcaaggtcttacgatagctttcagcatggtattttcaattctgtcattaaagaacacgcagtggcaaatggttccagtgtacctggatcctcggagaggctctccgagctgcttcggtgctgccgctcctaagttgtttttgtggggttttgtctctttctggccctcagaccaatggaacactcttggctacgggttcatatgacggttttgcaagaatatggacggaagatggtgagttctgtgtccctcgtgctggggtcgggtaagaggagctgccgaacttaacccttgagtgaacagaccatgacattgaggtcaacatgtttgtttttactaacaggtaacctggccagcaccttaggccaacataaaggccccatctttgccttgaaatggaaccgaaaggggaattacattttgagtgctggtgtagacaaagtgagtattagctgaaaatacatccctttgatctataggtggttatatatttttaatctcaaaataacatcgtggtttcttggaactcgtaggctttgtgcttccccttaagaaatgaaaatgatttgtttaggctttgtttttgtggttttgatctttctgttcatttgtgacacatcatctcttaatatattctgctgttctgcagaccctcgtgcaaagcttccctttatttgaggtacatggttcagtggtagagagaggacaatctccacattgcatttgtcagttgctggaaggagccacgtggtatggggcgtgccctgcctgaacttgcacccactgaggggtgagtggcacaggctgtgtgtgttcttcaggcttcggctttcctcatttgataaactgctgcttcccaccgtagaccgcagatttctctgagtaggagtcaagcaacctggctacaagggcacgctcttccgatggcccacagagccaggttagaattgacttgctctgcacctgggcagggctgcagggagacacggtagtgttaactccaggtgcatgtaaaagccatcaatggggtgggaacccaagggcaaagagtaaggggacgcagactccatcctgggcccgagtctgatccagccagcaacctcggcctctgtgcatttcactttcctcacttgtccagcgacaaggctggctggagtcatgagcggagacagccttcatggaacagttgtgcgttcccgagactcagcaggaattctaagtcatggctttggaaaagaagcattatctagaattgagaaaaaaaaaaaaaaaaagacgtgttttcacatgaatttgtgtttctacaacaactggaaaccatgcctgaatactggaggatgctcgggcctccacaaagctttgcattttgtggtgatttcaggataacttgaaaacttactaggtcttgaagttcgagaccagcctcgccaacacagtgaaacccagtctctactaaaaatgcaaaacttagctgggcatggtgtcgggtgcctgtaatcccagctacttagagactgaggcgcgagaatctcttgaaccagcgaggcagaggaggttgcagtgagccgagattgcgcctctgcactccagcctggatctggaagaagagtgagactctgtctcaaaacaaaacaagacaaaacaatacaaaacaaaacctgagtcagagctctctgttctttctagttctgaaagttataaaatgatagagttggccggtcgtggtggctcacgcctgtaatcccagcactttgggaggccacggcaggcagatcacctgaggtcgggagttcgagaccagcctgaccaacatggagaaaccctgtctctactaaaaatacaaaattagctgggcgtggtgggggatgcctgtaatcccagctactcaggaggctgaggcaggggaatcatttgaacctggggtgagcccagatcgcgccactgcactccagcctgggcaacaagagcaaaacttcatctcaaataaataaataaataaataaataaataaataaataaaatgatagacttgacctctgaacatcatcccactttgggagaaattgctaaatgaaataattgaatttggcaaactgtggcccacataggccaagtctggctcctcacctgtttcttaaatttaaataaagttgtattgggacacagccacacccctttgttgagacttctccatggttgctttcatgctacaatggcagagatgagcagttgcaagagagaccagatggccctcaaagcctaaaattctactacctggcccttcacagaaaaagtttgcggactcttgcactagggtataactaggtcaacaaatcattcattcataattgctctccctctcttttaagccaagaaacctttcagacttagtagcctggtttatgatattttaaaagctgagttgctgtggttgacacataaacgttctcatgtagctactatcagatctttgccaagatgttctaattcaagtaacatgcatacgcagcactttgctgtgcattcagtaggctctcagtaattgctgcttgagttattaaaatcactcatgaaaatgacagcacttttctttatcaagcagttcactactgcatgtgttaatccatccggtactgccaagataggaggcaggcacaagtatgatcactcccattctatagaggacgaactggaggcctggagagggttattaatttgcctagggacacacagctggtgcagagtacagagggatgggaactcagaccctggtcaccagtaactactgccctttaacttccgtagaattctaaatagctgtttgtttcctggcctccttcctacctggagactgttaacatttgtgattgtttttctcactgattatcagtcttaactccaccaggtgatggactatgtgatcagtgaaaatgcatatgtggaattatgttagtctcttgggctgggtacgatccaccatcattacttagtcaaccacagcaggagtgaaaataacatccttgtacataacactcagggagaaaatgtaacttaggggatgctggtgttgaccaacacagagtgactaaaatatatgtcacattcttcaaatgtttgcataactgttttcttttgtccaatgtacatttaacataaacatcaactaagagaccagtcgctgatgtaatatgtgaaatggtatcagaactgtgaaagagtttatatattctctgcagtgttagatttgtttttgcatggctaaattaagaagagttataccccaacaaagaaatgttaattggtctagaactgacccaaaacccaggagtaccaagtttcaaagacactcactgcttgctttcctctgaaaatgtctacagtcaacacaaaatagaactctttcttcttaaagcaaaatcttgactgagcgtcagtaacagagaggtgtaaagtttccaattaagttgaaaattccagttgatgaagacgtaactccaatgctattcattgagctggttctctatcttcctagcgtcagtaaattcataaaaattcgtgatttcctttgctttccaagggagaactcaacctttctacttactgttagaccagtacattggtgcctggccccagtgcaagccaatggctctgccatgtctagtgcccccatttcatggagggatgggcagaggcattttcagaaatgctcgtctctgcagcccttcacttggaacaaatgccacaaagatctctggagatgctttgttccaggtttttcaacagtttctgcatttggggatgaggaggaattcctaccaattttggtagttcttgcaagtattggttagggatgctctgtccttaaacccatttatgcctagtttccattatcggaatgctgagcatgtgggagttatttatatcctgctgctcagggtcatcgccaaggtctgattgcagaaattcaaaaagttgcaacctcaggcataaatgagttaagggagatgccagcatatgtggctgataggttcatcaaatgtggccgtccagattgctgagtttaaaacatgctgtactttaatgatgtggtatgggagaaaaagaaggcaaatatcccagtaaggttttgatactgattacatgttgaaatggtaatatttgggggcatgttggagttaaatataatagattgctaatgaattttaccagtttctttcttcttaatgtggatcccagaaaattgaaactagcccataaggctcactctctatctctattggacagtgccggtttataaggagaagggctgtcttttcttgtatgataaatgtttccagagaaaactttgccagaatagttactaactttttcctttgtttgcggaacacagacaacaataatttgggatgcccacacaggagaagccaaacagcagtttccttttcattcaggtgagttttttgttgttgttgttgttgtttgtttttttgtaattcaaaaataataattcaggtcgagcccagtggcttacgcctgtaatcccagcactttgggaagccgaagcaggtggattgcatgaggtcaggagttcaagaccagcctgggcaacatggcaaaacccatcactacaaaaaatacgataactagccaggcgtggtggtccacacctgtagtcccagccacttgggaggttgaggtaggaggatggcttgagcccaggagatggagtttgcggtgagccaagattgcgctactgcactccatcctgggcgacagagccagaccgtgtctcaaaaactactaataataataatccaaaattaggctgggcactgtggctgatgcctgtaattccagcacttcggaaggctgagacaggagggtcacttgagcccaggggttctagaccagcctggacaacaaagcaagaccccgtttctacaaaaaatataaaacattagtcgggtgttgtggtacacacctctagttttagctacccaggaagctgaggcaggaggattgcttgagccaggaaatcaaggttgcagtgagctgtgattgcaccactgtattccagcctaggtgacagaatgagatcctgagatgccccttaaagtaactgaatgcgccgagtatggagcccaggaggcctcattggtcagaaggagacccattttgtggcaagcattgattgctcttaaggtttgcaagatagagatgacctcggcacccacctgctcagagctctgaaacacagcagtgagccagccacagaagcagtgcgggctcctttctcttgctgttctaaagggatgctgttttgggggctccctgaaaccactcccaggattggtggtttgctgcgaggacccccaggactcaacatactcacagctaagatttctaacagcacaagaatttagtgcaacattagcaaagggaaacggtgcacacggccaaatccagagcttcgaaggctcctctcccagtggactctcacaggccatgctgaattcttccaggaataagttgtaactatgcctgtgaagtgttttataccagggaagctccatagagtctcagtgcccagagtttttattgggggttggccgtgtaagcacccagtgcctagtacaagccaaaactgcagacccccagaaggaaagcaggggcacagcataaacacactgtttgcacaaacaagtgttagcagagtgagccgcttgcgtctgttaggggagggtgggaactctccggaaatctaaaatctcagtcgctagccaagggccggccttgcaagcaagcctctgtagggagatcagcctcgggcctgtggtgttagcaccttcctacacagatgtgtggccgctgctctggagccaactacatccctttgtgcactggagccaggccaggccacatgcgttacccagggctctggagtctgtagagattccgattttccagattcccacctgattcttcgtgggtcgttttgggtttttttgtttgtttgtttggagacagagttttactctgtcacccaggttggagtgcagtggtgcgatctcagctcattgcagcctccgcctcccatgctcaagcgattctcctgcctcagcctcccgagtagctgggattacaggcatgcaccaccaagcccagctaatttttgtatttttagtagaaacggggtttcgccatgttggccaggctggtctcaaactcctgacctcaagtgatctgcccacctcggtcttccaaaatgattcttcattttctttcccacctccctcctctgtgtaactcagtcctgatgttagacgtggcctcttaaaacaaagacagatggccacccgcagagctaatagactattggaagtctttagactggcttaaagtggacagaagtgggtaggtgccacttcccttaagggcaaatgtctgatccgtcttgaaggaatccctaaatatgtgggacgaaagttaactattctatcagctgtccctggggcattgtccaggaggagatctgagtgtctttcttgtcatgcagcttggggtgcttaaatgatgttctgaatgggagggctaactgcaacaaccatccaaggcagaacagccatcggcgcctggggagggctccaggcaggggacatgggccctgcaggaaacaagaccatgaaccgaaggtcccgtcgaggcacgattgtgttagatgcataggcacccacgtctgttatattccatgcagtacttcagcagggactcctcatacaggcagctcagagagtgagggagactcagggaggacgctgtttctgctctgctgccctggagagggagagccactcctgcacagcttgggacccacaccaaacacacctctcagggttgccggtgaaatttgttactggtgttgctttaattgacactgttgatgaaggtgctgagcatacgagagacaaaaggctcccaatgcaggtagcacgtgtactaggtcctccagaaagtgttcttcaccccaaagggaaaccctgtacccattccatctttccctggcaactccacctacagcctgtgatctgtgtgtcatctccatgccagacacttgctactctgtgctctagactgcaaatcaaagcaggtggctagtgagaatagccttcctaatggagttccgtcacgtttggcttaagtgccaaaacctacctttgtaggcaggaaggatgctatgacaggttcacagccctagacacgcagaccccggggggtgaggcagggatgtctaatgcagaaagctctggcttctgtttttcagagaaaaatatgcccgaggtaaacatcaataaggttcctctaacacttgtgtcttaagaattcatctgtaaagtatttcagcagaaaataatctttcccaaagtgtccccaggccctatggaagggtttcctacccagctgacccaggaagaccacaaaccacattgttctgaattgcgtgagcttctcacctgtgatctggctggccatgaggtagacccaattcccgtcggcaggtcagacatatctaggcgttacttgctctctttttggtgtcaatcagtgtgttaaagaacgttcaaaatgaagagaaagaagctcgctcttccaggtgaaacgcagctgggaagagctgtgaggagcgcctttctgtggctgtggcaggtttggtgtttaatggggcgataggagacattgccttgccccactagcttttccccagtaacacctcgtgggggcgcccttggtcaccgtcggcaggaagccttagctcagagcctcgtggtggagtgaaactcggccgcagaaaggaatgaactattgatgcacgacagccaggagagatctcaagggcattttgccgagtgacaaaagccagtctcagaaggttgcatgctctgtgctttcattgatgtaacgttctcataatgctaaaatgctagaaacctgggacccgtcagtgctgtgggagttgagggagcatgtgaggaggttgtgtgccgatacagtagctgagggagatcttagtggcgacggaacacttctgggtctcagttgcagcgatacacatctacccatgtgataaaatgacagcactctacaggcaaattgcaccagtgtcagcttgccagcgtcgatacaacgctacggctacgcgaaatgtaaccctcaggagaacctgggtgaaggagacacaggacctctctgtgttacctttgcagcttcctgtaaatctctaagtatttcaaaaggaaactgactggctgggcccagaagaatgagggctattgaaccaaactggcctatgcatgggagggagggcacagaggcccccagtgtagctcagccctcttaccggccattcacccacatggttccaagcattgtggctgcaggagctgactcagagtggggctaaccacctgagcacgggggagcctctctttagatcaggaatgtccagtcttttggtttccctgggccacattgaaagaagaattgtcttgggccacacataaaatacgctaacactaacaatagcttgatgagctaaaaaaaaaaaaaaaaaaaaaaaaaaagaagaagaaaaagaaaacaactcttaatgttttgagagagtttacagatttgtgttgggccacattcaaagccatcctggaccgcgggttgaaccagcttgctttagatggaggagtcatcagatgctggtcgccatctcttggaccgctcaccagattgtcacatttccaggtatattaatcacatgccgaaatgcagaggctggaccagaagtttgctgtttagctcaggcgatgttgtaaacgagaacgaagaaaatgcgtcaagaactgtggggctgtcatgaaacacgctgctggggatggaacagaagagatgatctcagatgtggaaaagaccattgctgacacccgcgtcctcccacccacaccttccgcctgcagggggagctggatggggaagcgaatggggtccctgtgcttatggaggataaacacatggaggcttgcacctcttatttgaagaccgaggaagaataggggcaattgatggttagtattcagagaaagctggattcttctcagttcagcgctgactgcctttaagaaacacacatggctgggtgcgttggctcattcctgtaatcccagcactttgggaggccaaggtgggagaatcacttgagcccaggagtttgagaccagccagggcaacacaccaaaaccccatctctgccaaaaacatctttgaaaaaatgagccaggcttggtggcgtgcacctgtcatcccagctactagggaggctgaggtgggagaatcacctgagcccaggagattgagggtacagtgagccaagattgtgccactgcactccagcttgggtgacagagtgagatcctgtctcaaaaaaaaaaaaaaaaaaactgggcatggtggcacacatgtatagtcccagctactcgagagactgaggcaggaggattgcttgagcccaggagttcgaggctgcagcgagctatgattgtgccactgcactccagcctgggcaacagcaagacttcatctccaagaaaaaaaaaaaaaaaaaactcacataagatgagtttctatattggtcgattggtaaggacatggtggccagagcctggcagaagctaaccctctctttcccctagaagcaatgcttcattattggctaattcagtgtttacagctaccttggagaacataacttggcaaataacagaatggaccatagtatctaggaaaaccaatgagagttcttggctgggcacacttgtagagttgccctaaccctgctgcctcctctcctgggggcatcatggagcccactcagtagctaaaagtaatttccatgggcttgcatgggaagcgcagggttacgagaggtggtcagatgcggacgactagctctcgaagtcccaagctctctgccccgtaaggcattacccccttaaattagcatgaaccctgggaagggaggcactgtccctccatttcacatgtaatggagcacagtacttttcacacccctaaatcattccttttgatagtcagggttccggacacggggctggttgtggaggtcctctccacacaagaagcctcatgatgatccttaataagagggtggggttgctcagaaccttcaggggaagggaagagatcaccagagaagggaagggaagagatcaccagagaagggaagggaagagatcaccagagaagggaagggaagagatcaccagagaagggaagggaagagatcaccagagaagccgcctcttcccctgtgcccttctgtctcggcatcgcatggccttttctgctgctcatcagttctctggcatgaggtgggaagaagcccagggaacatgatctgctggtgtggcccccgcagtggaaagagaccggagacctgagcacagcgcccttcctggcccctaggaaggcgggtgacccctgcagtccgtggacgcctgagaggaggtggaacagatgctcgctcccagccgcagacccactctctgctagaggacaggagtgagcagttgaagccatgcttccccagaagcagaagaggatgagagtgcacgggggcccccaccgtgggaacttccacacctccagcgcactccctgtcccgggcactgctgatctcctgagatgcctcggctctctcccccttgtctggggctgcttgcaacatccacatctgtagctgagactccaggaagccgtcaacctgcagctgcacatcagtaaagaggcagaacgaggaatgaggtccatttgctaggacttcagtgcccttgctgtcacctgtgcttccagtgcctctcagggcatggtccagccctgtggaggcagacgctctgaggacagaaccagggcctggcttttagcgagtgccttggccattttggtacattgggaagttgttggattcccagctgccatcctagaaaataaatcagaaggtagagaatgagacccatagctgtaactaaactacaaggggaggtcagctccccgttgttctgtctttgtgaccctgaaccacctggacctgagaaaggcccaaagtcagggagggtgtcggtcacaggccctgaagtgtgcgttccgtttcatcccaaaggggtttttattgaccctaattatcccctagtcaaggggatgccttaatgtgttacaggagagtttttttcatattgaggtatcttgaacataggacatgaaatctttcctctccttttttctcctctttgtccaaaattaaatcaaatgagctcactgcagagatgccgctggaagcagcaaggtacagagcaggcagggcggccctctcacctgcccttcttaactgtgccatgggagcgggagattctgcaggctgtggggtgcaagaagtgtcacggagcctctctcccaggacatcttgtcatccctgccaacgtggcaggagagggtctttaaggtcttagaaagagactgtgttcacgcttgagacgtttttatcatgttactaaatggggcttcttggctgggtgcaatggctcacgcctataaccctaacactttgggaggccgaggcgggtagatagtttgaagtcaggagttcaaggccatcctgggcaatatagcaagaactcgtctctgcaaaaaaaaaaaaaaatttaaattagctaggcgtgatggcatgcgctattcagaaggctgaggtgggtggatcccttgagcccaggaattctaggctgcgttgagccatgatcgcaccactacactccagcctgggtgacagagcaggccctgtctctagaataaataaataagtaaactaaagaggcttcttgattgtgctgttcattgttgtaaatccatggagctgtgcaacagtgagtaactccagatgtcctccctccctactgcagcccctgcccttgatgtggactggcagaacaacacgacctttgcctcctgtagcacagacatgtgtatccatgtgtgcaggctcggctgtgaccgcccagtcaaaaccttccagggacacacagtaagtgagagctcttgtcactggtctcgagtttgtgagaatgtgatgtgggagccgattcttgtgtgcctagaattaaaagctactgcagcagcagaccagctctaatgtgccccttggctatttgagctgtcatggttaccccatggtaaccatggtggttggattgactcagtttggggttggcagtgagaacagttcactcagaaatgacctagatggtggatttggcaacaaagcctttaaggtagccatgagaaacatgtagaggacatcaaggaaaggatgctcacaataaatgaatagacggggcacatctgcagtgaatagaaaaaaaaatcattaaaaaacaaatggagactaagtgtggtggcttatgcctataatcccagcactttgggagtctgaggccagaggattgcttgaggccaggagtttgaggccagcctgagcaacatagcaagactctgtctctacaaaaaattttaaaaagtagctgcgtatggtgatgcacacctgtagtcacatcccaggagctgaaggctgcagtgagttacagtagcaccactgcactccagcctaggcaacagagcaagaccttgtctctttaaaaaaaaaaaaaaaaaaaagaaaagaaattgagaactgagaaatataatgtctgaaatgaaagtcttaataggtgggtgtattaggcagttctcaattctctcattgctctaaagaaatacctgagactgggtaattgataagacaggaggtttaactggctcacagttccttaggctatacaggaagcatggcagcatctgcttctggggaggcttcaggaggcttccaaccatggcaggaggtgaagcaggagcaggcacctcacatggccagagcaggggcaagaggtgggaggagtggggggggtgtcacatacttttaaaggacaaaaactcacgaagacagcaagccacgagggatctgcccccatgatccggacacctcccacgaggccccacctctgcatcagggatgacagttccacctgagatttgggtggggacaccgatcctaaaccacatccgtggatttaccagcagatgggagattgcggaagtaaggttagagagcatagaaattggccaatttgaagaacagataaaagatcgaaaaaatgcataaaggcttaatggcttatggaacaatatcagagaccctaaacctatatgcgtgatggggagagaagaaagaatggaacagaaaaatcatttgaggcagtaacagccaagttttcctaaatttggtggaaaacatcaacatttaatccaagaagctcagcaaatttcaagcagaacaaatataaacagaaccacacaaacagaacagaccatatccacctaggcatatggccatcaaacaccagaatcaatgacagagaaaatcctaaaggcaagcagaggctgacaaatccattatataccagggaacaacaatgggaacaacagctgacttagcaaattccttagtttggcctctgaggcgcttcccggtctttcaccaaatctccctcagattagccaatttctatggtctctaaccttctgcaatctccagtctgctggtaaacccatttactagcctcgacctcctgggctagtgtccaaaaattccctgtgcctctgtcctcctaaagacacgtgcagccaagcaccttgccccgcgctgagccctgcctggaatgctccctgccttagacccccacagcagctctcggtccaaaacagaatcctccccagtctccaggcccattcacgtatcctctgcacgccctggggaggattcacggcaccccctgagctcctactgcccacatgaatgccacagccctggcagtagctgctggcctgcgtgtctgcctctcccagaaaacgcagagtgcatcaatgctgggaccatggcatcttgcctttctctcaccagcacccaggatatctctgtggtggggcagggtgggggtcccttgttaaagcaggagaggatggtcacagtccctggagatttgccattgtgccactaacttaactgatgtaaattcccttgtcctgattcccctaatgcccacctctccccacccctggcccaggggtccctgtcccaaaggaaggcgcttttagagcacaggcacctatcgtcctgttaacatctgtttggctccaaactgactctcttctcccggtctaaacttatttctcctctaaccctggactatccacaagtttttaatagagctgtacacactatctgcagttcccaggtgtcctgcccaggaccttgccaccagcacaggccttggccctttaagtgggtcttaatgtggctgatggccctgaacaaagctccagctcagtggggttgagtggagacccatgagccggctctggaggcggcccaggaaccggggcttgcattgcagagctagggatccgctcccaggaagttatttgttcctttgcatgggcttggctagggacagccagtggtgaccagctctacattcctgggcccatgagttttcctctgaacagctgcagtcagagccacccttgctggccttgcatacacattcacactcatagacacccatgcgtgtgcacactcacaaccctcagccccctctccagtcggccccctccaccctcccgggctctcgcagcagcctgcccctgggccgcgaaacttcttcctcctccctttcctgggccacgtgtgcctcatggaacacagatgtggccttgtcactgtccagttcacacccttcaaaactccatgttcttagaaagcaacctgaccatacagttaatccaaaccggagcccttaggagtatgaaatttagaaaattcattatgagtgtgtcattagttaattgttaggccgggacagcaggtgtcacatggtgggactggactggacatatggggccctatagtcacccctgagggagccccaagctggtacgccatgtcccctcatttctcctgggtaggctgttccccagctgaacctttgccacaggtggttcttttacacatgcctgtcccggtagtgtccccgtctcccttggcccctgggtacattcattcacctttatcctccagggtttagcctcgtggtccccaggtgtcctgagcctgtgcttttcgctacctggctgtgccgatcacgagcccccagccaggattttgcctgtgtcatgtgtgtttgtgccactcagcatttgcctctcacttgtgttgcacatgtgtgcctgcctgtgtgtgcatttgggtcgcccatcttccacctggatcagcccttaccccgcttgaactccgtaataggtgagggttcacttctcatgtttacccctccctccgcctccactcacctgcaggagagaaataccttctaatgggtgtggacactggaggaactgttacattaaaagtgcataagaggcctggcatggtggctcacgcctgtaatcccagcactttgggaggtcgaggtgggaggatcacttgagcccaagagttcaagaccagcttgggcaaaaatcccaaaaaaaaaaaaaaaaaaaaagggcatggtggtgcctgcctgtagtcccagctacttgggagggtgaggcaagaggattgcttgagtttaagaggtacatgctgcaaggacctgtgatcctgccactgcactccagcccgggagacagagtgagaccctgtctgaaaaagaaaagtgcataggaaagtgattttcaaaggccaatttaaaaagtaactggttttactggttttatttgctgcgttttatggtatgtgatttcttcacttgccttccttcctagcagggaaggtttttttcttaatgaagtatggatgagagtggctggtgttgtgtggtatagggctgtggttttatataaatgaaaaaggcaaagtgagaaaaagaggaaactagatggctggttgggctgtgccctttgatgtcaggctgaagccgaagaccttctgcagcgccggtggcgcgctgctgccccctgctggaaggtgacctcatctactcacaggccctgatgtctttttcacactcttctgctctctttcagaacgaggtcaacgccatcaaatgggatccgtctggaatgttgctggcatcctgctcggatgacatgacattgaaggtagagtcggcatggcaaggggtgggctgtttaatcctagacaaccccgggcacttgatgccagtctcacggtcactcttacatgaggattatttattactgaccaccctcccttcctctgtcatccggtgagctacgatttctcagtcatagtcccactgagaatcgcagcctccctgcagcctttctcaccactgtgcaccctccaccctgccctgggccccgtgtgcacccccgggaggaatgattccacatcgttcccggatgcaggaatggcttttgctcatgttgtgtctggtgtgttctgtagatctggagcatgaaacaggaggtgtgcatccatgatcttcaggctcacaataaagagatctacaccatcaagtggagccccactgggcccgccaccagcaacccaaactccaacatcatgttggcaaggtaagggcaggcaacacagctggcacagctcggtgttacacaaagacaacaggaaattctgctaaagcgcgtccatgcacgtgtgttgaagcccttcagaggaagcaaagcggtagctcactttgaaggggccaggatagaattaccgagtaacacctgcctttgaggtaaggatggttttgagtcaggcacagtggcttacgcctataatctcagcaccctgggaggccaaggcaggacgatggcttgagcccaagagttcaacatcagcctgggcaacatggtgaaaccccatctctacaaaaacttagccaggcgtggtgacgtgtgcctgtagtcccagctactcaggaggctgaggcaggaggatggcttgagcccaggagattgaggctgcagtgcgcggtgatcacaccactgcactccagcctgggtgacagagcaagaccatgtctcaaaaaaaaaaaaaaaaaaaacagaagaagaaaaaaaaccacccaacatgactgcagagccacagttgagggacagcaagccaggcagcaccaactcctgttgacggtgctcgaattaaggtcatctcttagagaggacaggatggaattcctgcatccactgagagacggaaccaaaaaaacaaagaacacataggccgtaattctcatatttcaagtaattgtcataaaatccacttaaagtactgtgatatagtgtgatatagtactacacactcgagttgttttgtgatgactcagaaggtgcttttgcgtcgcgtggtactattaggagcataaattatccttttagtcagcaagtataaaaggggcatcccggtacctaatgggtccctgttgaaagaaagcaagccagacaatagctttgtgatagatattactgttctaagtttgaaaataactaaaatttgcagctttcaataatgtgattacgtatgtggatgtgattgtattttaattcttgtttgattaaaatttattttctatttagagacagggtctccctatgttacccaggctggtcttgaactcctggcttcaagtgatcctcccaccttggcctcccaaagtactaggattacaggcatgatctactgtacctggcctaaaaagttttttaaatgtttattcacttaatttgctatttttccaaatatggctgtctgtattaatttagttggtaataatagatgtcatgttttaaattgtaggggcattttaggaaacttgataaatattctacaaaaatatttaccatttacgtctataggaaacatagaaacagggctgggcgcagtggcttacacctgtaatcccaacagtttggtagggtgaggcaggaggatctcttgagcccagaggttcaagaccagcctgggcaacacagtgaaaccccgtctctacaaaaaataaaaaaataaaaattagccgggtgtggacctatggttgcagcttctctgctgaggctgaggcgggaggatcacttgagcccaggagttcgaggctgcagtgagtcatgatcacgccactgcactccagcctgggcaacacagtaagaccccatctcaaaaaaaaaaaaaaaggtgcagaaacaaatgtagatatcaaattgtttccctaataagaccattaaagctttttttctgtttaatgactatggctttgtttttaatacttgtaagtagttacagtttagaagacaaaaagctttttagttattatcttttgaaacgtaaaagctgggaaaaacaactcctggagatctgatacacattatggagaactgtttgaaaccaccgtgtgtatgtgattttgctttctctcccaccttgctagtgcttcgtttgattctacggtgcgactgtgggacatagaacgaggcgtctgcacccacacgctcacgaagcatcaggagcctgtctatagcgtagctttcagccctgatgggaagtacttggccagtggatccttcgacaagtgcgtccatatctggaatactcaggtaagctcccgacccctacaccaaatccttttagtaagggatgcccaaatagccacgactccagtgcccttggctcagagcagtgccccggagggagttgagcaagctcaggctccccgggcagacccagtggatgctgtccacgtgcaccccacgtgggctgtcagctcttcccccaccagacacctccggcagctcccctccctgaggaagggcgtcgtgtccaccgtaatcatggctcttggccatttgattccaaaccctcaccttggcacacgttcttccttgaaggagccgctgtcttctgttcacttttctgagtccatggcacgaaaccttccacctgcctcttcctcttcttagcagttatcaccgaagtgctgctctctagatactgaggttagaaggtgggagtgggggaccagctaacggggtcaaggccacaccagctcctgcagctcccttacggagcagaccagggagtgggaaggaatgtgctcttgctgttgtcatgccacttcaatttttcttttctgttttgttttgttgttgttgttttttgtttttgtttttgtttttgagacggagtctcactctgtcacccaggctggagtgcagtggcgcgatcttggctcactgcaacctctgcctcccagattcaagcaagtctcctgcctcagcctcctgaatagctggaattacaggcacccgccatcatgcccagcttatttttgtatttttagtagagacagggtttcacatgttggccaggatggtcttgaactcctgacctcaggtgatccgcccacttttgcctcccaaagtgctgggattacaggtgtgagccaccgtgcctagcctcaatttttcaaatcaaagtaggttctgtttgaggacataaggtatgtcaatattgggttgtccttttagcagggattgaaaggacataggatttaaataaaggtggctgctgtgggtatcttgggccacacctgaggatagaagaattccagctgtaaagtgtagaaatggatgggaagtagcactgcatagcataaaggattgtatagggccatcagcacgtgattctagtctaagggaagagagaggtgataatatgctaggagctgttgaaaataaggaaggggtccctttcgcctcaggaggggaggaatcacacagccttccccctgccccctttcatctgcactgccttcttggttccttttggcttggttgacattcaggtggatttataccctcaagttcattccccctgtggactcaatggtgatgagccctgttcactggcaaggggtccactgagatcacaggcttcccagggacctcatgtgaaccacatcctctcagggaaggaagggaaatggtggaccctgcgtagagccaacccgacgccaagcccagccccacagccctagatagctctccgggaagcacgcatctcagcactagtgtccaagagtctccgttcctgaaatcctcgctagaaatagtaatgggtggatttgtaaaaagaacacatcaattatcaaaacaatgacatgatcagttaggtacagcctgttgtcaggaactcactgaactgtttcaacccttttttataaatcaaagaaatccttaggacttttcttttttttttttttttttggatcggagtttcactctcgtcacccaggctggagtacagtgatgccatctcggcccactgcgacctctgcctcccgggtttgagcgattctcctgcctcagcctcccgagtagctgggattacaggtgcgcaccaccacagccggctaacttttgtatttttagtacaaacggggtctcaccatgttggccaggctggtgttgaactcctgaccccaggcaatctacccacctcggcctcccaaagtgctgggattacaggcatgagccaccgcgcccggccaagaaatccttaggaattttcttaagagaaatcttaaagcccactttaatctttctccaagtataaaaatacttatctgtaatactgccgacacacacctttctcagttcatggaacaccaccctttaaggggcccaattgagcagaggatttgggacagccctcctggtctcggtgttcagatttctcctgcctgtcaccatagtgaatcatgagtgaaggcttattcgactctttctctcttttttattttttaaaattaatttttgtagagacgaagtctcactgtgttgcccaggctagtcttgaactcttgggctcaatccgtcctcccgcctcggcctcccaaagtgctgggattacagggtgagccacctcgcctggccttattcaactctttcaaaggcctcaacttcccctacctcttagatttgtcaagttaatgctgttttaaaccggaaaccaatggtctgtggtgttttccattacatgtatattatgcatttcttctttcaaatgtccaaaaatacgtacattttaatgtcatggcatattattacatttaatcatgaattacagtcaatttaattgctactggggtgggtgtattcattatgttgtattcattcaggtcctccaaagaacagacaccagaacaggattagatgggcgagagatttattgggggaaagagctgtgatggaaacagggaggaaggtagggggaagggagaattcagaccataaggccagtctgaccctgggaaggagacgggaagggtaggaagagtcagggatggcccttacaggtctgtagaaagttttggtcgtgctgatggagagtccatgagccacttacccaccagatgagtctgagtctcagcaggtgactgccatggtctcccgcctccatcagtcctcagctgggtgcagcctcagaatccacgcaaatgtggcagattccgcaggcataagtaatcaggttcactcctcgtggtgggaagtcctagaggcacatctccatggcccccagagtccttactgaaaacccttaaatttcaccatgcttgaaaatgttcatgacgaaacgtcagggccggaggagcgcacattccacacctgcatctgtcgcaggcgccccttgcgttgtaagtgacagctgctttgctttgcagagtggaaatcttgtccacagctaccgaggcactggcggcatcttcgaggtgtgctggaacgcccgaggagacaaagtgggtgccagcgcgtccgacggctctgtaagcaacacctctggtttgctggggagtggggtgttgggggcagctgatgcctaagtgagcttccagggcgtgtgcagcattcgtgtcctgaagggcctagcccagtgccaaaggaagcttctgggctggatcccatcggagttggtaccacatctgggaatggccttctccttgtcccttccagagtgtccttctagtcaacattttctcagtcaaattggtggttctcaaccagggtgattctgcacctctaaggacattagacaatatctggagccattttaggttgtcactacagtcatgtgtcgcttaatgacgggaacgttttgggaaatgtgtcattaggcacttttatctttgtctgaacatcatagagtgactgacacaaacctagatgataatacctgtcccacaccgaggctgtgtggtacagcctattgctcccaggctacaaacctggacagcgggtgaccatactgattcctgtaggcaaccagaacacaatggtaagcatttgtgcgtccggatctatctaaacatagaaaaggttcagcagatatatggttataatcttacaggaccactgcggtctgtgcggtgcgttgttgctggaaacgtcattatgtgacgcgtgactgtgcttagatgaggatgctgctaaacctcctactgtgcacagggtggccacaattgtcacccatgctgtggctgagaagcccgggcctctggtggccatcctgcaggtctcctgggccctcttctcttcccatggggcatctggatttcttattttcccctggacttgaggttgccctgacctctggggcaagcggccgttctggctgaacggccaagggtcagagtagtccccaaatgttgtcagaggctgtgtacttgggctcgtattgtcatctgccccacgattgcaggtgtcccttctgggacctctgccactctgttaattcctatcattacccttaacctggcctttctgctctgtgctgtttgcttcagtttgctcggtccgatgtccagatgccagtctgttatgagagcttctctgacccttcatgacgatgttccaataaactttactgacaaacatcggtggagggctagattgggcgtgggggccgtagcttgccgacttctcactctaaaggcatctttgtattgtctctcaagatgacaggtgctttatctttccttccaggtgtgtgttttggatctgcggaagtaaccacaaaatattatcgaaaaaagaaaagaattctaatgaccagccgtgaatgtgtagggttgcagctctattctccaaaactgtaggaacttgacttgcgttagagtgtactctgaaaccaactcgtctctggccgcaggagtctatatgttttcgtaatcttcatcaagaagtttttaaaaggcaagcaaaaacagaagcaaatcatatcaaacggggatagaatggtttccactgaggacattcagcctgggaaggaggaagtcaccagctcgaggcgtgtggattggtttccacccggaacaggctctgtgatggctgaatggaaagaaacgtaaaaagctgtgccaaaaaaaaagcaaaatgctgtgataaaccaaacagggaagggggaaaaaccctcctccttgggattttttttttttgttttccctaacaatttggacactacaattgctctcacaaaggaggttcaaagaccagtttgtaccgatgaaacgcgcaactttgtaatcccaacactttctattttctagaatcttctttgttcattgggtggtttttcagtcggctggaattctatcttctgggggccttccgtctgagatggaagctgtcttgggcttgttgtctcttccttctgttgctccctgcccctccccctgcctttccactctgtctggtgagctctgctttttcagtgcaccatcaagagatgcagccccgtggacatgaagacacaatctcccacggacagctttcccccttccgccctctcccaccctctcctccccttgcgctcgcgctcgcgctcgctttctcactggcgtgctctctttctctctctctctccctctgtacctttctcatagttgcttcagatcttaggtctcaagggcactttggcgcgtagtaagtgctttatgtaagaaggcagggcaggggggctttttacaggagaaaaaaaaatgacttataagagaaagagcctggagtatttttggaaaaaaaaataatatttttatgttaaaacaattttaaaatcttaaaatggccatcagacatagagagctttgtgtgattcatgttttaaaaagaaccgaagaagccacaggcagggcctgagggagcccctggctttcccctcagcctcaggaaaggtggtcaggaaaactctggctggacaagggtcagtcttcggggtcagcagcgagattgctctgcagccagtgagggaggtccccgccatgccggctggaagaagaacctcgcatcttttggtgtgtatgcaccttggcagccagcaggaaagcagcgaagagccgcgcgccctctggcctcaagggagcattggcagaaccataaggtactgcagaagccgtcgaaaccgactgctcggctggattaggcgtgttggctacatctttcccacaaccgtataacgaccgatggtcatttctccaagagcaggcttggcgagtccttgcagagctgacatagaggcgcccgcatgtcacttagtctaacgctgacagaaatgaatgcagaaggaagattttcagtcctgaacgtgaattatagaggtagaacgtcgctaataatttctgccatctttataatttctttgtctcacagaagactaggagaaagatcttttttaaataatctttttgctgtttttaaaaaattaaacaaggctttgtgttcctagaagagcttcatttcagtgaatctggtgacctccatctgcttgctgtcataacccgacacggacttatttttgtcattagcaagggggaaaaggccaaaggacaagggcctcttctcccattggttttcctgtgggcagaagggctgaggaagatggcccagcccgtgggggctgctgggtcaccagcagtgggtagggtgcaatctggtgtgtgttccagcagtgagacggtgttattgtgaaggtggcattcatctgcggagccaaaacccagccatcggggaagggtcagggcttctgtggaacttggaacgtgccaggaccacctgcaaaagccagggtgcgttgatcattctcagatcattgattggcctccacttgggtatgtgaattattcatgtcccagaagaccaaaaagtgctctggttctgagatgagtattttattcgtgttctgtttccgaaacacttagcaaagaaggtcacagtgatgtggagtcgccgcacccatctttgaagatagccagtgtccctggatgaggtgatgatttcccgtcccaaggactctgtgaagtttagagtacagtttgttggggtccaaaagacaccatctctaccccacccaaataaaaatgcactcatctctgtagaacatctgctgtcaaaggccagcctgtcgttagggcatggcttatgcttgacaaaccagtaacaactgtgggatggcgatggtgggatgtgtcgcaagcaattcactagacaatcttcacatgaatgtcggtagccagggtctctcccgagggatggctttagtcttgatgaatgtgaaccatgtcggaattgttaggtagaaacctgggctgggaggcctcggaccccaggctccatccctggcttccccagcctgcggccgcaagcaaaaccaagcgcgagatgcagctagcacccttcatatccatccccgttctcagcgggacaacaccatggacagccgttttcagagcctccagcatttgcacaccactactcaccctctctgctgctggcatgttggtagagtcatccctgtaatcaagaaatggcctgtggaatgttattgttcaacgttgtttacagctcttaaaacatggtgaggaatgcctaagtcttagtgaccaaacgtgaccttgaaagcagacatagcatgacagaccttcctagagtgtttggtcgggttcacagtgaccgagagtcaggtccagcacacacctgggaaagggatgctgccccaagggggaccaaaagggccggacgttacagggtgaaaccctctgacccctcgcgacaccgtaggacttgacttttgtttagtctttctaagaaatagatcatggagccaagtgaagtgcactttgtcaaatgtaagggtctgctttgttcttgttgcttttctgttttttaaccttttgttccgccatttaaaaaaagaaaaaaaaaaagcttatgtttcttgtcaaatgcagaaatgttccttccgccactcactgaagttttgcattctggcttgtgcagtttttattgtctgtgtcagacgtacagccagacatgttctctattggcatttttccgattctgttcagatgacagcgaccgccttttcattccccccgccacctgtactcaccctcacgctctttgaagaaaaaaaaaaaaatcaccttgtgtgttgtagctcatttgtttcaagagagaatcaacagatcatattcagtgtcttgaataaattgctctattttgatatt

SEQ ID NO: 36000 - DNA, 254739 bp, Homo sapiens; identical to SEQ ID NO: 35999

SEQ ID NO: 36001 - DNA, 254739 bp, Homo sapiens; identical to SEQ ID NO: 35999

SEQ ID NO: 36002 - DNA, 30851 bp, Homo sapiens
ggccgtgagaacacgctgtgtggctgaaaagtgaaggcaagagctgatttggcctctgtgctcccctccgcaaggggatcgttttctccaggtacgtgaatagcccggagaggtttggccgttagctgccatctgccaggttggaaagaatgtagggacgttctccgagagcctttggttaggccttaggtggcggagacagcagcagcgcgtggcagcggttcctgcgggacagctggaactgatggagcgcgggcgacgccgagagcttgggggcgcctcggtcttcccctccagccgacccggctgtcgccgctgttgcctgccacacccgcgagggacttcgagaatggacctagatgccgtagtctccactccccctttaccccactcccgccctgaagctaaacctgctggagaggaaggcacctttagaacttacagcactctctagtacccccacactcctccagcacccaaaatggatatattgtcacatgtgcatatttggttgtgggaagtcgtggcttccacgttttgttgagtggaatgagtcatggcatcttgccgccatgaagtcgaatactcgctgtccactcccaggctttatagaaatgatgcccacatgtcactctgcttttctcagaacagcgtgtacgcagctatgactggggttgtcccaagtagtttcccagtagaaatcctatagtttttttggtacgcttttgtagcactaggcactttctccccttacccgtttttccttttattgtatctaatactcattgagatcaaggttgatgtctttactcagaatacctttattatctcttcagggcttcgtacattgtaggcatttaatacgtattgtgaatgaatgacagccaaagccgaattcccacctcccattaactacataagcttattttctcttttttgatggtaaaaatctataagaggaagaactgtccaaataacatgttttatttttttactctttcccaacaggactgctaactagtcatttatgatagtggcatttatgttgcagtagtttgtcccatattctgagaatattcattgtataccagccacctgacactaatactttgttagtgtaaccaaaggctcagaacctgtatttgaaccaaaagctgtttggggtttgtgagctttttgagaacttagttctcccctattttaaaaaagggagtttttttgtttgtttgtttgttggaagagcatctaacaattgggagagagggggagaaaacaatattaagttagagttcttctaaatgtcttaaacttaaaactctttgaaatcagagccgtgtaccactcctaacttctacgtgttttgtaagactaataaactacaataagcatgggttagactatttcatgtgatactaaacatcattagttaacagcagtctttgaaatgcttttacacagcgttacaattattttggctttagactgtaaatgcttctaagtattcctcacttccttttttcctctcagctgtaagaatgacactgagggtcattgttctagtgtcaattttgaacacttttgtcttcgaatctgaaatatccgcaaatccttctttgtttgcaggagcctgttaactataatcttcctctccaagctttactgtgcctaggttttctattgaaaaacaagtagggaatccccttgccccaattattgaaactgatacagaaattgaattaaaagtgttcacacagttaattaacagttctacaaagaatccatgttcatttttcttaaatgcattacaatttatcactatttttatataaatcagtttattaaccacttctggtatgtttttattctactgtaaaaatcaagccagggtagtgacatgcacctatagtcccagctattcgggaggctaaagcaagaggatcccttgagcccaggagtcccagtctgtagtgtcctgtgatcactgccctcagccaggacaccatagcaagatccctgtgtctttttaaaaaattgtcttttacagtcttttggtttttaaaatagtttgaaaaattaaatattttagtagtttaacagaaataaagtttaagcaatttcgtggtgatttatcccctggaggggaattcattatgctctttcactgagtaattgtagaaaggcattcagtatttaaattagaatgcatggtgtccagttttaatagcttgctgaagaatcttcatttcctaggaagttgtcatttcccgaataatagcttttttgtgacaattcaagccatctaatttcttcctcttctaatctttacaagacctggaccagtttttagaggaatagagtcaacctgtttattggaataaccctgtacttattacatgaacatttagtctccttttgaatgattttttttttcagtatgtagtttagtggacaactgtcactataaaatattggtaacttgcaagatttctaaagttgttataacctacaggaaaattatttactatatttaaattcatattctcattcatttagcagaaatgcttgatctcctgtgtgctaggcacaggttcagccactggaatgaacaaaaattcctaccctcatgatggatggagtacattctacttggggaggggaaaaatgtgtatgtgtttgtagagagacaatatacatacacacacccacgatagatgtgtgcatatacaccagatatatataaaaaaaatatatatatggaatatatagtatgtcatatagttgagctagggagaaaaataaagcaagaaagaaggatgaagaggcagttgggtgtatttttcggtagtgtatattgtggtagtgtagttacaaaaggctcactgagaaatagtaaagattgaaaggagtaagccatgtaactctctagggggaatagcattacaggcagaaagtgccaagatcttgaagcaagaacatgcctggcatgtgctaggaacaacaaagagccaatgtagctggagccatacaagagctagagtagttggagatgagatcagaaagttaacagaggctgatcaatgcctcattgattattttcaggactttggcatttactcagattgagaatgaagccattgcaggattttaaatagaggagtgacatgatctagcttactctttaaaaggcttcctatggttcctgtgttgagaatgaactgttgagggttagagtagaaagaggtgagggtaaaagcaaagagatctgttaggaagctatttgagtgatgctggtaagagatgatagtgatagcttacaccaaactcatgagatcagattctggatgttttatagcttcagtgggatttgctgttattaggtggaaaagaaaatgacttcaaggatttgggcctgagcaaatggaagactggagttgccatctaacaaaatgggcaagactgctgaaattttggtgaggatatcaggagcttagttgggagattcctcttaagccttccagagatgttaggtgggcaggaagggttcaagagaggtatgctgactaaagatagaaatttggaaatttgcagtatataaatggaatttaaacctgtgagaccagaatagaacaacttggggaatgagtatatgtggaaaaaaatgaccaagtcttagagcactctgcatttagaagcctgggagatgaagatgagtgaccaggaaaacagtagaaaaaccagattagtgttgtatcctaaaaccaagttaagaaagggtttttatctagtaggaaaagtgtttatttgtgtcagatgcaattgattggtcaggtgaattaaggtctgataaccatttgttttagccatgtgaagaacaatgatggctcgaaaagttttgattaaatgatgggctctagagcctagaatggattccagagagcatgtagcaagaaatttgagacattgagtataagcaactctttgaagtagtcttgaagaaggaaaaataaaacaatgggagacgatggggtcagataatagaatgcctgaatgctgataagaatgagccagtggagagaataattgatgaagttaaagacagaagggagaattgttgggacattcttatggaatgtcttctagtgtacaaatggtcttagccagggaaatacatacagtgtcattgctggttggcataagggtccatttgagatgatgaatttaaagggagactagtcagcaggttttgtgtttttttttcacctaccattttcagctctatgtgtgcaggtgaagagtcgaatttaaccaagattgtgatttagggtattttagctgggtgagaaggaaaataaaaacaccaagagctgagggacagtggaaatatgatagaatcaagagataatgaaaggtttgaagaatggaggaatcagagttgttggattgttgtgtagtagggggtgaactaaaaagataagaatggtggttggagaatggagtatttgaagttgaggttatagaaggattgcaattactggtaatgataaggtctaggatgtaaccagaaaaaatgaatggctgtggtaaggtagaagacaagctgtttgaggagaggggttaaatgagaggacaggagggtcatctgtgagcatattgaaatcgagaactatgtcaggagttgtaaaagagtgtgtgaaagttaacaggggctgaaatcttcaaagaatgaaagggagtgatctggtggtcactactaactaaagcagttagatagttgagatgcaaaactttttagggaggagggagagataatagtctaggacagcgtcgaggagcaagatctcttatccccatccaagcctaatgatattgatgggtgtgaaaaagacttgagatgtctacaaagggaagcagtctattaaaaaaaataaaataaaatcaagattgattatcacagtaagaaaaagacaacatgatctctttctaaatggataatcttggtttcagattcattcattacatattggaataaacttgagtattaaggcaccttttggaattttttactttaatcaccattctaaggaaattaatttctgaaccactaagcccaatattgtgaaagatttttaagttaactttgatcttaatgctgtgtagttgattaaattggaatatcaagacttataaaagctttaaaagtgagcatagtatatacatatagttatttggtctccttttaatttcattgctattatgattatttgccatttctgtcagtgtcattatagtcagatgtacacgacgtgaagtaatgcttagtttgggggaagagcttgtgggatttcccccatcctgcttcccctttttcagttttcctggctattaataattctttttccattagagctttagatttgctttgtctgggttggttggggtttttttttttttttgagactgggtctgactctcatccaggctggagtgcagtagtgtgatctcagctcactgtaacctccacctcctaggctcaggtaatcctcccacctcagcctccggaatagctgggaccgcaggcgcacaccaccacatgtctggggttcttttgtttgttttttctcatgagattgaattaaatatataaattcaggaagggtttaaatctgtgatattaactattctttattataaaaactgagatagcatgtcatttgttcaggtcatttatatcatttggtgttgttttaaagttttcttgtgtatatatcttgttgagtatattcctagatattttctttttgtcgctattgtaaatgacatttttttctttccttatataaatcttctgattaaagtatatatgtaaaatttgattttcccaaccttactagattatagattattttacaatttttacatttgtcaaaatttatattttttttttgcagataatcatttcatctccatataatgatcatttatgttttcctgtctttcatgtatgcaaattagttcccttaactaatggcattaaatttgttgatttttctttcatagaagagctggatattctttcgcccagttatggcagacaagttaacgagaattgctattgtcaaccatgacaaatgtaaacctaagaaatgtcgacaggaatgcaaaaagagttgtcctgtagttcgaatgggtaagctgttctgtggatcatttaagtataaaagaaaaccatgaaagaaatcaactggtttgataattctttacggacattaacataaactttgtgttcaccattagtttcataaaactgtgaagacaagaaaagtagtttgttctaaatttcttttattgctttgtgactgaaggatcatattttttaaagaaagaccaaattttagaataatacatcaatatttaaaagtgtattggatgtgaactcaaagcagagttcagcttactgatcttgaaatctacaaaatcttataattactttaatattatatatatagtaattaattactataatcaatgggggaagggttacagtaaactttgacagtattttcatatttaaaaaatgaacaaagagcttaataagaatgactattcataaggtttaactatattttgaagattagataaatttccaacaattcagttgaaaaattattggtagtcgttaagggctatgttaagtaattgtgaatatacgaatgaggcatagaattactgactcttagaattactgaaacttagaaactttagttgtcatctgttattgtctcctttgctattcagaaattccattatccctactaccatgtttaattttagctgtatgttagatgactgcatacctttttggagttttactgatctagctacaatagttcattcgtttaatgctctgccttaccattttcaaggcatattttgttttatgaatttaaaatttaggttaatcagcttaaaaatatttcaggatatgtcatacttttactagcatattttcttccccagtagtaaattaagtaaaataaatatatattaattaatcatctccctgctgccaaacaaggatattcatataagtgattagaaatctgtccccacaaagcactgatttaagacattatctcaaatgtatttctttgtgtggcctttgtttttgaaaatctgcttctgtatggaaatttagaaccagcattgcctaaataacagtgttcggaaaattagaagatcaaaggaaatggcttaattatatcttttcctttaccaggaaaattatgcatagaggttacaccccagagcaaaatagcatggatttccgaaactctttgtattggttgtggtatctgtattaaggtaagtaatattttatttactggatcaaacgtgtaacctaaaactgaaatctgaaaattctggatactatgctataactactttaagtgaggcaaagtataaagcaaatgaatagagaatgtaaatttaggaaagtggtattctaatatcagtgacattgttgcttttttaaataaattaaaccaccctttttaaaagttactcttgctgtactcaactttataaagccatttccaaccaaaatttctcttttttcacctttttataaggacattaccatcacattacatgtttctttcaagtctgtattgaattttaaattcacaccttttaaatagaaatgcacacagccaaaaattttaaaatttaacataattcttctactgtattacacatgcttctattgaatttttcccaatagtataatacttaaaatagctcaattattaatagtttttgttgccttgaatagtttgattaggcttttgactcatgaatggtgaatttccaactttagttcataaaagaaatttaggagctaatgtgtaacatacttaatttagatctttctgtttgtagatattataaaaaggcgcttcaccagaattcagataccacactattgttcaaataaatcgtgtgtatatttcacattggtttctgaatccttgtttaagtatccggaaagatttcatggatacctgaaacattttcacttgctttgaaaatataaacaggaagcattccttccagcaaatatttactaatctcttactagatacctgcctttatcctgggtgctgggaatctggttttgagcaatatagtatctattctgttttctctctttgtgctgtaagaaaattatattaatttaaattttaaattttggatatacacttgagtggctaaaaacatactaatgaggtggtcctctttgagggtggagaagtaatgtataattcctgaacactaagatattataatgtacctcatatatgaacagtggatatttttttccttgtagaattgagtttaaatcacttgcagcatataagcattgtatgtacatttaagagaagaggataatggaggtaactccactatcctccactgtaatatagaaaaatataatttgtaaaaacttaatagttttggttagagggtggaaattactttattagaaaacaagagtaattatctgtttttataatgtataaaatggaaattccctggaatctctaaacacggaaacttagaattggtcccctaagctcattgaacatgtctgctgaacagatctctaataacatgaggttataatttttgcatgtacctctgtagttgtctgtacttacgaaaaatttttctagccatattaccattcttaaatgaccttcctgtttttgctgttcttgttccttggacagtcatcttatagttgaatgttatttgaataagcctatgtgttttattttgttttttaatgtgaattgactccgagaattcaagtatcttattcatataagatagataaaagtcataatggaaagacattaatccccagtctgtgcaaatatgctagctattggtgggatggaaatagcccaaaaaaggataagatccatgacctcaaacgactttacaaggtagaacaggaagtatacaagggcaggaataattgaaggaaacagagggagaacatctgttttggaaagaatataaagccatatattcagtgacttttttgttgacttgcctcttagcctcccctcatctaatatgttttaacaaaaccaaacaaaaaacctcaagttctacaaggtttttcaataagtattaagcactctttaaatgtataggattatacccaacactaaagggaatatcaagttacagttgacccatgaaatcacaggttcaaactgtgcagatctacatacacgtgtattttttcccccaaccaaatgccaattggaaatagagtatttgcaggatgcaaaaccattttagaaagggctgactttttcttttactcaggtgctccagggctgactgcaggacttgagtatgtgccaattttttggtgtactcggcagtcctggaacaattttccccacatatactgagagacaattgatataattctaatgttcaaggaaccttttattttaagtaaatagtagaaggaaatgaaacaacatttcacatctttatgaaatcatgtttagaagattgcttataaaaatatttttaatccattttagttatgtgtatatgtctacaaattaatacaaaaattaattctttactttaaataacagaaatgcccctttggcgccttatcaattgtcaatctaccaagcaacttggaaaaagaaaccacacatcgatattgtgccaatgccttcaaacttcacaggtatattttcacatcaggattcctcttctgtcaagttaagagtaaaatacatttgggattttaagagaagtgcagaaattggggggaaatgctattaaccagtcactaaaggaaaatacaatattataacatcatgcagaatcatactgcatatgtctgtggttcattctggctaacattacagttacctatgggactttttaaagctactaatgcccaggtttcagcccagtttaattacatcatagggtctggaccttagtatattgaaaaagtcccaggtgactctaatatacaactgggactgagagtcactgttgttcctagtacccttatccccaaaataacttttaagggaacttgcctttgattttgtttatccattaatcttatgatctacagagaatatcactttgaatttggacatgtattattaaggcacaaataaatccttagtttgggatttttatctgctgaacactaacactttgaatctaggagtctagatttttactaataaaaaagtatttctcaacctgccagctttaaggggcctactgcagcagggagaaggaagtggaatatttctggttgatgtggcacttctctccttgtaagtaaatggcaggccagaaaagaaagacattgtgaggttgcacctgctgtgtaattttgtaccaaagcattttgttatacattaaaactgggccttatatgtaaagaagaaatttactttaggatggactttgaaaactgaataaataaaacttgtagtaatgttgtttaaggatgcatttctaacaattaacagtgtaagttaatcttggctgttcttttttctaatagccattaatcttggctgtttttttcctaatagccagtaatatctggcatatgtttcttagcttattaatggatggttgtgaagtgcaggtgcattaaaatatatcattctgatgttatgtggctttttctgtgtaaatctgagttgttttattatttttgtatacttgtaacaggttgcctatccctcgtccaggtgaagttttgggattagttggaactaatggtattggaaagtcaactgctttaaaaattttagcaggaaaacaaaagccaaaccttggaaagtacgatgtatgtattatcaccttgtaaaaattaatatcatgagtcagttttatgagattttggggggatgatatgtatatttttaaaatattcttattttcaaaattatttatggaattaatgctgagaaatttataaacaaagctcttttgtacttttgaactaaaaatctgttaatgttacttaactgaaaattctgagttgttaagccttgatctgaagcagaattctgcttgattctgctgtattacacacgtttctatttaatttgtcccaataatgtaaaaatagctcaattagtttttgttgcagtcaatagtttgattaggcttttgactcatgaatggtaaatttccaactttagtacataaagaaatttaggagccactgtgtaatgttcttaagttagatatttttatttgtagatattataaaatggagcttcaccagagtgtgaatgccgccctattaattgttcaaataaatcataagtgtattttgcttttcatttctgaatccttgattaagtatccagaaagatatcttggatacctgaaaacattttcacttgttttgaaaatatgagcaggaaacattccttccagcttaacctcttattagatgcccttctatgtcctaggtgctaggaatctgcttttgaataacataatatctgttctgttttctttctttgctgctatagggaaatgagacttttattaattatgttcgcctccaaccttaagttaaaagccacaagtgttctatttgcatatataatctatttcctgtagcattcatcctctttgtcattgtattattaaattcacatgattctgtattttttttttttttttaggatcctcctgactggcaggagattttgacttatttccgtggatctgaattacaaaattactttacaaagattctagaagatgacctaaaagccatcatcaaacctcaatatgtagaccagattcctaaggctgcaaaggtcggtttttgatagagggaacttaacggatattagtagaagtataaaagatatatcaaaataaacttgttttactttgtgattctttttaatattgaaagaaaatagtaactgtttttggtatattgtggcaggggacagtgggatctattttggaccgaaaagatgaaacaaagacacaggcaattgtatgtcagcagcttggtaagtgtttattttttgtttgtgtgaatatatatttatttattttttgagacggagtttcgctcttgttgcccaggctggggtgcaatgatgcaacctctgcttaccacaacctctgcctcccgggttcaagcgatactcctgcctcagcctcccaagtagctgggattacaggcatgtgccaccacgcccagctaattttttgtatttttagtagagaccgggtttctccatgtcagtcaggctggtctcgaactcccacctgcctcagcctcccaaagtgctaggattacaggcgtgagccactgcgcccggccattttgtgtatatatttcaataggccctgaacttaagtgatgaaagtacacatctttatgtggattactgaaaatctccagtaattgttatatttaaacaattttcaactgaaatagcattcaaacttcaaatgatgacatgcagtatactttttacctggaagaggtgaaatacattgagcacaatgcctctatgttctttgtagatttaacccacctaaaagaacgaaatgttgaagatctttcaggaggagagttgcagagatttgcttgtgctgtcgtttgcatacagaaagctgatatgtaggttactttacaatttttgtttatcttcatccgtattgtagagttttcagttgtgatgctgctaatagaggaatggttttgagagaaattaatagaaatagtatctaagttcctaatttcgaggtaagatgttgaagcagttgtgtatccactactcattttccctgttatattcacaggggaaaatatttatttatttagatagtttataactgataggtgccggaactttttatataaagtcagttattcattatctaagctctctttttttgagacggagtctcgctgtgttgcccaggctggagtgcagtggcgcaatcttggctcactacaagctccacctcccgggttcacgccattctcctgcctcagcctcctgagtagctgggactacagacgcccgccaccacacccagctaatttttttttgtatttttagtagagacggggtttcaccatgttagccaggttggtcttgatctcctgacctcaatgatccacccacctcggcctcccaaagtgctgggattacaggcgtgagccaccacgcctggcctaagccctgtttttatgtgaaaagacttaagctctccagccaggctagcaagctttttaatatctgaagcaagacgcgaggtcttttaaatcactgtagatcactgtggcatgccatgtgaaagagaggagaggaaagtttccttcctttatttagtgtctctcctcccagacatttattgctgctttttccacatttctgccctgttgtccggtgaaggctaactcttctccacaaagtattctataaattcttgaaataccctccaaaaaactatgcttaaatgcagctgacttaagagaaaagctctccaaactacttgagactatatcagaatactttttatgaggagtgaccaatttgtaaattagcctaacctggtagaccctcaccagacctggtgtgtaatcttgctttctgtaattttttccttctacttctgaacagaatacagaaatttttaccattacaagtagactcttcattactattggagatttgtgttgtggttaactcaaaagctcttgatactacagtgctttaaaatagtatgtaaggtagaatgtcttgtctttcaaacttatatttgctttttttttttttttttcatagtttcatgtttgatgagccttctagttacctagatgtcaagcagcgtttaaaggctgctattactatacgatctctaataaatccagataggtaagtagagatctggcatattactgtgttgttttgtttggagatttttacagatttctaaggattaaacactgggactgtcaatgtgatgtacatattttttatcttggttgtttatagctgccacctaaatttacctttctttacctagaacagaggttctcaatgcaagattcatttattaacacccccgcttccagggagcttaggaatattctgaaattatatgcaaattccgtagctttataggaagcagacccttagcttttaccagctatctttttctctctctctgtctctcattttcacacacacaacacacgcacgcacacgcttagaatttgtaagaatcactagagtaattctggtttttcagaatcttgctggacaaaagaaaagaaaattatcataacttctgttagtattcaaaatacgctgtgtttatagggtgcttttgtggtttgtagagttttcagattcattatgtcatttgatcctcatggttatcttgtaggaatctttagatggtattcctattttgcagatgaagcacaaggtcaaaaatctagttgtttgttctaggttacaaatttactgtatgacaaagctgtgaccagaccccaggggtttttttctgtatagtattttctgtgttatactgcctcttctgacttaacaatttaatgaacatccttttaaatacatggctcatcttgcaagaaagcaagagaaatcccaaatggtcaaaaactaaagcattagaactatagaggagtaataggaccagatgttgatggtttctgtaataggtcttgggttttaacatccactcatgggcaagaagcaaggtctagtattggattttcacacataaagtgccaggactctcaaaggactgctttctcactgaaagggcgaattagaaacaacttgtctatcattgcacggaaatgtcaagaaagcaaatatctatcattcactgagctccctggaagtgaagggattgctctgtttcaaatctctattcatgggccagcagctcgcctggctatggaattgaaatttatataaccagtggaatctgtgaacccttcaaagtgagaaagtaatatgtttaaggggtctggaacttttatggtacatagcagaagcaacgaaccaatatgctttcaaccctggttgcacaggattcctataggtaatggctcatgaggacgagctcaaattgtaaattataaaatttataaattagaggaggaaacggtccgcaaattagccagcacatattatatggcagcaggattcaagaactttaggtgacattctaagggcggctattaaataatcttcaaaataaaatctttaaataaaaggattcaaaaccctaaggatataatgctactaaaaaagcaataggtagatgttcagaaacccagacaaatctagaaattaaaagcatggtgacattacagattcactggacatgttagatgggttagggacagcagaaaagtgcattagaaaccagatcttaggaagttactagaatacagcagagagagaataaaattaaaatgtggaaagaaggttcagaaacctggagaatgtaatgaggaaactatttacatatatcttaatagtctgaaaaataaagtgatgaaaggattatgactgagaactgttcagaattgatgaaaaattcagctccttagattcaaggagcacaagttctacagatactaactaattcatgtagatactttgaagtgaaacttagaatatcagtgataaagagacaatctcatgtgagccaaatagaagccataatttttactccatacacaggcattaagagcctgggcattatgataggctctttggggaaggcaagtgtaaaaatacagtcccagtattcaaggacttcacaatgtggtaaagaaaaatacacactgtggtaaagaaaagcatacacatgtaccagagtcttgaaaggaatacacaaagtcaggtcactagttctcaactcaagtcactttttataaaaagtatttttatagtccctttttatactaaaatgaaagtcatagataatatctacgttcatataaaactttaaagatatcaaatcatgtcctaacaataagaggaaaactaaaagaaaatactagtttacagccagtatttcaatgtgtaactgtttagacacatcactagaaaacaaggcatcaggtacttatattgacttataacgaataaatttaaaattaaaagatcagtaactattttgtatagttgcaataggaaagtgaaataaataagtgtagatggacctcggggaaaaaaaaactagttaaggaaaagtaatactacccaagactttcctatattataagagagaggacagtaactttaattgtaatagggataacatggtaagacagattggcatgacaacgtagagaaaatttttaagacatttcacaagtgggctggtcttatttacaggtataaagttaagatctctatgtagtgatagattgatgataaagagtcataaaaagtatatctccattctgaaatttgatgggtcaaggcatacattcagtctttaatgccataaaaagattttggagatcatatccttggataatgaaaaatagaggatgcattggacaaaagaatagagatttaagaagttttatagagtttgacctcagaacattatcagtaacattgaagactaagagatagccccaaattaactgtagggtatacattttttacaacctagattccttactatgctccagatttttatttcttcccaacttctcagaaaacagaatggctgacctaaatcatgtttatattttggacttctgtctccataacctccatttgaaggttggggttgggggcaggaagtttgacctatttttttcttcttttcaaagcaaagtaaaagctactacgtaatacaatgctccctcacactggctgtttaaggaaacataggattttaagagtagagaagtattccatgtaatggattagtgccaacaaagacaccgatgcaagatgagtatcaccagctcacctgggtgatttgccatttttattgataattaccaccattgtggtagaaaacatttccttttaattttcccttttcatcttagacctgctcttattttccaattttccattgttactttttttttcttgccagattactcctgaaatgttttctcatttcattcccttactctagaattgtgctgtagcctctagacaaacatccttatttaaattttaattgaaattaaaattttatttcatcaaactagcaacattcaacttatggctagtagtcactatatgggacaacatagagatagaacattttcataattgtagaaagttctggacagtgctatttcagaacctactactatcttcctcatttccaattagttcatactcttcattttgtcattcaacaacttttttaggtgtctgttagtacacagtgtaagactaaagatcacagaggtgctaaaatgtattaagagtctcccttaagatgtttatgagcaagttatggggtaatcaaaaataataaaagtccaagtatcagtccaaatacttgttaccagtattcaagagtgagggggaaagctcatttgcatattaggaaaagtattcccatagcaagttggatttgagatggaccttaaagggttaggtgggatttcagcaggtaaagatctaggcaggagactacttagaaaaagaatagcttcctagacaccagagaagtagagaagtggtttatttaagaaaaaagatgcattcttcagtgtttcctgtgtatgagctaatagaaagatagtaactaaagttttagaaagtgttgaaagtctaagtctaattaatttaagtgattaatttcatttggaattgagacccacatcaggggacctaaagaaaatgagatatgaaagaaatacgagggcctgaactagaatttaggcaaagaagaaaaagggtgagattgaaacacaagacattgttgagaaggaattcacagactttaacagtttaaacaaaatatcagtgggaataaaatgtcatttttgagggaatgataatttcgttaatacaaatatggagaatttttatttgtgtaggaagctgatacattaatttgacatatgagatgtttgcaggacatttttttaacatgttgaatggtgttcgatatggaaatgggaataaagtgctacataaaaccttcatgactattacttgcgtctaaaacttctattccagccaatactgtatcacttcattcaaatatagccacttaagcttcacatcatatcccattctcattcataaagtgctccagtacccactaacctattttctttctgatgttcactgattttattatctgtggagcatattttgccatgtaatctttttttgttaccatttcatacctattccttgtcttccccagctaaatggaaacgtctcaggttaaggattctgtcctatctttgtgtatgcgtccatcccctactacagctagcatgggacaggacaggtacagggcttaatacataaattgagtagcataataaacagtttaggctacatctgaattaaatctattataattactttgtaacacttatttcgaaatatgtttcttattagcagaatgcatttaattcatatatcaataaacttttaaattggctgattttttccttttagttcaggaaaacatttttaaatatgagcattgataatgagccttactaaaaatgttttatggcttttgcttcttatgtctttatgcttaaattttattagatgtatctctttttctgaaatttccaactattaaaaatagttatgtaagagttttaactaaaatctggtttgattttcagatatatcattgtggtggaacatgatctaagtgtattagactatctctccgacttcatctgctgtttatatggtgtaccaagcgcctatggagttgtcactatgccttttagtgtaagagaaggtaacttgaaaaacttttttcacatatgctgtattctcttctactctaatgcttataaactacattattgatattaagtagttttacattggtctgatatcatccaaaactctagttccttggaatttaatcactgagcatataaggttatatatatcagttgttatacaaaatatatttttttcattttggagaattttctcctggggatgggtagaaatgcaatgttacttttgttgggggttgggaggctacagtaaaagtcctctgcattttggcttctgcagtattactgtagtatttgtcattttcaaattaactttgacaggccaataccagtaatgaaactcttaaaatgctttcagtgttcatcttgttttcatgttttaaatttatctgtaatatgtatactatgtttttggaactaaggctatctaaaaacctaataagatagtttagtaagtgtattaaaattttcatttagtctttgtacttccaagaaaatgagattccctggcctctcccttccatgtctcctccttacctgtgtaatttaagcaaaaatagaaactagcgtaccactaagtggctccttaaaaaaaagtaccaatgtactctctgccttcaatacctttttcctttttttcttcccattttcctttcactgcttccttacttgtgtcttatttttatttttctctccacctgtcttaaactgacaattcagaacactaaaagggctgtttactcaggaaaaaaataccatctcctagaagtagaaaaattcatgtagcctgtagttccctaagaggtgacaggttttttggtttctttctttcttttttttttttttaatcttggaggaatcttttttatacctaaaagctcttttggaaaaataaatttatattgcattataatccttttcataaaaagatattgggagtttttataatttataaaaagtacataaatattaagatgtggggaagaaatggttgtaacttacctacttatacatttgagatagatgcatactttaaagaaaaatttgcagttacctagttttcttgccagtagtcttaagggatgacatcagaacaaatttattaatgttttattcttgtcaattaacaaatatgtattgagtaccttactctataccatatggtagtctttgaatcaagttgataataatatgggtactcggcagtcattcttcacaactccagttataaatgtcatgtctaaaggctgtgccattcagtaaatggtacccagtaaggtttttaatgtgctcgatctattaaaacagcttaagaaactttagtttttctctgttcctttaatatattgaaatcagtgcagcatacttaaaagctttctataaactgtaaaggtgattatggtttgaactcatttttaaattgacaagacaaacattgaagtaggactgtaaagactgacttgctgtgttttttttaaacgaagtcacttagttctttgagcctttattttccaaaataagttaggtatttgaaccaagtggctgctaaggttcctttgagtttatgtttttatgtaattgtttttatttaattttttaacttcacatttataggttttagatagtttaagatcaaaaaacatgctgattttggcaaaataaatgtaatctgttcatttgttctgtcagcaaagatgtattgaacacctgtgttctaggatgaggatacaggctgcatgatgtgtctctcagttccaaataaaatgaataacgtcaagaccttccaagaaacttcagctttctcttcacttaaatataggaaacactgaaatatggattattcattgtttctcaaatacgcttttcatttcagtgtgtctgccattgtagatcttaaaattttattacagagggttcttgtatacaatgtggatttaagttattaaaatctgtttagataatggttgttatctttgtacagtgaagccattaaaaaaatgttaactggaattagctcatattcaatttcatatgaacctgcaggattaatttttttaaagcaataaattataacctcaaaatatgtgcttatgtctcatatgaaattaaatattgataacattgtatattaaaaaatttatcccccaaacttttatatcaatattacatcaatctgaaaatactcttacatatttgtcattttcgctttaaagataaagcaaaaaggacatcatgtgctctcttttgcataaaacctgatggaaaaagtaattacaggataatgagaagatgtacttcatgtggttgggggggacatgcatatatattcatgaattatttaaacttacattaaatatatatagttttttaagttacttctttatatgcagaccaacatgttagcaaaaatccacagaaatttaaagtatatagtctatagattgctcccaagagagcttaggattttggctctaatgatttctcccggttgacaattttcttcccaacaggcataaacatttttttggatggctatgttccaacagaaaacttgagattcagagatgcatcacttgtttttaaagtggctgagacagcaaatgaagaagaagttaaaaagatgtgtatgtataaatatccaggaatgaagaaaaaaatgggagaatttgagctagcaattgtagctggagagtttacagattctgaaattatggtgatgctgggggaaaatggtaagttttctgttttgtgataagtaaaaatcttcctgtttatctagtaaattagttttaactgttttgtggaaaaatttgaatcatatgttatagggctagaagcagagttttatttaaacccacaaatttcttagtgtactttcacatttttttggcattgtgtaattcaatttcactgtaattcaatcaggttaatagttcttattttgttttataacctctagtgaaaataaggtgttctttgtcagctggttttttacatgtaaattgataaggcagttattaatcttataaattgactaagatggaaaggataaatggtgattcagaaataatccagctttaaaaattttttcctcatacacttcaatgtggaacttttcttattttaaattcagagcaatctacctttgtaaataattgtattaccagcatatatttcataataaattgtcataagtgtagatataagatgaatttgactactaaatatgtgatattgccttcatgatttaagaactatttgaattgtaatcttacagcttacaaaactatagaagataaattttatataaagattgttacaatgtatcagtctttagataatgggaattttgaattgggttgcaattaatttaaatattttatataagtaaactttaaaattacagttatctttcataaaacagtctatactgtcttaataaattgtgtgccctgataatttagctaagtagatcttttcaaactattgcaggatttaaactttatagacataccatttattaaaattgtcataagctttgactagtctttattcctcttaattaccttagaatgacacttcagaggtgagccatgaaagacttaagtatttttctatataaacttcagaattcaataatgtcagtgtatatctttaaaacaaatttctcagttaaaaccaaataggacatagtgatttactttaaacgtcaagcatctttcagatcaaactgtcatatgttgtgttgccaggaacgggtaaaacgacatttatcagaatgcttgctggaagacttaaacctgatgaaggaggtacatttgtaactgttgagtctttttactctgttttacacagtaaactttaaagatctgggcagtttttagtgtcttatgtatttcattattttgcaggagaagtaccagttctaaatgtcagttataagccacagaaaattagtcccaaatcaactgtgagttattattttttatatggttactaaagaaaattttgtatatatgcctatagctttcatcttttactatattaaaatttttctccaaattagattctatacagttttattgatagttgcaaacaaatgtattaagagtccaatccttgattcatatccactgctaagaaagtgctttaaagatatttgtcatctttggccgggtgcagtagctcacgcctgtaatgccaacacttcgggaggcctaggccagcagatcacgaggtcaggagatcgagaccatcctggctaacatggtgaaaccctgtctctactaaaactacaaaaaactagccgagcgtggtggcagcgcctgtagtcccagctactcaggaggctgaggcaggagaatggcgtgaacctgggaggcagagcttgcagtgagtggagattgcatcactacactctagcctgggcgacaaagcgagagtctgtctcaaaaaaaaataaaaaaataaagatgtttgtcatctttttgctaaataaataattaaaaacctaatgtattttgtgctgcaaattgacaacagcaagaaggtgaaaaggctttacccacaagatgggagaaacatttgcacatcatatatccaataaaggacttgtatccagcatgtataaagaactcttataattaaaaatgagcaaatgtcttttagttattcagccataaaaagaaatgaaatattaacaaatgccacagtccttgaaaccattctgttaaagttaacctcctttgatttctgcgggtgttgtaatgaactcctcagtacctcaacattcaatttatgttttgtctacttggcttagcttaccataaaagttttgtcattgatgctctctataagcttagctttaaattctaaaattcagccttatcctgaaacagcaaggaaaagccatcttaggattcatccctagcacattatcatgcattttgtgttctcttactgattgcctaaggttgcttgatacccactttgacctttggaatttctactcttaaatgatttttcctctgaaacattcattatttgcttattactttctaattttaaaattattgcaggggctgtggagtggaaaaaaaaaaaagattgttgcaggctgggcatggtagctcacgcatgtaatcccagcactttgggaggctgaggcaggagggtcacttgaacccaagagtttaagaccagcctgaccaacagattccgcctccacaaaaacttaaaaattggttcagcatggtggtgcatgcctgtagttccagctcctctagaggctgaagtgggaggatcgcttgagcttgggaggttgatgctgcagtgagccctgatcatgccattgcacacctgggcaatggagcaagaccctgtctcaaaagaaaaaaaaaaattcctttttacttgttggacatgatgggttttgaatagaaaatctcaaaacatgtcatagatggtggatacacattgatatctgttggtggcaaattgatatacttttattctgaagcttaactttgtcaagattcataaatagaagagttctatagtgaaagtttatcatttaaatacttttttatattaaaaacagggaagtgttcgccagttactacatgaaaagataagagatgcttatactcacccacaatttgtgaccgatgtaatgaagcctctgcaaattgaaaacatcattgatcaagaggtactttaacataattttttttatttttttattattttgaattttggatgcctttacatggtttgctaaactcctccaattaggtgcagacattatctggtggtgaactacagcgagtagctttagccctttgcttgggcaaacctgctgatgtctatttaattgatgaaccatctgcatatttggattctgagcaaagactgatggcagctcgagttgtcaaacggtaaatatcttgctcctagccatattttgattatgtatactgtcctacaagtgtgcttaatataacagtcgaatgttttatgatagaaagctataagatttcaaaatcattgtgttttagtttcatactccatgcaaaaaagacagcctttgttgtggaacatgacttcatcatggccacctatctagcggatcgcgtcatcgtttttgatggtgttccatctaagaacacagttgcaaacaggtaaaattactttttaatatgttcaaagtaattcattttaaattttccagtaaatagtaaagtcactcactttaatttttaaaaaatgaaagctagaaattctagacttgattctgtgactcctgagatcattggtattggggactggatgggaccatgtggaagagtagtgtttaggcttcagtgtggaatccctcaccaggaagataaaaagctgtaggccacagcataaaaagctgtgggcccctcaccttttctcagcttaacttttgtttgctttattatttgaatttcccaaaaaagattgaaaactattgctttcatacatgatagaaaaagaaaacaagattaaagaggttacatgatttgtccaacttatgctgacagtgattgagctcacagtggatcccaaatatctggtattaatctatagcagagttaaaataaatggttttacttttttcgttttttcttctcatttttccttgttagcctgattaagagcacttgcaatatagagaagcctaacattcagatcaagttatgagaaattcattttacctttagtgctaaagcctatattattagattgaactaaatgaaattactggtgttcagttttcacctataaaaccagcagtttcatgtggtttcagcatgttttctggtattggagagcaaggaatggagttgccattttaataattcatctaagaaataaaagtattttgctgggcttcttccctgaattccttttttttttttataaattgagaattacatatttcttaaagagctagggaaatttcttagcatatgtgatgtttatttgttcatctagtgatatcccacctttctatttacaaaattttaaaatgtttcacatgtatgttgtgatttggcatgatttaagaactcacttgggtaaaaacgattaagcatagaaatttagaaaggaattgtcactgaaaaccactattaggaggacatattccctccagtaacaaatttttcatataaatataactttttaagattctcatcccccctaaaaatgtgcaattggagattctgtaatctacttattaattatcttctgtttttctaaagtagtacttctatcttaaatgtttctttcaccagattagaaatccaggttaaattttttttttgttttgcacaaaaatattacagccaagaaaactatatagtccaagcaaagctatttctgaacacaggatttgtaatatgctgttattatactgttatccagatgatttatgattggggaatttgaggtaatagtaattcttaatacccttcctctcaaaaggtagttacatttctgaagtaaaatttaatcaaaattgatttttttttttctcttagtcctcaaacccttttggctggcatgaataaatttttgtctcagcttgaaattacattcagaagagatccaaacaactataggccacgaataaacaaacttaattcaattaaggtatgtagaaaagttgtcttaaatcatggattactgatctcagtataaacacttgaaaggctatttaaaaatcaataacatatggctgggcacagtggctcacacctgtgattcaagcacttttgggaggccaaggcaggcagatcacttgaggtcacgagtttgagaccagcctggccaacatggtgcaaccccatctctactaaaaatgcaaaaattagccgagtctggtggcaggtatctgtaatcccagctacttaggagtctgaggcaggagaatcacttgaacctggaaggtggaggttgtagtgagctgagatcatcccactgtactccagcctgggcaaaagagtgagactctgtctaaaaaaataaaaataaattaaaaaacaaccatattttattttaaaattcctatgttttttacattttaagacctgatggcatactttagtgtgcggtaggcagcaattgtaatgtagctgtcattgctgtgtgaactcaagagctcttcctgttttctctttaagttgtatcacagttgtactacctatattgattaccacttaaaatgtctggggaaagattacactaattcaccattgtaacaaagaattttttaagaataccttaaccaatttctgttatatttttcaatacatgattaaaaggtgtattttaggccaagcgcagtggtttatgcctgtaatcccagaactttgggaagccaaggagatcgagaccatcctgtctaacggtgaaaacccatctctactaaaaatacaaaaaattagccaggcgtggtggcatgcgcctgtaatcccagctactcgggaggctgaggcaggagaatcacttcaacccaggaggtggaggttgcagtgagctgagatcgttccactgtactccagcctgggcaacagagcgagtctctgtccctgcccccgcccccgcaacccccgcaaaaaaagtatattttgaaagtctaaacaagctcctgtgatgaggaaaacattgtgtctacttaattgacaatgttttttgtctttgtagttcacagttgtgcaccctacagttgatttcctctgtgaaatacagtatttgtttcttaaaaggcaaaaatcttagtcactcagaaacagaaagtaaatgaactctaaaagcatttctgggttgtttttttggttttggttttagttgtttgtttttttgaggcagagtctcactctctcacctaggctggagtgcagtggcgtgatctcggctcactacaacctctgcctcccgagttcaagcaattctctgcctcagcctcccgagtagctgggattacaggtgcccaccaccacacccgactaattttctgtatttttttgatagagatggggtttcaccatcttgcccgtgctagtcttgaactcctgacctagtgttccacctgccttggcctcccaaagtgctgggattacaggcgtgagccaccatgctggccatcatttctgtttttaatatctgcagtgcctcaaagtgtttacattttatcactctgtatccatcatccttaatgcttaaaagctttagaagtatgttatacatacttctgctgtagcatttattttcatatttgtagtcctagctttgctgctaaaccatgagctcttggaatgccagaggcaaagttatcttgcacgtcattgtattcttaagcacctaacagtatgtctggatgccttttttctgattgatattacttcttggccaggatagagaaatggttaagttctcacataaaattgaagagttttctcagttttgaaaagcatattgggtagaaaagaagaatttctttggaagcattaaggacactttgtattgtcattttcttagacagacttatggttcagtcaccatgagttatcatttctgtatgcctactcatcttaagattgtcataccttaatcctaataagagaacagctcaacaagtaggtaggtgagattgttactggccagtattggaaaaaactttatatatatatattttgtgtagtaggcagatctcaaactgacagtatgctgcattttgaatctggagataaaagttgcattgatgaaaatggaatttaatagttttcctagaaataataacacatagcaaaattttatatatgtgaggcatcttatataaagggactttacttgagttggtgcaagtgagtcattctagcattagggatggggcagaggtagttatctttcctttgagcagtggacccaggaatatccagaaacagatggtatgtgcagaacaggttgtacaggcactgttttaagcacagctaagtaataccatgagtgaaagtctacttttacctatagtagaatcgtgttgctgatttttgtggcttctgttttcttttttaggatgtagaacaaaagaagagtggaaactactttttcttggatgattagactgactctgagaatattgataagccatttattaaaaggagtatttactagaattttttgtcatataaaacttgaatcaggattttatgccccacatactctggaacttgaagtataatatacttaatataacataaaaagccagttgggttctaaattgtagttgaaacacagaaaatgccacttttctgttcctgaagaggctcttttgtgcataatattctaaaatgaagacatttcaagctatacaaattacttccaagttttcatgatgtatgggaagattttcagtaggtgtattatattcacggtaccaaatgctgaccagtgttgctccattttttaaatcttgaaaagggtttctgtacttacctggtttgccaagtatgccagtgtaatgaaactgcccttattttaaaagccagtcaaagattccactgattgacatttgataaataaacatcaggattatgtttattgtttgttttcagtctttgcactatattaccagtatatggtttccgaggaagattatctactgcaaaacaccactgttggaaaaataggtatttttaaattgtttttaatcttttttggtgcttttaaacatgtttagcaaaaaccaattcagttccattccccgcaaaaaacccctaactttactctgaactttttttgtttttgcattccatgaggttctgtattcagtcattctctaggtaatgtcatttttgtacacatatatttatataatcactgattgagatttaggaaaaagcatttctaaagaatatttgcttcccttagaactacagactcgaaatctttaaagatggtgcctaagcatctatgtattttttttaagttccacagatttttctgttgggcagccaaggattataaaccacttccctaaaggcaacattaatgcaaaagtccccagatggcaatacaaagtatcccctggtaccacatatattcatttgtgagtttggatatagagcacattatctaaaccattttgtagttccaaaaacccatctaaatttcttgagttcctgaattttgaacaggattacctggagcctggagccactttaagttgtacttctgactaaactggaattatgagtgaggaagagtgtttactaaataaatgactggggcaagcaaaattgaggaggaaattagaaactgtttgacaaactttaagagctacttgaaataacagaagtcttgattaatatgcaaataatggctagaaagtatggtttaactggaccctattatgccttttaaaaataatttcagtaacccataaatacatgttgtaaaaaattcaaatatacagaatggaataaaaaaatgatctccctttattaccctcccaaaggttaccagcgtttgaatttaataatgtatattctttcatgcttttttctgtgcacttacctaagtgtgaatatgtaaagggtttgttttgtatacaaatgggattatactaaaataagtaatgcctatttttaaggataggttaaatttgtgaatgatcatttcaaatatattgaataaaataagcaaaagctattgttatttactgatcctg

SEQ ID NO: 36003 - DNA, 109157 bp, Homo sapiens
gctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggtggtggtggcgggccggggcatgagcaggaggaggattaccgctacgaggtgctcacggccgagcagattctacaacacatggtggaatgtatccgggaggtcaacgaggtcatccaggtgagggtggccgccgcgccagctggaccgggcccgacgggggagcggattcaggcggcacgcgcggtcccgagggacaggcctgggcctggtgcgcagcctagcccggtgcctcccggccttgtcttctccgctgcctctgctggggatagagggtgtcgaaagcagaggttcgccgattagccgggtgtggggaggtgcgctgggggcggtgcttcccaagtcctgctatggcggaggccttcggtcgcctaagccttctcttgcgggcaatttctgccagtccctgggccgggtgtcctttctctggccgggcgatcgcctactggggcggggcggaggaggtggggtggagaagaggagtcaggaagaattgggccctgacgggacttaccccggccgtagcctcatttgagcacttttggaagggattagagtaggcctaagagcagcttggtgtacagttgccccaagtgggcaccagttaataaagaaatggatcttggcagtctcaagtgcctacttaaaggtgggggaagggaagtatttctcggaagaggtgctgatgggccttcttttcagatggtgaggcttctgcttacatcttttttatgtctttgctgtttgggacctaattgctactttttctagtcgtagcagatgacttgcttgaagctgttggaatagttactgcatattgcatacccttccttgtagctaaaacaacaacaaaacgcagtgttgtctaatattggacaagactctattgtgagttagaaagcagaggttttctgcttgtgaactcctttctctgatattttctattttgtggtaagttaggcttggtgtaagttgataaccacatctcatttaaccatgtgcgtcagattttgcatttttgagctttagaaactcaaaagttttcatttggggaaaaaaaaaacctcagttctcctgaggagtcagggatatggctgaagaataaaaatgaagcttgattcagtgcaatttttagaaaacctggaaggaaacatatatgagcagcaagttactattgcctcttttatcagtattatttcttttttgtttaacttaaattggttggctaaatattcattgacaaattagaagtatgtcactgtcaactcgttgactttctattattaactgatttttatagtattataagtaacagttttaaaaattgaagcatctattcaggcactgtttcaatacagtgttttgcataatagaaaaatctctgatatctagtgccattactaaatagtggaagtcttcatttttaatctagagaacacagtctaagaaggaagttgaggattgtagaagataattttttgtttgtttgagacggagtcttgctttgtcgcccaggctggagtgcaatggcgcaatctctgctcactgcaacctccgcctgccgggttcatgcaattctcctgcctcggcctcccaagtagctggtactacaggcgcgctccaccatgctcagctaattttttgtatttttagtagagacgggtttcaccatgctggccaggctggtttcgaactcctgaccttgtgatccgcctgcctcggcctcccaaagcgctggattacaggcgtcagccaccgtgcccggcctgtagaagatgcacatgtaagaaaaatctgattaggtaagaaaaaataaaaagacaaaacaagcctgccacccagagacgtacaacaaaatgcgaactgtagttatttttctagacctttggatagccattaatatggttccacgttaataacagtggaaccatactgtatgttctgtttgtgttttcagtggaaaaacattacagaaatactctgaacaaccttctgtcaagtaaatttttcgagaacttatatgattatagatctgaactaatttatttaatcaatctgttatttgccttcctttttattttctagtttctggcttttataaatattgaaaatatcctcataggtcagtctttgagtgttcttattttcttgggataaagtgaattgctgagtcaaaagaatttgctcattttcaatgcatttgatacatactaccacattgctttcagaaaagttatgctagttttcccaaccagtgtttgatgggcaaaaaaaacctggtgagattgaatttatgtttattgggcttggtatttcttttttaaattgcccctcgctttttgctcattttattctcttttgcccattgcccctctttgggatatttatctcttactggtttgtaagacttctttctattaatagaggttggaaatagcagttatctaggtttttaatgttggtttgataaacactgaattttacttagtttgcattagagagcttactgttaactcttaaacatttaaattccctgttctcagttctaattttcagtgtgaaatcaggtaagatacatttgcaggtgaaaaagtttgaaatgtaaaaagataaccaaattaatttaatatttccttgggaatttgattactttttctgggagaggagttctgggcaacaacataaatactgttatttgtggatatttgcaggttaggtttggtcttcaaataagtcaacattattttctttcagaaaacttggttttctggctttctataatttcccaattaacatttaaataaaagaccaaattaaacaattaaactttatttaatttggtcttttgtttaaatgctttgtggctacctagcttaccttttcagcttttaaggaaaaaaaaaatcagagttttttattttgttttgtttggagacagcctcactctgtcacccaggctgtagtgcagtcgcgtgatctcagcttactgcaacctctccctcccaggttcaagagattccccttgcctcagcttccccccctaccccagtatctgggattacaggcacctgccaccaggcccagctaattcttgtgttacagggtttccccatgttcatcatgctggtactgaactcctggcctcaagtgatctgcccttctcggcctcccaaagtgctgggattacaggtgtgagccaccatgcctggccagggtgttttttgttatttgtttattttgagacagagtttcattctgctgcccaggttggagtgcagtggcgtgatctcagctcactgcaacctccgcctcttgggttcaagcaattctcctgcctgagcctcccgagtagctgggattacaggtgtgcaccaccacacccagctactttttgtattttttagtagagagggggtttcaccatgttggccaggctggtcttgaactcctgaacccaggtgatccacacagctgggcctcccaaagtgctgggattacagtcttgagccaccgcgcccagcctaaaaagtagttttctaatgtaactatataagtagctaggtaatttattaaaagaaccctgttcaattctgcagttgggagtatttaaacttgccattttgtttttccacaacagtgttcagcaaatgttgattgtgctttctaagtatgccaggcattatgttaagcagaggatatgctccttgcctaaggagcatatagggatagggaatatggaggtccttgaactccacttccagagattcttactcattaatgaagtctgaggtgaaaccttagcatctctgtattttagccttctagtgataaccaaaccactggaatagtgatagttaatccactgtcacgattttgactcaggcagggtgagtagagtgagaagagcagcagctcttaggggcacagattgggtatacctaatcaaaaaatcagaaatgctctgaaatcactttgtgttgttgcccagactgaagtgcaatggcaagatcatagctcactgcaacctcaacttcctgagctaaagtgattctcccgcctcagcctcctgagtagctaggactataggtgtgtggcaccactcctagctaattttttttcttttttgtagagacacagggtcttgctctgttgcccaggccagtctcaaactcctggcctcaagcgctccttgaacctcagcctctcaaaatggtaggcctggaaatccaaaactttttgagcaccgttgtgatgctcaaaggaaatgctcactgcagcattttggatttcggattttcagattagggatgttgattgtaagtataattaaatattccaaatctgaaaaacttctggtctcaagtattttggataaggaatactcaacctgtaccatatttagagtgtgtgccgagaggaatatggacctgggactattgaatgtgagtggtcagaggaggtataaaaaacagtggataggtatcttgcttttataagatctgttatgctaaataactttttttttttttggagacggagtcttgctctgttgccaggctggagagcagtggtggcgtgatcttggctcagtgcaacctctgcctcctgggttcaagcgattctcctgcctcagcctcctgagaagctgggactacaggtgcgcgccaccacacccaactaatttttgtatttttagtagagactgggtttcaccatgttggtcagatggtctcaacctcttgacctcgtgatccgcctgccttggcctcccaaagtgctgggattacaggcgtgagccaccgtgcccagccaaataactcattttaaagaaaaaaatatctaagccttactgaagaaattttctgttggctgttggttcgaaagctgtatttcacttatttaattaagagatttaattaaagaacctcaagttgaggttgcaagcctaaactaaggaagacagtgtactattctttttttttttttcgtttgagacggagtctcgctttgttgcccaggctggagtgcggtggtgcgatctcggctcaccgcaagctccgcctcctgggttcacgccattcttctgcctcagcctcccgagtagctgggactacaggcagccgctaccatgcctggctaatttttttgtattttttagtagagatggggtttcaccatgttagccaggatgatctggatctcctgacctcgtgatccgcccacctcggcctgccaaagtgctgggattacaggcatgagccaccgtgcccggtcaacagtgtactattctagcatattgtttactgattggggagtcagttatagccctggtttttactctgtctagttaatatctcagaaccttcaaattttttttttttttttttatacatgtctcactgtgtcacccaggctggagtgcagtggcctgatcttggctcactgcaacctccacttccagggttcaagcgattctcctgcttcagcctctcaagtaactgggattacaggcacgcgccaccacacccagctattttttgtattttattagagatgaggtttcaccatgttggccaggctggtctcgaactcctgacctcaaatgatcgacctaccttggcctcccagagtgttgggattataggcatgagccacggtgcccagccacactttttgttgttgttgttgagatggagtttctctcttgttgcccaggctggagtgcaatgacgcgatctcagctcactgcaacctctgcctcccaggttcaagcgattctcctgcctcagcctcctgagtagctaggattacaggcgtatgccaccacgcctggctaattttgtatttttagtagagatgggggtttctccatgttggtcaggctggtctcaaactcccgacctcaggtgatctgcccgcctcggcctcccaaagttctgggatcacagtgagccaccttgcccggccttgttttgtttttaatctgggactgaaaatgagggagttgaaatactaggttggtccttttttacattaagtgttttattcgtttaacatcattttaaaaacctcagttaattggagatgttcattttttccaagaaattgaattcaggtgtgcatattgtggttatgttcattaattgggagaggaggaagagggtgtacaagcctgtgcatgatgtgtgcaggcacatgtgttttgaagttattaaagtgtttgatatagtttagatttatttcttttggacttttatattttcccagctgatctccttgagctgtaagtttaaattacactgacttgttgaattgctatggcagtagtcctatgaatcaaactctggggatggggtctggctgtctgttttaacaagccttctaggtgatggtgatgcaagctaaagtttgagaactgctgatgtagttgaaatttaatagcagtgtttctctatgtgttacgtgtagtgatagattactacagaggtgggttaatgagggaagataaattgtttaagaaactaataataggggaccagtcacggtggctcacacctgtaatcccagcactttggggactgtgccaggcagatcacttgaggtcaggagtttgagaccagcctggccaatatggtgaaacactagctgggcgtggtggcctgtgcctgtaatcccagctacttgggagacttgaggcaggagaattgcttgaacctgggaattggaggttgcagtgagctgagatagtgtcactgcactctagcctgggtgacagagggagactctacttcaaaaaaaaggtaataatgggaaaatttccagaacctaggcaacgtttactaggctaatcatagggttggaagatgtttgtcatcgtagatgctatccttcatgctatgctatccttcagctaaggtggtctttactcagtattttcttttcttttcttttcttttttggagacagagtcttttctctcttgcccaggctggggtgcagtggcgccatctcggctcactgcaaccttcgcctgctgggttcaagcgattctcctccttcagcctcccgagtagctgggattacaggcgcccaccactacgcccggctaattttgtatttttggtagagacggggtttcaccatgttggccaggctgatctcgaactcctgacctcaggtgatccacccgacttggcctcccaaagtgctgggattacaggcatgagccactgcacccggccagtattttcaaatagacaaactaaactagtgacatctgacattctagattggagttcttgatttcccttccagtcctagatttttttaatatagaatgttgagttttctaatttattagtatgctggaagagatataaagtcctggatagatataaagtcctgtttaaaggaatatgagaagacttattcttaaggagttgagaatctcttagagttaaagctgttaggttagtgagtaatttaaataagtggatagtaatagatactcatggaagagacctctgtaggtgttgtcaaagatggctaggatttgggtggataaaaaagaggaagtcattctaaggaactgaatgaggtgagaatgaggagagtttttgggtaatggtgaaatcagctaaagtagaatggagcttataaatgctggataataatgtagaacctgggagattaaatactgtgatgaaaggtaagcagaagtcatcacattagattcttttggggttgacctgtggtaactatgtagattggttatcttttgccttatgttaccccaaaacttagtggcttaaaaaaacaaggatctgttatatcatagtttctgtgagtcacaattctggatgcagcttacctgggggcctctggcttatggtctcttacaaggctgcaaccaaggtgacggcttggtagcagttctctctctctcttttttttttttttttttaaagacagaggcttgctgtggtgcccaggctggagtgcaatggcataatctcggctcattgcaaccctcacctcttgagtccaagtgatcctcttacctcagcctcctgagtagttgggactatagatgtgcaccaccacaccccagcttatttttttgtttttgtgggttttttggtagagaccagtatttttttgttttgccatgttgcctaggctgctcttgaacaccttaattcaagggatctgcccgccttagcctcctaaagtgctgggattacaggcatgagccaccgtgtctggcctgggtagcagtcctcaaggcttgactggggaagcttccccttccgagctcactcatttggctgtgaccaggccagattttcactggctggttgttgcccagagatatcagttccttgccatgtgggcctctccataaagtggctgacaacacagtagcttgtttcctccagagtgagggatcttagagaaaaggcccatacgatggaagccacaaagtttttataacttaatttcagaagtaacgtcgcatcactttgcaatattctatttgttgtaagtgaataaccaaatccagcccatactcaatcggaggggattatacaaagatgtgaagaccaggaggcaggggtctttgggggctatcttagaggccggctgtttgtctctgtctctctctgttaagaggtaaattacagctattgtataatgcctttctatccaatctttttgtatgctattgggagaacatagtgttttggattttttattttggattaaccgtaaattaattacttttggctttgcaaaacattatacctgtaaatgataaacattcctaataacctttcagtggcttaagtttaaaatagcttgtagtctcagaattggtaggaatttgagattctccagtttactgattttttttttttttaactctagctacgtaatggaatcacctggggatttttttcattactgtttttaaaatagaaaattgtagattcacagccgggcatggtggctcacgcctgtaatcccagcactttgggaggccgaggcaggcggatcacctgaagtcaggagttcgagaccagcctggccaaatggcgaaaccccgtctctactaaaaaaatacaaaaattagccgggcatggtggtgggcgcctgtaatcccagctactcgggaggctgaggcaggagaatcacttgaacccaggagacagaggttgcagtgagccaagattatgccattgcactccagcctgggcaacaagagtgaaactccatcaaaaaaaaaaaaaaaaaagaagaaaagaaaagaaaattgtagattcacatgcagttacaagaaataatgcaaaaatcccacatattcttttttccaaaaaattttatttccctaggttattggggaagaggtggtatttggttacataagtaaattctttagtggtgatttgtgagattttggtgcacccatcatctgagcaatatacactgaacccagtttgtagtgttttatctctcacccccttctcacctttttcccccgagtccccagagttcattatatcaatcttaggcttttgcatgctgatagcttagctcccacttatgagtgagaacatataatgtttggttttctgttcttgatttacttctcttagaataataagtctccaatcccatccaggttgatgcaaatgccattaactcattcccttttatggctgagtagtattccatcatatatatatatatatgtgtatatatatatgtgtgtgtatacatatatatacgtatatgtatgcgtgtgtatacgtatatacgtatatgtatgtgtgtgtatatatgtatatatatatgtgtgcatacatatatatgtgtatatatatacatatatatacacacacacacacacaccacagtttctttatccacttgttgattgatgggcatttgggctggttccccatttttgcagttgcgaattgtactgctacaaatggcgtgtgcaagtatctttttcgtataatgacttttcctctgggtggatacccagtagtgtgattgctgaatcaaatagtagttctacttttagttctttaaggaatctccacactgttttctatagtggttgtactagtttacattcccaccagcagcgtagaagtgttcccttctcaccacatccatgacaacatctattattttttaattttttgattatagccattcttggcgtgactgaagttgtatagcattgaatcccacgtactctaccgattttttctacagtggtaacatcttataaaaacagtatcttgcaaaacatcttgcacagtatcaccatgagggtaatgacattgatgtgatcttactcagattttcttacctggggattttaaaaaatacaggcaggcaggccctaccccataccaagtaagtgggtctctggggggtttggaccaggcattgccgttaaacaagaatctttcctggattattttaatgcacatccaggatcgagagctcctgcttttgtaagaaatctttctaaaacactgccgtctctgcttaactacaaataaataacagtgagctatttttgtgatgcatctcaatacagtgtttgcctattgatttttttttttaatggaaagaaaatctacttccgtattagctttcactcattgttcttagtacctgtagcaccctgaatggttttgttttttatataactatcattttggaatcctgaaggaaaaatttttcttcctgaggttaatcaacccccctttcctcagtcattcctgccttctaggtaattgctgtctttcttataataggcatagtatcataggccataactttgctaaattattgactgtatatacacaactcatcgtttgatcttgacactatattactatgtaactttgtataaatagcttaattattttcattaaatgatgggataaatagaagaatgagaatttatttaggttgacattattggatgagatagtaatcaggctgtttctaacctggagtgactggatcctttggggcccatggagatagtagtggtggtccttgcattattttcagtgttttaaaaagcctcatgtatatttttttaaaaagctgtcaagccacttttataaagtcagtagatttctataatcacttatgatttaagtttctttctaaatttttaatttttttttccctaaattgtcattcacctagtgataggaggtcatctggcttgaccatacaatggtttccccttatctacagtttcagtttccaaggtttcagttacctgaggtgtgcagcagtctgaaaatattaaatagaaaatttcagaaaaaaacaatttgtaagttttaaattgtacaccattctgagtagtgtgatgaaatctctcaccatcccacccaggacgtgaatcatccctttatccagtatatagcagtatatagactacctacctgctactggcctcggctggtcacttcactgttaccagattgaaaaaacatagcatgtataagttcggtattacctacactttcaagcttccactgagggtcttgggacatgttccctgaggatgaaggggactgctgtaatgtctcatttgatacagcttggggtatagttgatgcccagttagtgtttaagtgatggatagtatgctatctcagaaggtggcttaaaaaattcttaatgctctctaacatctgctctggcaaatcagctttccagagccctactttttttttttttcatttttaaaaatgactttttttttttttttttttttgagacagagtctctgtggcccaggctggagtgcagtggcatgatcttggctcactgcaacctctacctcctgggttcaagtgattatcgtgcctcagcctcccaattagctgagattacaggcatgcatcaccacacctggctaatttttgtattttttggtagagacagggtttcaccatgttggccaggctggtctcgaactcctgtcttcaggtgatccgccctcctcagcctcccaaagtgctgagatacaggcatgaaccactgtgcccagcctgacaattttggttttaaggccaaaagtttgaagatttaaatgaaaaatgccaaatattcaggaattttctcctattattattattatttttttttgtatgtaaatattgttgtgtagtattgttctttccttttttgctctgttccatttaaaagtgtcagaagtgccctgacaatacattttggcaaaaaacagagcaggtaatgaagtattaggtaacattttcttgttactgagacatttgcttagacaatgctaagaatagctatcatcctagacacttctccccaggcttgctttgccattgcctttgaaactgtcatacttataactcagatattaactggctctaattacctggtaatatgtcctctctcctaatcacaattgtacagtgtttttagggataaagtgtaaactagaaaccgagaagtattacctgattcttagcaagtatttataagtgaaagcctctaatgtggacatttatcttggaatttgtgacatttggacagatatttatctgaaacttacttgaaactcaaatttaataccttctctctttgaggcttttcccccttttattggcttatctgagaaccattcttgggatttgagtcatccttttttttttccttcattttccacatccagttatccctgatcaagttacctctgaaatttgtttcatgttgttgctatcctttttactaactaatcctagtttaggacctttttattttgcctccttgtctctgggcttccagtgtatcattctgttaccaaacacaaatttaatagtcatcctcctgctaaaaagagactttctgtcaaaagtctatcccagactccttactatggcattcatggcttccccatcttaacatagctaatttttttcaatctcatctgcagttgttcctcatcccttatcacccccagttgcactgtttgtaattctttactgtgtaacacatatttgtgttttcatgcttttgttcatacttgtccctcttcttttgataccttttcttttctttctgtctctcttttttcttgagacagggtttttgctctgttgctcaggctggagtgcagtggcacgatcacggctcactacagccttgaactcctgggctcaagcgatcctcccacctcagcctcctgagtagctgggactacagttgcatgccactacacctggctaattttttgtattattatttttatttatttattttttgtttgtttgttttgtttttggtagagacaattttttgccatgttgcctagactggtctcgacctcctggactcaaacgatcttcccacctcagcctcccaaagtgttgggattacaggcatgagccaccgtgcccagctctctttctcttcttaactgcctgatatattcctattgagaatctgccaggctggctgcggtggctcatctcctttcaggttcttctctacctttcctgtgcttccttatctatgtttgaatagtgcttcatatggatatttggtatagcctataagaggttatgatatagctatccctatatccaagcctctagctatatatgagggttttgaaggtgagaactaaaactccttcatctttgtgttcatagcagagtttcttctctgacagaagaaactcagtaaatatttgttgaagtttgtccttgcctagtaaatgcttgctttctcagtttccttgtggtaaaccaaagggatccagacaagattttcttctggcactaacaaattattttatgatttctagataatgccaaagtggtagtgtaagaagatggcaaggaagaaatgtttgaattccaagaggacaagcttcttaaggtccctgaatattcaaccttttaggtgaagctttattatttgcgtatagttccctggcgctgggtgtgaactgacacagtgatgatgttaaagacagtggaatcacccaggtgcagtggctcacgcctgcaatcccacaactttgggaggttgaggccagaggattacttgagtccaggagtttgagaccagcctgggctacatagactttttctctacaaaaaaaataaataaaattagctgggcttggtggcatgtgcctgtagtcagttacttgggaggctgaagtgggagaagaggattgctgagctcaggaggtcaatcaaggctgtagtaagccgagattgtgctactgcactccagcctaggcaacagggtgagaccatgtctcaaaaaaaaaaaaaaaaaaaaaagacagttgaatcagtttaatacagtacttctcaaagtatggtccataagaacaaaactatttaataataacagaaagacactatttgcctcttaaaatgttctggcatttgtgctgatgttgcagggcaatgaggaggtaaaaccactggcaccttagtacagaaggtatcagtggcaccaaagtatgctagtagtcattgtgttcttcactatcacacactcagagtaaaaaaatacgtttcacttaatcctaaatgaataagtaaaaattactagttttctaagtctttattccttaaggacacatcttaattgcttgtgtgacaaaatgggaggtatgcctaaagcacttctgcatactgaagtatggtggtcgtcccaaaatgaaaacatttgtgtgtgcttttgacttgtgagcttgtttctgtttctggacctaccctgggcaggtttccacagttgagaatcttagcgtattgctgttacctcaaatttccacacactaccagtttgtcttttgaaatgttatttttataagatgtcaaccctggtatggttcacttttgttatatgttggcacctctgtgggttacggaaagctttgccctccaaagcaaccagttggtttttaggaaagggaaatattgatctttgtggataagtagagtcttgttaaaagctattagaaggctctctttggaaaaaaatcagaaaaatcaaaagaactgtgaaaaggatgataataatggaaaagaggcctttgtagccttgtgaatgtaatacgtatagtcaccacagatttttcagggaggccagtcacggtggttcaagcgtgtaatcccagcactttgggaggctgaggcaggaggattgatagaaccaaggagtttgagaccagcctgggcaacatagtgagaccccatctctagcaaaaaaaatgtttttcagggaatgctgaaatgtctccttctcaaaaaaaaaaaaaaagtctccttctcttacaagttagtcaccttactcagtttattacagcaggagttcccaatcctcaggctgtggcctgttgtgaactgggcagcacagcaggaggcgagcagccagggagcgttaccacctgagctctgcctcgtgtcagattggcagcggcattagattctcataggagtgcaaaccctattgtaaattgtgcattcaagggatctaggttggcactccttatgagaatctaatgcctgataatctgaggtggaatattcattgttattgtctgactccactcccctcccgctcctttcatggaaaaattgtcttccatgaaaccagtccctagtgccaaaaagttggggaccactgtactgtagtttcaaaaatgttcatatttggcctaaatctatagtctgaggaagcatatcacatctttatcattcatgacaagcagggatgggagaggaagcagggataggagtggttatgtgggcagccaatagcataggaaacttaaaaggaacctacttagccaaacatgttttgagcctttgagtcccagtgactaaacaatgcagattaggataaaagatttgctcacacctgtaatccctgcactttgggaggccgaggtgggcagatcatgaggtcaggagttcgagaccagcctggccaacatggtgaaaccccgtgtctactaaaaatataaaaattagcccggtgtggtggtgtgctcctgtaatcccagctactcgggaggctgaggcaggagaattgcttgaacctgggaggcagaggttgcagtgagccgagatcgtgccactgcactccaggctggatgacagagtaagactcttgtctcgaaaaaaataaaaataaaaaataaaagatttattagcatgataaatcaggcttttcataatgtgcccctatctaccttagctgccatttctttatgcttattcgtattatagcataataatcacattccctgtggaaattttctgtatgcctttgtaaggtttttttcctatgcttcaaatgcttccccccacccccccataaacccattcatacttcatgacccactgtaaatattgtttcttccttgaatctttccctgtgagcctcagaattttgtatatacttttataataaaaagctcttatctcattatttccttactagatagactctgaaattcttggttgtttgatcagtgtattaattttggtattcacgttgtacccacaaagttcctggaacatagctgttagacattgagtgaaaagtcagatatgaatgaattttctaattgattttattattgataaaaataagtcttggtactatccccatttttttcctttgtgaattgttcacatttctcttctaccaaattcactgaattaacccttccctcattctctaacatactactttttgctcttaaccagttatcttacggaactttagttatcacaactgttatgtgaaataggtgacatttttactgttttgtggttaaggaattagaggcatagaggaattaaataaccagcttttcatagctggagttggaactcagtattttatatcattaaatatacacaaacgtgtgaatgttattgttgtgtgtgctgggtattttctgtttgcctctgcggaactcttctacctttttccatcctgctgtgctccagaagactgacttatacaggctgagtcaatgggctctgacttgtgacttcattgctgtggcctctgaatccaaataaatgactaagagtggaatagagtcagaagtctactacataccccatttaagactttacagcttacatatgtaccatcctcaagaaaatatcaagccaaaattgctgttatatttactgttttctactctaagcatttaaaaacacaaagtttaataaaaaataattctcgaccaaagtaatagaatacatatatattatataaaatttgttcgttatttatgtatgaagttacaaacttagactagtggtccaaaaagcccagcattcttctgaaagaagcaccaagagattctggaagaatagcaccgtgaaactgttatggaggcactagataacaaatgcttgctttaaagggagaagagccagtttattttgctcggtaatgagaaaatagttctttagtaaagttctcaggtgagcttattactaatgccgtttaacttcaaatgtgagaaaatatgtttactttttaacctgttcaccacttcacctcttatgaaggggaaaacttagggagtgggcctcaaattacttgtcatttaatttggaaatgttcctttgaaatttggaaacgtatgtacataattttagtcactgatttgttacagaatttttaaatgtagtaattacatttcattggccctaaaaatgttgtctgtttttaataatcatctctaattgtattgcattaatataatagctgggtccttaggatatatgataatgtatgaagcttgattataatgttgcattccacccagctataaagccaaagtggtgaaaataggacttttaaatatacagaagtattctagtcacccttaggaatgaaagtataacattaagcaatatttgaagatttaaggatggcagtaagcttgcctaatctttgattcataccactgtcaacacagtttttgattcatgtagagtcaaattaacaaggttggaaggatcctaatggttatcctagccaaccacatatcaagtactacctccctggtaagtggtcctgtagactattcttaaatgtctactctggctaaaccttcacagccacttccagaagacctctgatttagagttctttcatactctgattttgtcttcctgtagctttttacctgaacctacctggttctaacccttctcatgatagcgattctataattttaaagacttatttaacatattggagactagcagtgcaataacctaatccagactaacactttttggggggggaggtcagaacccagaataaagctgctgcttattctgggtttacttcttatggattgttgattagaaagattattctgcactggtattttggattgaggcctgtgcatgtctgttcaggcaaagtttacataaggtagaacactacagcagcacatgtgcaccctgctcaattaaataaatatcaggcagatctgtttgttcataccctcattgcagatactgaagggttggtgggttttgcagtaacgaatgaataattcatcttgatattactatattaatagttttgggttctgtatatttcctccgactcagaatttacaaaaataaaagcactttctagacagttaactagttagctctgagtagaatgttttctactacctttttaaagattctagatcattttgagcaaagaatattgaaattgcattgcaaacttatctttgtgaatcaggtttttcttcattctatgtacaaaacaaaatatagaaataagatgtatactgagcttttctccataacctcagattttttttaaaaagttaaaacagtcttagtatgctaagagtgactgtttataaacttttttaaaggattttaaattttttattgtttgtgcatacatatattttcttggttcaaattcaaaaagcacaaaagatttaaaaaaaacatatatatctgcctttatacctcaactacgtggttccctccctcacagtattattgatgtcttagtacttttctcataaatgcagaacccttccctaacctgatttttatatttcttataagatcctaaataatcgtgttatagtttatgaatttctgaggttagtgggtccctaaatataatgcttcagtttaattgggaaccatttgtaaattgagtacttgatttatttttatcagctgagatttctttagctgccacactgctgggggaatacagataatggacaactctttaagaaataatgtataaataaattataatgcgacgctttgtttcatagtagaagcataaggtcgagaaggaatatttaatgctcttctctgggaggaccgacttgctggtaggaatggaagctgaattttgaaaaatgaatggtagcttactaggcagatggggttagaggtggcattccagacaaaggaggaagaggaatggaagaagttgtggtatgttgaatgaacaataaggaattgaatattgctgaaattactgggaagtagagtggtaggagctggggctagacaggcagtgtgatcagattatgaaagcttttagcgtagtgctgttgagatggacttaattcactaggactacgtgaaacaactttaaacttttaaattaataaggaattagagtttaaaaggccactctgttggtactataggaaataaatgagaacaggacgggattaggaaactgggagagtagtgagtaatccattagaataacctgtgaaagaaatgggttagcaaggctggaatggaggagggaaggcattcaagataccgtgagaaatgatgaattattaggaaaaaaaaaaaaaacttagtgattaagtctttggtgtcatttagaaccacattcagttccagctttgccttttaccagctctgtgacttcgtatgtaaatttgattttaataaattctgtttcatcatctgtgagtattgtaattgtgtagttgaagctttaagcaactttcatttaactaacttggtgaatagttaatagttgctctccattccctcagtaaaagagacctagggcagtgttcatgacaggctctcagcttgtcggcctaagtggcaaaattaaccagtcacgatagcccttatactgtgtggtatcatttatacaaaatgtcctgaattggcaaatctatagagatagaaagtagatcagtggttgtcagaggctgagtgggggaaatggggcgtgactgctaatgagtatagggtttctttttagggtgatgaaatgttctaaaattaatggttgacacaactgtcacaattctgtgaatataatcaaaaccactgaactacttttgagagttaatttcatggtatatctcaagttgtcacagaaaaaaagtctaattcagtattccccatttgtccaatacgtcttttatagcttttcttcttttggtcaaggatcatggattgcatttggttatcatgtctctttatttgtccatgttcttgatgggttaaaataataaagaatatacaaatggttagatctcctataaacaaaagaatatacaaatggttagatctcctataaacaaaagtttcctgaaacttccttaaacatgtagcatggatctagtttattttagttgcatgcaaaataaaacaattgattaaattaaaattgttctttcatggctgtaagctcttggtgaagacaggtcagacaggtatttgggttaatgtcaggcaaaaatttctgtatcaaaacacaatatttatactggcttgagctagaatgttgagacattgttttaaggtttgtttttttaaaatagcttttagaagcttattgaggtgtaactatatatgctatataaactatgatatacaaatatatatactatacaaaaatatatcttacaatttttttcctcaagagatactgtttttctgtcacccaagctggagtgcagtggtgtaatcacagctcaccgcagccttcaactcctgggctcgagcaatccttccgcctcagcctcctgagcagctgggactacaggcacacaccaccacacctaattaaaaaaaatttttttttggagatggggtctgttgcccaggctagtctcaaactcctggcttcaggcagtcctcccacttcagcctaccaaagtgttgggattacaagcttgagccactgtgcctggccatagttttgtatataaatgtcttactattatagtttggtaatcgacctaaataatactgttacatattgttttaagcccccaaagttgtcttacctagatgtggtgctagcaaacgtttttataaaggcaggaatgtagaatggcaaaatgctgaaatacaaacatactctaagcacacagaccttagtgtcacagtagaaacttcctgcttgcaataattgccattttaattttggtgcagaaagccttctatggatgtgatagtttatgtaccaaagagcaatctctatttgaagaaactgtgtggcctggttacaaaagtgcctgctgtatctgtaactgtcagtggtattaaaaatactgatttattttgcctgttgtgataatcaagaatagcttatttggatatatgcatgggatggttgcaaataccaagttcaggtattttactatggaatatagataggggtgttttcttctggttttccccacccctttatatataccttgattttaatttttatcaagtgtgtctctttggcctttgccgctgtggcccattgatctgtccatctgtctgttacagtgcatattgggtacttccagaagtatgaattcagtgatgcaaaggacaggcgggctgcagcagcaaaggtaggacagaatcattccaaagacaagtcattaaaagaccattaaacacacatacttacacacagacattggcaaccagtacctcattatttaagggcacatcatttatcctataaatctttgtgggaaagtttgttttgacatgacaaatgtgatgtacttgtaaagggcacaattttattattatgttttaaaccagaagcctacttggcacttaggcaacaaagtaaatggcatttgccactgtctttaagatgccgaataatagaagagataattaaatggaggatattaatggtattaattgattcatggagctggctgattttcagaaactatgataaaggatcctattttgtaaactgggaggagaaacagagaagatagattgagctatgtgtgtatatttatgtgttaatgtttatttatattcctgactctggaatattttgatgaaaataatctaaatcttcctgttatttcgctgacatcactatgaggaagattaagaaattctatttaaatgtttgtaccatttacttaagtatttgtatcagtttacttgctaaatgatagcagttataatagcaatttctggcttaaaaaaaaaacagggttaggatggaagggcaatagcatttttatactgaatcctaaaacatcagttataggcaagttttaaaacttaatcatacgttgcaaacacttgaagatgaaatggaaggcttataaggttaagtgttaggttttatgtgtcattctagtattggctgaaaagtgagtgctatagggatggtggaatgatgcagatatttgcatcattttctatgctgttatgcttctaaaaagaagaggctatgttttcctaaataggttagtagagtgcttctcaaggcttcccaaatgaaaagtcagacaaaaatatgtatttgttcttcagtgaagattgttgggttttcaaaccagcaatcttagctgtaaaacctaagatcttaccacagcctaaattgtgactcaaatgctgatgttagttaatacttttataaactccatatactatattgaggagatctagtttcttgaatgtggaagtgaagcttcataatataccatagtagggatgtttcgaatcaatagtgttaaaatgttttgggttttttaaagattttttttcagctggtcttggaaaccttttcagttatctgtttttgattctaccaaaggtattaggtatttaatgctccactaaatagatcacaaaaggggagtcttaaggaggtgaagatgtgaacttcttgactagatgtaaatcactgctcagaaagatttgacttttttaaatgatgcattcttatgtcaatagactttaatctgcaaccaaaatgttttttttttaaataaaaatgaggcacatttgtgctttctcacttctgctccaattctaccttattctgcaagttgctattttttcctttagcagtacactatagatttaaaaattgtatggtattttctaatataaccatatcaatttatcagttttcctattgttggacatctaattcactcatatttgtgtcttcttcctttcccttacagagtttttgtaaagaaggctgagtgttttcaaaagttatgtttatatttacatgtgtgtgaactaccattttctgtatacccttgctgataactattaagaatcttggtctggcgtggtggctcacgcctgtgatcccagcacttagggaggctgaggcggtggatcacccgaggtcaggaattggagaccagcctgaccaacatggcgaaaccccgtctctactaaaaatacattagctgggtgtggtggtgcatgcctgtaatcccagctacctgggaggctgaggcaggagaatggcttgaacccaggaggcggaggttgcagggagccaagatcgtgccactgcattccagcctgggcaacaagagtgaaacactccatctcaaaaataaaaaaaaaaaagaactcttcaaatttttattaatctggtaaagaaaatactagttgttttaatttacatttttctgaattgcctttttatgtcgtttgcaccttttcataaatttttttttttttttttttttttttttttttttttttgagacaaagtcttgctctgtcacccaggctggagtgcagtagtgtgatctcggctcactgcgacctctgcctcccgggttcaagccattctcccgcctcatcctcctgagtagctgggaggcgcacgccaccacacttggctaatttttgtatttttagtagagacggggtttcaccatgttggtcaggctggcctcgaacttctgatctcaaatgatccacctgccttggcctcccaaagtgttggcgtgagccactgagcccagccagtaatggtatttaatgtataattattgtagctctttctccagtttgttatttgtaagaaaaaaaaaaagcaatacatgcatgtggtaacaaatgtaaatgttatatcttacaatgattacatttatagctttaatatgtctcttccttttgacattatctctttcctttttcttcctccatccttgagaaccccactttatgccagctatagttatatgttatcaaaatatttttgtcttgtgattataaccaaatgttattagttcgcttatagcttgatttttgaagtgacatcattgaatgtttgtttttatggtttataaatatcaatgacattctaagtagtgtattatgattactgttgctttttgtttttaacaggtctaatttcaaatgctgtgaaccttcctaagaacagtactctggtagcaagatggtttgggtttatttatactccttggagcccttcattctgctcttgtaatcaggatggctttccctgtaagcctcttacatatagctctcaaccatggactttgcatcattctcctgtgttggagcctctgattcttagatacatgtctttttcttgactgaatctcattgtgctggactgcatccttaatttaactctcacaacacttttttcccccctgcaacactcttaggctgttacttattgtggctctgataatgtgcttaattttccttcaaacttgattgctagattggctaggttggaaactctagattagaatatttgtgcaagacattgccttctgcattcactgttggtgataagactgatagtagtctggttgtcatttctctcttttttttttttgagttggagtcttgctctgttgccaggctggagtgtagtggcacaatctcgtctcactgcaacctccacctcctgtgttcaagcgatttctcctgcctcagcctcccgagtagctgggactacaggcgcacaccaccacgcccagctaatttttgtatttttaatagagacggggtttcactgtgttggccaggatgatgtcgatctcttgacctcgtgatctgcccgcctcggcctcccaaagtgctgggattacaggtgtgagccactttatgactttatttatttatttattttttaagtttcagccttttctctgaagagatatgtaagtgtgaatcttctaatccattgtgctggatcttcagtggaccctttcaactggaagacttgtgtccttataaagctttggggaattaacttctgttactgctttgctaatttcattccctctcttcttcttttggaattcctatcagttgaatgtgaaaaacaatggatataacttaaaataatgataagttatggaagaaagattgagaggtgcatgtagcgtgccagatcctcatctttcacattaggaaggtgacagataatatctaaaatagaaaaataataactccttgagcataagcatattatttagcataaaagtaaatactagaagacacagaagagtttaaaatggttacctcagaggattagaaatcagtagtgactgaagtatggcaaagaacactgttaaatcttgcagtaccattaacttctaaaactatgtatgtatattaaataaaataacttaaaagtgatttaatgtaatccttaaggtctacatttaatgataccttcattctttaaaatatcgtcaggaagtttatgtagacgtgttcttagaccaaatatacactatcagccttcatgggaggaggtacacactatgtattcctttgtcatgattcgtaattattgagctgtgtattttgagaataattgatagagaatgtactggagatttacatggcctgttattgcttggttttaaaacttaaaggatacaggggtatatttttgtctaattcaagatcatttggatttatgacttttattagctttaaagaagcctacaatggcttttttcaaaaatagaatttttcttagaaaacagtttttaagagacaaatttatttaaatgcccactcttttaaaataaagttagatgtatggttttcaaataatcttatgtttgttattgaacaaaatcttatttactgtatatacaaatatatagtatggatgagtaagaagcagtgaattgctaatcagaatcccaccacttatcagtaagtgttttgagttgcacggtttgagaaagtactggttcaaatgctgttaaaaatcaaatttttgtatgctgtctctagatggtttgttgatgacctagtggttgtgttaaagaagtggagttacattgaagtcacgcgaatgttttgcttgtgtgtttggtggaacatttttagtatatgccacagcagatacgtggaatgctgatacttagggcttaacagttggaacccagaagtgagtatgtgaacaaataactgaaaggttacaaaataactttaatcatctcacaattctaatcaccacaaaaataataaagtagcatgaggtggtctatatttatggtttacattagccccactgtgccagggcagtttggaatttaagttacctggttcttggctctacctttagtttgtaccctttttatcaatagggcttttttgcccctataaggaatagccagttaagagactgcaacccaagaaaatcttgcctgaatggagtttcaggtaacgataaaagtttaaaaactagggtgttatatatattagaagtgacttgtctcttgatgcaaagtcatagactgctattttaagtcttgagtatttttttttgatataacattgaaggataccttacctattgtttctattgttcatgtaaatatacccttccattatctctccccactttggtttgccgctgaatttttatggaagaaatcaaatgattatacatagtgataacatccttctacttacagaaacattgtattaaaacactgattaaactcttgatgttttctagaggtgaaatctttatatttgggatgacatagaaggaagtaatttccctcataaaataaatgtgcaaagaacagcaaagcccagatgtgtcattggctaggcacatttattaacaagtttggatgcatcaggattacatatttaaatcaaatgcatatctcagcaaaatttcaaattgttatgtatttataggattgccaacagttaattgaaacttgtcattgttaaattttgctttaaataatctccaagagtaatgagtggctgggcactcactcatggctgtaatcccagcactttgggaggctaagacaggctgattgcttcagcccaagagtttcagaccagccagggcaacatggcgaaaccctgtctctacaaaaaaataaaaaaattagcctggcatcgtggcacgtgcctgtagtcccagttacttgggaagctgaggtgagaggattgcctgagcctgggaggcagaagttgcagtgagccaagatctcgccactgtactccagcctgagcgacagagccagaccctgtcttaaataaaataaaattaaaaaaaagagtgatgaaggtatgacattcctgcctgctgaagtaatctgagaagcctctttaagggggagttctctcaagaatattatcctcaacatttttaccttttaccttccttctcctgtggtagcttagaagtaaatattcataactgggaagtttgatgatcagtgtttagttgtaaattcttttaaaatgcacatacttttaagccatctagagattgtgtggattgtctcccttagccccactaggtgcttctctgtcctaagtagtctagaaggccaaaaactatttctcagactattttgcatttagggttctagatataaaatagttgtgacaattataatatatatgtgggagatttgaagggagtttatgttttcttcgtttttgtggtctgggtcatgaagaagtgagattttgccaacagtagcagaaatgcagcatagcattatttattctccagcatcttgagttatcaagaggcttttgtggttaaggcagcagctagactgttttattgtgtacatcccctagctgggtatttagaggcagttgtgacagtggcaacttcctgattcaagctttccaatccttggatcacagttatctgccatgtgttcttggatttagtggtcccattggtagcttcttatgatttcagttctgtagtgttctggtagtcactcctggagacatattcctatagccccattcctccattctttcccgtaactaagcatctaattcctttttaactcccctttgctcagaatatctagtggtttctattccctccaccaaatactgattgatcaaagtcaagagcatcctttggtgacaaaatgctactcttacatttagtagatggtactgtatgtgatgcaggatttttcttgaccccttctttggacttgtgatggaggtgccccatttactctgcttgcagccctcaaccccttgcaggagggagcacgtgagcaagtgaatgcgggatctggctggctgctttgggtgctggcaggagcaagtttcatgtgggccctgcgatggcacccaggttggggtgcctgcaacccctgaagccctagagggcatgttacaatgctgtcttagctccaccgtctgtggacagcggtgtgttaccagctcagtaggctccttgccttgttgcgtggggcagccgccctccactagtgagggcaaagggccagtgtgatagcctttatttatttatttattttttagatggagtttcgcccttgtcgcccaggctggagtgcagtggcacgatcttggctcactgcaacctctgcctcctgggttcaagcgattctcctgcctcagtctcttgaatagctgggattacaggtacccgccaccatgccccactaatttttgtatttttagtagagatggcgttttgccatgttggccaggctggactcgagcttctgacctcaggttaatctgccgtctcagcctcccagagtactgggattacagtgtgagccaccgcacccagccagacagccttttttgggtacctgcacttggtgggtcccaagttcttgtctggtgtccaagaaaaatgaggtcctgccagacgcttgaaggatggtggaggcggataattttctttagtgatgaaaatggctcttagcagagaggggagctagagaagagacaggttgggcaggtaatctttcctgaagtcaagctgcccctctgaagtccagggacctctctccagtcaagccgcttctctcgttcgtctttatctgcacaggatgaggggtgggttggccatcagtagttttggaaaaagcaacattcgattggtaaaaagacattattcggaaagaaccaactgggagagaatcggcagacggaagttctcattttgggccacaggtttcaggctttttggtttgaagttggggtttcactgggaacccacccctgtctgcctagaatgtctctgcttcctgcctctatcattgaacttcagatatataaagaagttattctatgatatgtcattgactaagcattaattatgttgacccttttagtgactctaaataaagagctctcaacaaacctatacctttaaagggaagaaaaactatacctgaattacacatgataatttcttagaaggcattaagtatttaatcatatctgaggagaatttggaaatgaaaccatttacagttgcaatttaaccagctctcaagagcattacttcctgtagcttatatcagtgctcctcaaactttaacatgcatacagatcacctcaggaacacttgagggtctgttcaaagtgaagattcagtagatggctgttgggacctgggattctacatttctcacaaactcaggtgattgtaattttgtgaaccacactttaagtagcaaagcctatagtatttacagttataaataaaggtaatattttacatttctatttatttgaaatttctttttgaatattaccatatcatagaaatttacttttttaacacaaaaatggaatattgtgcactactcagtagcttgttttttttcgctcagtggtatctcatgaataaccttccatatttttttaatggctgcataatatttcaagtatgaatatagcataatttataggcagtctcctcttgaaaaaatgtataaatgggaaaatgctttcccaaataatgtggatgtgaaaattcttatacttctatacttggtatttctgttgagcaggttcctataatgggtatttctaggtcctagttcatgtgcattttaaattttgatcacttctgccaaactaccctcagaaaaggtttgaccaaagttgccatctcattaacaaattatgacctgtttctcttgccgttgtcactggatagtgtcttttttttctccctgagacggggtcttgctttgttgcccagaggtggagtgcagtggtgcgatcttggttcactgcaccctctgcctcccgagttcaagcagttctccttcttcagcctcccgaggagctgggattacaggctcgtgccaccatagcgggtaattttttgtgtttttagtagagatggggtttcaccatgttggccaggctggtcttgaactcctgacctcatgatccaccctccttggccttccaaagtactgggattacaggtgtgagccactgtgcccagccaatagtatcagcttttaaaaacttagtcattgtgggccaggcgcgtggctcacgcctataataccagcacttggggaggccgaggcgggcggatcatgaggtcaggagatcgagaccatcctggctaacacggtgaaactctttctctactaaaaaatacaaaaatattagccaggcgtggtggtgggcacctgtaatcccagctactcaggaggctgaggcaggggaatggcgtgcacccgggaggtggagcttgcaatgaggcgagattgcgccactgcactccagcctgggcgacagagcaagactccgtctcacaaaaaaaaaaaaaagaaaaaaaaaaagaacttagtcattgtggaagatttaaagcattcattgtattaaggagattggatattttcgtgtgtttttcagccaattgtaatatgggaattgatgaactgtccatttttgttggattattttcttttttgagtgggtatgcttgctcatttttgttgtagcatttataaatattccttagaatacagatgtttttatactttgtgacttttgagtttctaatattgtttaaaaagtattaaaaaattctctttaaattttggacccataagcagctcatttgaggagcttgtagattttatgcaaacatgagcccatgcttctgtaggaaaatcttaaaactgaggtttaaggtggtgcctctaacctgtttaattctcgttcagatcaaattctgaaataataaaaaggtgggttttggaggttttctgtgtatgtaaactggaataaaaaagtggtttttttttgttttttttgtttgtttttttacttagctttatcctaaaataagaaagttgtctcttgagatttttgaaaaagtagttgcctcccactctgctaaatataggaatgtcattcagcaatttggttgtgattatttttatgtatgtatgtatgtatgtatgtatgtatgtatgtatgtatttatttatttattttttgaaacgcagtcgtgccctgtcgcccaggctggagtgcagtggcatgatctcagctcaccgcaacctctgcctcctgggttcaagtgtttctcttgcctcagcctcccaagtagctaggactataggcgcacaccaccgtgcccggctaatatttgtatatttttggtagagacggggtttcaccatgttggccaggctggtctcgaactctgacctcaagtgatccgcctgccttggcctcccaaagtgctgggattacaggcgtgagccaccatgcctggctttggttgtgattctacctggagagtttgtcatactcttgaatatgggcctgtctgcacacatgtgtgcatccagattatgattctccactgtgactgcttattggaatctcttgggagtttttgaaaatggtaatgcccaggtgtccccctcagtcctcttcctcactccccccatattctgatatatttggcctggggtttgtggcttgtttaaaagcttcctagatggctgtgcacagtggctcattcctataatccctgtgttttgggaggctgaagctggaggattgcatgagcccaggaatttgagaccagcctgggcaacatagcaagatcctgtctttaaataaaaataaataaataaataacagtcaattaagagcttatgtgctactaaaattgagaactacttgatcaaaggataggggatgatggtgcaattgatgttaaagcttcagctaggacagttgacataatcagacttactaatcaactttttcaaaatgcaaaactttaaagtaaatacagctgctctgagcctggaatgttattttctttagattactaaaatactatactgccacattcatgggagttctacagatgtactttttcggagcctgtgtagtgggaaattgtttagagcagtagttcccagttctgtctgcatgttaggatcatctggggaccttcagataaaaatgttggatgaaaatatatatattcatattctacccttgacagttgaatcagaattgctgggggcaaagcccaattaatggtattttttaagttcctcaggagattcttatatgtagccagaatggacaggggtgggtggtactgatttagagttataactagacaagatgtaaggttttaggttgttctattgtcctaaaagttaaatgtactgctgctagtattagtactagttttctgattatagtgattttactcaaactgtttttgtttggtttgtttatatcctttaaaaaggatgaagagctctttatttcagccaagagcttgaattggcttttcactgaactatcagttttggtggcacaccgaagtgaatttctctcctttgacaagtccttgtagggagtggtgctataatcataaattaaaaaataatttctccatgtattcaaatcctactagcctattttatcctggaccaagacacttaacctctgtaacctcatctgtaaaatgtaaatcatatctaacttgcataaaatattgatgtgagtattaaatgaaataatgtatataaagtatctagcattgtgcccggcactaaataatttcaaatctatgttctccttttcagcattcccttttactctcattgttctttctttcttttttttttttttttgagacggagtctctctctatcacccaggctggagtgtagtggtgcagtctcggctcactgcaacctccacgtcccgggttcaagcaattctcctgtctcagactcccgagtagctgggactacaggcatacgccaccatgcccggctaatttttgtatttttagtagagatgaggtttcaccatattggtcaggctggtctcaaactcctgactttaggtgatctacccgccttagcttcccaaagtgctgggattacaggtgtgagccactgtgcctggccctttttttttttttttgagactgagtcttgctctgttgcccaggctgggtgcagtggcctgatctcagctcactgcaacctccgcttcctgggttcaggtgattctcatgcctcagccacccaagtagctgggactacaggcgtgcatcaccactcccagctaatgtttatatttttagtagagacaaggtttcatcatgttggtcagcctggccttgaagtcctgaccttaagtgatcacctgcctcggtctcccaaagtggtgggattacaggtgtgagccaccacacctggcccacattgttctttttaaaagaacttcactacaggtgctccagtgcaggctagattacgtttatagttgaatactttaagtttcatacaataaaatttacactggagcatacagttctctgagttttgataaatgcctagagttgtgtaaaccaccaccatagttaatttacagaacagtttcccctcaccatcacccctcaaatttctttctaccccattgtttagtcaaaccctcccccacctttaatatttggcagctctggatttgtaccctatccttacttatttatttctatttattttcactcattcatttaagacagggtcttactctttcgcccaggctggaatgcagtgatgcgatcataggtcactacagccttgtgctactggactcaagggatcctactcacctcagtctctagagtagctgggactacaggcatgtgtgtcatcatgcctggctaattttttaaaaatttttagtagaggtcttgctttgttgcccaggctagtctgaaactcttgggctcaagcagtcctcccgccttggcccctcaaagtgttgggattacaggtgtgacaccaatcgcccactccagccccacctttttttttttttttccccaaagagagatggggcctcactgtgttgtccaggctagagtgcagtgactgttcacagatgggatcctagcacactacatctttgaactccttagctcaagtgatcctcctgcctcagcctcctgagtacctgggactacagggatctcccacctcttctggcctgagccctgtaattttgccttttccactgtgtcatttaaatagaattgtaaatcaatttttaaaatgggcttttattttcttgttaggtttttagatttttaaaaaattattctaggtacaaattcttcatcagaaatgtaatttgcaggtatcttctcctagtctgtggtatatcttgtattttcttaacagtatcttttactttcgatggatttcagtgtatccgttttctctaatggattgtgcttttgatgtatgtacgaactatttgtgtaactcaaggtcacaaacattttctttaagttttacagtctgatttacatttgggtctgatccattattaattttgtattaaatgtgagctaaagtacattttaaaaatatgtacatcttaattattccagtactacccagcactttgggaggccgaggcgggtggatcacgaggtcaggagatcgagaccatcctggctaacatggtgaaagcccatctctactaaaaaaattaggcgggcttggtggtgggcgcctgtattcccagctactggggaggctgaggcagcagaatgatgtgaatccgggaggcggagcttgcagtgagccgagatcacgccactgcactccagcctgggcaacagagcaagactctgactcaaaaaaaaaaaaaaaaaaaaaaaaaaaaaaaaaagactttttccccgttgaattgttttatcacttttgtaaaagatcacttttgctgtatttatgtgggtctatttctggtctccattccattcttttgatctgtatatctttttgccagtactgtaacttcatagttatgttttgaaatcaggtgttctgttttaaaatttttcaaaatttggccactctagtttccttggtattccatataaaatttagaatcactttgatgtttatccaaaaaatatttggagtttgattggcattgagtggaatctataggtcagtttgggaagaattaacattttaattatgttgttttccaatccatgaagatggcatctctctccattatttaggtcttattaaaatttctttcatcaatattttgcagttttccgtgtacacgttcttcacatattaaatttatacctatgtatttcacgttttggtgctattgtaagtggcactttaaatttttttgatcttcagttattcattactagtatgtaaaaatatagctgatcttttctttctttctttcttttttgagatggagttttgctcttgttgtccaggctggagtgcagtggcgccatcttggctcacttgtaacctccgcttcccgggttcaagtgattgtcctgcctcagtctcctgagtagctgagattacaggcgtctgccaccatgccctgctaattttttgtatttttagtagaaatggggtttcatcatgttggccaggctggtcttgaactcctcacctcaggtgatccacacaccttggcctctcaaagtgctaggattacaggcatgaaccaccgtgcctggcccagctgatctttttatattggccttggacttcgctaaactcatttcttctaggaattttttgtagattaatgggattttctgcatagccacatacatagtcatctgattagaaacagcttttttcctttccaatttcttttatttctttttcttgccatattgtatttgtaagactccgtccagtacagagttgactgagagtgactgggcagctggcctagaagtgcctcttctaggcacttctttttcgtttcctagtttgctgagagatttttatagtagtggatgttgaattttgtcaaatgctttatttatatcctatcctgtgacttttcttcattaggcttttagtgtggtaattaaattgaattttgaatatttaaaactatccgtgcaatcccaggacgaaccccacttgattgtggtgtaattatcctttttatatattgctagattgtatttcctaatatttcattgaggatttttgcatctttgttcatgtagtaattttcttgaaatgtctttgtcggattttgatatcagtgtgatcttatggaaattgggaagtggtccctcctattctagtttttggaagagtggtgtagaatttttttttttcttccttgaatgattagtagaattttccagtgacaccatttttggtccatgagttttctttgtgcaagagagttaattacatactcagtttgcttaatagatataggatcattcgtgttgtgtcttctttagtgaggtttagtaatttgtgtctttaagaagttggcctgttttattgagttgatgaatttaatgggcaaagagtttgtagtatttgcttatcatcctaggtagagttttattagtttcattgatctttagcactagcttttggttttgtttctcggtttttttctttttttttttcctttttaatttcattgacttctgctgtttattattccctttcttctgcttgctttgggtttttctttttcttttttttcctgaagtgtttgagatctttctgattttcttacataagcatttaatatgataaattttcctgtaaacactgttatgtcccacaactttgatatgttgtattttcatttttgtctagttcaagatatttctaattttctttgagatttcctctttcaagcttggatttagcaaaagatggtttaatttggaagtaggctgtctacatattcagtggattactgagagaggagtgttgaaatctcttaagtataattgtggaatcatctatttgatttctatcagttttttctttattttgaagttactgctgctaatttttcttgttctggagtttgctttgtctgatagaaatatggccactgtagccttcatgtgattagtgtttgcgtgatatatcttttcccatctttttacttttaatctgtatatatcaatcattacattgaaaactgagctgttatggacagcatagagttttgccctttttaaaaaaaagatctgagcggttgccctgccttttaaatggtttgttttgaacatttacacttgatgtaattatttacgtggttagatttaggtcttttaaaattacttttctctttgttcctcctttttctgccttttggattacttgaaatttttaaaatattctacttgatatatttattggctttttaaaagcttttctcttggtcttactattttagtggttgctctagggagtataatctaactcttgacattctagttaaggtaaatattttaccttctcaaagtaaaacaggtttttttcctagcctctttatattacagttgtcgtatgtgttatgtctagaaacatttaactcttcctaccaagcatgatgttacagttttttatttcaacagttttataagttttcaagaatttaagtggagaaaaatagtgtataatatttacccaggtatttaccatttctgtcgcttttccttctttcctgtagttccaagtttacccccatatcatttcccttccacccaaagaatttcttatagcttttcttttagagcaggtttcaatctctctctctccctctccctccctccccctctccctccctccctccccctgtccctccttccctccctccccctccctccctccccctctccctccctccctccccctctccctccctccccctctccctccttccctccctccccctctccctccccctctccctccctccctctctgtctctctccctccttccctctaccccccgccccgcctccgccaaagacagagtcttgtctgaggctggaaggctggagtgcagtggtgtgatcacagctcattgcaacctcagcctcctcagctactgggactaatacgccaccacgcccagctaattttttgtagtttttgtagagatggggtctcaccatgttgctcagactggtctcgaactcctgggctcaagtgatcctcctgccttagcctcccaaagcactgaaattagaggcatgagccactgcacctagcctgttttttgcttttttgtctgataatgtgtttgtcttcatttctgaactatacttttagtgaatacagaattctagcttgataccttttgatatcctataggggcctgagagattgtttgtttttaaaaaatatttcttctctcttttgttaagattggataatttgtgttgccatatcttcaagttcactgactcttctgtcatcttctttctgatagtgagccggtccagtgagtgagttctaaaattttcatttttttaaaaaatagtaaactctttcttttttgagaatttcagaccgggctctgtaatcccagcactttgggaggtcaaggtgggaggatcatttgagtctgggagttcgagaccagcttgggcggtatacaaaaccctgtcgctactgaaaatacaaaatattagctgggcacggtggtgcatgcctgtagttcagctgctcaggaggctgaggtgggagaatcacctgaaccaagaggttgaggctgcagcaagctgagattgcaccactgcactccatcctggacgacaaagcaagaccttgtcttaaaaaaaaaaagaggattttggccaggcgcagtggctcatgcctgtaatcccagcactttgggaggccaaggtgggtggatcatttgaggtcaggagtttgagaccagtagagggggtttcaccctctctactaaaaataaagaaaattagctgagtgtggtggcatgcccctgtaatcccagccactcaggagaattgcttgaatccaggaggcagagggtgcagtgagcctagatcacgccactgcactccagcctgaatgacagaacaagactccatcaaaaaaacaacaaaaaagataatttcacatttcatttgttttaaggtgttctttttttacctaatggatcatggttgtaataactgctggcctgtaatccgagcactttgggaggccgaggtgggcagatcacctgaggtcgggagttcgagacctgcctgaccaacatggagaaaccctgtctctactaaaaatacaaaaaattagacgggcatggtggcgcatgcctgtaatcccagctacttgggaggctgaggcaggagaattgcttgaacccgggaggtggaggttgtgggagccgagatcgtgccattgcactccagcctggtcagcaagagtggaactacgtctcgaaaaataaaaaataaaaataaaaaaatataaaataactgctttaaaagtctttgataattgtaatatctgggtcatctaggagtcagcatctgttgattatcttctgctttaagaattggtcagttttttgttttttgtatttgctgtgtttggtagtttagattctatcgcggacattttgaatattgtattgtgagattctgagtcctgttgaagtgctgtagagaaagtttaagatttgttttagtagacaaattgacctatttagtttatacctgcaaattctttctcatcttacataggcagtggttccattatctcttcagttttcaaagtctttgccatgttgtttgcatttgcccctcccattcccactttggttgatctagcacttgagcagtgatttatatcctaattttattgtgaaagcctcccttacacttctttggatctgttccatatatatatagatagcttgcagctgggcccacagacttagggatctacttttctgtctcttaatcatcagtgatttcacctatattcttcagctcccaggggccttctttattcccctagccagaagcatggaattatagtttgagtctcctacctgtcatgcctcacatggcagtgagcacatttagggagcccttgccctaaccatattaaataaaaacatggtggtggaaactaggaatctgttttaacaaaacttaccatagttacttttgataaaccaataacagatttgggaacttgtggctagaaacaatatttggcactagcaacatcaagttatactccctcccctctgttttttccctttttgcaagttgaggctcttaacaattcctgaaatagtttaccccaagcaccctatccagtggtagaaaatacagtgtactggatgccacaaagttatagtcatgcaattttagttaataacaggagacttaagtctcttgattgatggagagacttaagatttagcttattttacatatagctaaatctaaattagtgactttatttcagttgtaggcaaatcctcttgttaaaacttgtttttaatttctgagttcttttaaaaaaaaagttttacatcacatttctaagagctggagatgacagtgtctctgttttctgttttctctacaaataaacgtataacttaggatcagttaaaatatttcttttcacatcttaactcttatagatgggtggtgtctatcagcagtgctctgttaaagacagattcttaggggagtgtgggtccagagaagtaaggagtacctagattagcaaaatgtactaaggtgagtaagtgagtgtctgtatctttggcttttggaggggagtatgcatgtgtgtaaatttttctgtaacaaatggtactgtcgaaaacaattgacatacatttctttcatgacactatttttatacaagattactttaaatctgtagctaactacggtctgcttgtggtgaagtaaagtggttttagtccacagagatcttttttggaaggttatttgatgtagtaaaattatatatgagataaaaataagcagacacatgtttgagttccacttctgctattgtaactagctcttgtatctttgaatgagtcaggccttgctgacttcttaggccccgttgcattttgagttaaaattttgtgcacaaatagtgagctcactagtttcatgggaaatggagatatttgtgacagcattgaatgataaggcagtaaactttggttttatttcatagtggtaacttttctttcttgaaatagcagcctaaaagtatgccctgtaaactactatgtggtacagtattttttcattttggttaaatatctctgaagtatccttctaacttaaaagtgatttgaactcatttgaactattcagtgtataaggtattaaattatttttttaaaagagactgggtctaactatgttgtccaggcttcactcgaactctggggcctgagatcctcctgcctcaacctcctgagtggttaggactataggcacatgcgatcgtgcctgagtgttggaaattttccttttttaaaacaaatttttttttttttgagtcagagtcttgccctgttgcccaggctggagtgcagtggtgggatcttggctcactgcaacctccatctcccaggttcaggtgattctcgtgcctcagcctcccaagtagctgggactacaggtgtgtaccactacacctggctaatttttgtatttttattagggacgggttttgccttgttgcccaggctggtcacaaactcctgagctcaagcagtcagcctgccttggcctctctaagtgctgggattacaggtgtgagcaccctgcctggctgaaattttgattacatttagtgtgctgatgtggcagtctgctgaaattattttttttttgcaattaagacagcgccggatttactatagtaacttactttctgtttaatttctttttggcttatttttaatcctaaagaaacctgacatagtagtgtggcagactatgtttaaatagtcttgatcttatcattcaaatatatttccttagaggaataaagaaataactctagggatggaaatttgggtggagtattgtggaaatttaacttcaacctaggagttcactaaatgtccatgaagtgctattaccttaaaatgactttttttcccctccttctttagaatccagcaactatcacaagaatactccttagccacttcaattgggataaagagaagctaatggaaaggtaaggaactatattgtcagctttgtacttagaagtaacacagaaagcctattgaaccgaatttacaagaatcaagtaagggaattgatgaatataccagtatgtggacaacccagtgtgcaactagtgactgctttaatttcttgtattccccttttgtaaattttgcagtaaatttaatgttagggagttcagtcttagtgtttctttttatttgggagtatgtgtgtttgggggtgtgcttcagtatcttctacatatatcctcttgggtaccaagaactgaaagcaggtagagaaaaaaagcacctgataacattcttggagtacatgagtaagatcctcctttaattacttaaaaagatttcttgctcatccgggcatggtggctcacgcctgtgatcccagcactttgggaggctgaggcaggtggaacacgaggtcaggagattgagaccaccctggccaacatgctgaagccccgtctctactaaaaatacaaaaattagctgggtgtggtggcgtatgcctgtagttccagctactcaggaggctgaggcaggagaatcactttaacctgggaggcggaggttgcagtgagcagagatggcgctactacactccagcctggcaacagagcgagactctatctcaaaaaaaaaaaaaaaaaaaattcttgctcacaaacctttaacctgttattagtagcatttattcagtagaaacaaaattgagaagttgcttaggcttttctggccaccagaccaggtgcttggactggttctctggtttcagggcaggattctattccattgggtttttaaaaatattttctttctgaaaatctttatagttttaaaagagaagaaattagtgggactggagaatgacagtattaatgtcattcttaatcttgttctgctctttggtttggaaatttgtttgaatggaaatttgggacacttgttaatggtgaggttgacaacttatgtttatttcattatcaattctaaatttaataaaaaattaaacctagttgttgggaactgacaacccatatattatagaaataaatggaaagtatttcccatttgattttaaaattcagagagtactttataaaacataaataataccgagaatatcaccccatttcatacaccttgtatctattaaattacattgtaaataatatctattgttactattaaattacaatttaatagtaacaactatctcaaaacaaacacatactgtataaagctttcccatggttcatgaaggataacatgttcaactagtttgatttttctttttatgcattctgaccatgttttttttgtttttttttttttttttttttttttgagacggagtttcgctcttgttgcccaggctggagtgcaatggcgtgacctcggctcactgcaacctccacctcctgggttcaagcgattctcctgtctcagcctcccaagtaactgggattacaggcgccctccaccatgcctggctaatttttgtatttttattagaaatgaggtttctcagtgttggtcaggctggtctcgaactcccaacctcaggtgatctgcccgcctcagcctcccaaagtgctgggattacagttgtgagccactgtgcccagccctgaccgtattttttgacatcagtggtgtttcttaattttggtaacatttactttcaggtttttttatttgatgacacctctactaggagaaagagtttttatcgtttacttgtgaaactctaatgaattaacactgatttactcagagtttctctcatattaatgtatttctccaagacattctgaattttatcctataacactgctgaaaatatttttccattaaatattgtacttaatatttgtgtactattggatttaatgttgtactaaattttgtactttatatgggaactgtagcttctgctcagtttttctgggaaccttaaactgtctaaaaaaataggtggtaagtgtgaatttaaattaaaaggaggtttctgggaaacttctgagtatgtgaacgtttcagtttctccttgtagtttctgtagagaagctattggatacctaaaagatttataattcagtctttaaatagtgtctttaaaatcaatatgcaatatctttttgtctcatttaatgattttcacattatattttatgttgtctgctattagcactgccacactttttttttttttaaagcatttgactgatgtatcttttccattttttaaatattcaacctttctgggttttaggagtgtcttttgtaaataccatgtaggtgccgtttaaaaaaatctgaatgaaaaaactattatcttttaatatcagagattaacatattcatgttttataattaatgtttagattaaattactgtcattttaagttgtgctttatatttgttatgttttctgttcgcttattctgttggcctcatcagattttcctttttctcgaataatttcaaatttatatatgtattctatttcagtttttctagtcacttttacaatttgtacatgcctacttacaactatataaaagtttctaacaatatttacttgaagttttaatccatcctctgtacaagacaaaaactgtagcataaatttttttctttgtcctttccttgtccctatcagcttgataagttgatgtttgaatttttttttttcttttctttttgaaacagggtctcactctgtcacccaggctggagtgcagtggtgagatcatggctcactatagccttgacctcctggactcaagcaatccttccatttcagcacccccagtagctgggaccacaggcacgcatcaccatacctagttagtttttatatttttttgtagagatggggtttcaccatgttgcccaggctggtctcaaactcctggacccaagcaaccctttcaccttgaactcccaaaatgctggaattacagacatgagccactgtgcccagtcgatatttgaattttttatttgattgtaagcatttttactatgtatgtatttaatgccccccccccccccttttctggctaattcgctttttgcataccactattttttttctaaatacactgtttttcttagaatatatcctgtaatataaattgtttcacatgtgacaaactttaagtcctataatagaaactcttaatatactgaaacttactgtaatatttctggatgtgagttttgaaaacataaactgttgggccctttaagtctgacaattcatatttttggttttggaaattctcagctgttatttgttcagcataccttttctccattctcttgatgctttctggaattcctggatccatgttgaaacttggggatctctttccatgtcttctaacttttttttttttaagatggagtcttgcctctgtcagccaggctggagggagtgcaagtggtgccatctcggctcactgcaacctccgccttgtgagttcaagggatcctcctgccttagcctcctgagtagctggggttacaggcacccaccaccatgcctggctaatttttgtatttttagtagagagagggtttcaccatgttggccaggctggtctcaaactcctgacttcaggtgatcttcccctctctacctcccaaagtgctggggttacaggcatgagtcattgcatccagcatgtcttctaactttctaaaaaatacttcttctgtattcatctccccacccccagcacttgggcaagtgccagtgactgtactcatctttgtttttgactttgttctgtgaaaattcctcagtttatcttgcttttcttcctgcatccattctgctttatagtcgtattgaattgtttattcaacagtatccatcttattccttttaataactttgttcttgttttgtgggtacaatttttgctttatctctcggtttattcttacattaaaataattagaattaaataatgagaatacaaagatgagatgtggctgaaaaggtccagggcaatttacagtcttaagggtttttattagaaaaagaaaatgaggtaaaaaactgggctgcgcaccatggctcacacctgtaatcccagcacattgtgaggccagggaaggcagctcacatgaggccaggagtttgagaccagcctggcctacatggtgaaaccccatctttactaaaaacacaaaagttagccaggcgtggtgatggacacctgttattccagctatgcaggacgtggaagctgaggcacgaaaatggcttgaacccgggaggctgaggttgtggtgagctgagattgtgccattgcactacagcctgggcaacagagtgagactctgtctcgaaaaaaagaaaaataaaaacaagagaatgaggtaaaaaaaaggaccaagcctttgaaacaggaagttagaaaaataaaataaacccaaagaaagtagaaaaggtatttaagataaaattagatattaatgaactagagagcaacaacaacaacaaaaaagataaagatctttgacatgaattttctggaagataagctacagactgagaagatatttgcaaaagacacatgtaacaaaggactcttgtccgaaatatacaaagaactcttaaaactcaacagtaagaaaacagtctgattaaaaaatgggccaaagagcttaacagacacctcaccaaagaagttatacagatggcaaataaatgaaaagatgctccatgtcctatgccatcagggaaatgcaaattaaaacaacattgagataccagtacatacctattagaatggccaaaatcaaaatactgactaccaaatgtggaccaggatgtggagcggtaggaactctcatcatttctcgtgggaacgcaaaatggtacagccacaaaatggaagacagcgtggcagattcttaaaatacaaaatgtactcttactatgtaactcagcaatcaaaacttctttaaaattacccaaatgagttgaaaactgtgtccatacaaaaacctgcacatggatgttcatagcagctttattcataattgccaaaacttggaagcaaccaagatgtctttcagtagatgaaaggatgagtaaactgtggtacatccagaagtgggatattattccgtgctaaagaaatcagctatcaaaccatgaaaaaccgtggagggactttaaatgcatattattaaatgaaataagccaatctgcaatggctgtatactgtacgattccacctatgtgacactctggaaaaggcaaaactatgaagacaatgaaaagatcagtggttgctaggggttagtgaagagggagggatgaatagtcaacagcacagttttttttttttttgggtgggtgggggcctaaactattttgtatgatactgtaatggtggatatgtatcattatgcatttgtcctgacccatagagtgtataacatcaaataagaacccttatgtaaactacagactttgggtaacaacggtgtgtcaatgtaggttcattgaatgtaccactctgtgttgttgatagggaggctatgggtatgtattaggacagggttatatgggagctgtagcttctgcatatgtttgctgtgagccttaaactgctctaaaaaataataagttttttttttcttttaaagggggaaataaaccgttggcaaatgtgttgggggagggggagaagacacaacattgagaataataaggcataattagaggtaggaaaaataccgtgtgctacttttacatctttttttttttttttttttttttttgagatggagtctcgctcttttgcccaggctggagtgcagtggcgcaatctcggctcactgtaagctccgcctcccgggctcacgccattctcctgcctcagcctcctgagtagctgggactacaggcgcctgccaccatgcctggcgaatttttttgtatttttagtagagacggggtttcaccatattagctaagatggtctcgatctcctgacctcgtgatccgcccacctcggcctcccaaagtgctgggattacaggtgtgagccactgtgcccggccttttttttttttttgagatggatggagtcttgctcggttgcccaggctggagtgcaatggtgcaatgtccactcattgcaacctctgcctcccggttcaagcgattacaggcgtgcgccaccatgcctagctaatgtttgtattttttggtagagatggggttttgccatgttggccaggctggtctggaactctgacctcaagtgatccgcccaccttggcctcccaaagtgctgtgtgagccactgcgccagcccaagctggtccacttttacatacatttgaaagcttagaaatggaaattacctaaattgtccctcaagaagaagtagaaaaatagagtaaacccataaccagaaaaatatggtgaatatagtaaaagattccactccttccccaaaaagtactggatgattttatgggtaagttctgtctcataaacgttcaaggaactgccagttcctgtagaaaattatctccaaacattgaaaatggtaggacatcattaattcatgttagccagatcagaataacccagttccaaaatttgacagacagtaggagaaaatgatacttataaatatagctgttgaatttataaataaaataatgattgaatcaacgactcttagtaggatttctctttttttccttttgagacagggtctcactctgtcacccaggctggagtgcagtggtgcaatcttggctcactgcaacctccgcctcccaggttcaaatgattctcccgccttagcctctcccaagtatctggaactacaggtgcgtgccaccatctctggctagtttttttctttatttttagtagagatggggtttcatcatgttggccaggctggtctcgaactcctgaactcaagtgatctgcccgcctcagcctcccagagtgctgggattataggcatgagccactgtgcctggccaatttagtaggatttctcctaagaatgcaagaatagatcatcatcgggggaaaattttttcgtttataacatttacaacattaacagatttatgaagataaagaataatcataataaatgtcagttatgcattttaataaaattgtgtattaactcgtgatttagtgaaaactagattcttagcaaactgagaaagtgatttctcagattgattaaaggtatcaactaaaatctacaataaaattatagttaatgttgaagcatcagaaacatgcccattgtaatcaaacaaggattatggctgtcaccaccatttgaatgtattggaagttctgataaataacgtaatacatggaaaattaaataagtggcataaagactagaaaggaagataaattatatgtaaagtatataatctaggaaacccagaagaatcgactgattaactattaaagtgattgcccattaaaatcacctgagaagtgaaaaaaacccacagtgcccagtccctttccattacttcttccttcagttctcttggaaaatgaaaagaaacatggaatgtaagtagttgtagcttcggtgacccctgtgttcctccacattcttttttttttttctcaatttttttgtagaagcagggtcttgctatgttgtccaggctggtctcaaactcctagacacaagcgatcctctcacctcagccccacaaagtgctgggattgcaagcgtgagccaccacgttcaatctccacattttttgcatataaaaattgaggttacccatatggtaatcctgtaggtatttagtatcctaggaattgttaagaaaaggtaagcaatatacctacctttagtctacatatagcccataaggtttgtaacatcgtattttttaaaaatcgtgcttcctaatgggtaacactgaatgtattaaagtgtcatttctccttatttcgatatatttaaagataaatcttatcctagttaaaattgtgaaatattttaaaactttcttttcctttgtcatttccatataccaggcatattagtatttctttttattttattcattagtaagccatagtccctgccctggagggaggtgcccatggtcccctgagggcaatagaggtataaatagatccttgccagttattcctcttgtttgccccatgcctcttagtctgtagtttaaacaaatttatactgaccctaaaaatgaatgtgattttttctttttaaaaatatattttgaggcaggtacagtggttcaaccctgcaattctagtgactcaggaggcttaggttggagggtcacttgaagccaggagttccagaccagcctgggcaacacagtgagactccgcctttaaaaagaagtaggaaacttagctgggcatgatagtgtgtgcctgcagtgctgcctaccagagaggccgaggtgggtgtctcacttcagtgcagagactgcagtgaaccctgatcttgcactccaacctgggcgacagaggaagaccctgactcttaaaaaattaaataagatataaattttgggcaaaggtcggagctggtggagaaaggacacctttaactttatggtcttttcttttatccattatagcagttttccagaccactgtcattttctttcttttactgtctaatgcttttttttttttttttaaatctctgcagattaatttctcttctgttttacaaactaaatagaattttctataattactaatttctttccatgcctctccagatgaagcaaagcaaagcataaaatcagaaatacagcaacaactgttatctgtcaagtcttccatctgggttttgatactatcatgatttttgtgggatattgcctccattatttcatctgtcatatcttgaaccttttcctcctttcttggtatatcagtcaggatttttcattataaacaaactttaagaagttaaaagtgaaatagacattaaagattgagaatcttaggtgtgaaggttgtgcagtcaggaaaatgccaaaatcagaatgtcaaactattttagtggaggcactgttgctgctgccattgggcacaggtatcactgctgataacatcaatattgggcatatgacaccacaactaatacctctgcaacgtctgaaagctggatatctccttactcctttgatagattacctcattgaaccttctttgagtagtgagtttttgataaactgtctccctgctcctgcctgggaggaattctctcacctggagggatgggaaagtgaattgtgtcctctgtttaccttgctagctttttttttttatctccgtatccttatgtctgttctcatattacactttagtagtacaaaacttttgtgacagtcaccaaattcatttttctgctgcctcagctttgcaattgtgttttgacccagggcttctgtttactgtgcagctctagggagcatctttggaattgtactgtcattggcccaggcctgacttgcctttcttactgtcttttttcctaattttccttcaaaactcaagttaaccttttcttctgagacagcttttcttatctctcaagatctacttgctttgcactgtattgtttatttgatttagtattttaccacttctatttgaggttctttgtgcagaaactatcctacttttcttgtattcctacacataacgcagttcctaatatatagccattgtttactaagtattttaattaaatccagccatttataggttttcttttctgtaatagaattttattgaagttatgacatgaatgtaaatcagatttcattttgggagcttttagaaacagcatcaacaatggagctacttttaagttgataacaagtaaaaaaaaaagtgtctttcttgcagctcagatttcttgtaggttattaaattataataacatttaaaaactcatttcagttgatagtatggtagtatatagggtaaatgctaatgaattaattggtgtgtttgaggtgggatgaaatacaggtggttgaaaacttaaccacctataaaacttaattatacttggacaggtataattaaagaatcctgaagaaggatttcagtctttcctggactctgttacaaatagcttttcacttttcattctgaagcattaatacccatttaatgggtaggtactagtgttaatacttggatgtgattatgataacatggaactttttgtagccacattattaataatatataatttcataattagcctcagggatggtgaaagtaaatttggtttttcagaaaccttgcctttttgatgacatttatcactattctacaatacagtgaaatttttcctgtttaaacaatccacggccgggcacagtggctcatgcctgtgatcccagaactttagctgactgtggcaggaagatcgcttgagcgtaggagtttgagactagcctggacaacatagggagacccccatctctacaaaaaaataaaaaattagctaggtgtggtgatgcacacctatagtcccagctactcagaaggctgaggcaggaggattgctggagcccaggagggtggagctgtgatctgtgatcatgtcactgtactctagcctgagtgaccaagtgagaccctgtctcagacaaaaaacaaaaaacaattcacgtattattgaggagagtagtgaagggcaagaggcaaatgtacggctgggtgtggtggctcatgcctgtaatcccagcactttgggaggccaaggtgggcggatcatgaggtcaggagatcgagaccatcctggctaacacagtgaaaccccatctctactaaaaatacaaaaaattagccgcgtgtggtgatgggctcacgtagtcccagctactcaggaggctgaagcaggagaatggtgtgaacccaggaggcggagcttgcagtgagccgagatccaccactgcactccagcctgggcgacagagcgagactccgtctcaaaaaaaaaaagcaaatgtactatctcattatagtacagtgattaagaacacagaattcttgctccccctatctcactatctcacctagactggagtgcagtggcgtgatcacagctgactgcatccttgaactccggggctcaaactgattctctcgcctcagcctccctagtgggtaggactgtgcaccacaacacctagcaaattttttgtagagatgggaccttactttgttgaccacactggtctggaactcctggactcaagcagtcctcctctcttggcctgagccactgcaccctgccaggaattttttaaatatcagctatgtttaagacattgagcaggagcttggtgatgaggagttacacacaacagtgtatcatacaatagaccaccatggtacgtagagataagtttttatggctccatggtacttagagataaatttttatttttgacctaggtgggaaaggatttagtaatgaggtgtggcatttgattggacaaggaagggcagaagtgatatgggaacctgggtatttaaggctcagaaaacaaaactaagtggggcacaaagtttaaggaatatatgttgaacaattatgagattgaatgtctggagtatgcgaagaatagaggggaaatggttggaaatgtttaatgcacgttataagggccttgaattttaagtaagtgaatttggaatttttctgtctttattgggaagcccttgaacgttgttttatggagaaatagtgatggaaaagcattatttcagaaaaaaatctagtaataaatgagctgttttaactatccaggtaaaaggaaaatattgtcctgacttacaatagtgacagctaaattgatagcagagggtagatggaaagagaagtaaaattagttttaactgagacaaaatataggagactctgggaaacttctggtaattttgaccgttcctttcactaaatacactagaagaggctaggtgaaatactgaaacatgtttgaaaagtaagattatcaaataattagtaagataggaaatagaggttcaaggttgagagtttgggaatcaagggaaatttagagaaacaagcttccagtccttgttgctctagcagtgtatgttgatccagaagaggtagctaagagacttagctgtgagttttgtttgccctttgttagtagagggggaagttggaatattaggtctactaagagcgaaaattgaatacactagctccttaaagactgaagatgatcttcatgtcttttgggtagtccagaaaaccttaaaccttgaacttgggttaagatagcccccgtatataacagaaacaaacgtaaatcttctctagggaaataacattatttaagaccttaaactattttctcaaattatttttctaattaaaacataacaacctggaacttaagatactggaattgtcagacctagaccaaaatgagtatgctatcaccagggagctgtcattcagatttggaaaaaaatcagaatttttataactaaacaaaataagcaaaattaactttgtgacatagtttaacagcagactggacaaagctgaagagagtttagtgtatttgaaaatcaaacaatgatccagaattaagtatatccattaaaagatggaaaatacagaagagattaagaaatacagaggatataatgagaaggtctcattgagttttagaaagagaggagagaatgtggcagaggcagtattttaagataaaaatgactgagaattttgcagattggtaaaagacccaaatgtcatagattgaagaaacataacagttcccatgtgtgatagctacttgtttcactgatcctaagatacacagtttttcacattttaacatctgaaatctggatgcatctttcaattattgacaccttacagtccaaaaagattgaaattttgactcgtgaaaaattttccatgtcaacttctgttaagatcatgaaatttcagcacgaaagcattttagattttatgaaatatggtaaaaagaaatccacatttttatttatttatttatttatttatttattgaaacacagtttcattctgttgtccaggctggagtgcagtggcacagtctcagctcagtgcagcttgcacctcccgggttcaaggcattctagggcctcagctttctgagtacctggaattacaggcacgagccactaggcctggttaactttagtatttttagtagagatggggtttcgccacgttggccaggctggtctcgaactcctgacctcaggtgatgtgcctgcctcagcctcccaaagtgctggtattataggggtgagccactgggcctgaccagaaatccacatttaaaaacatcttagtaaaactacaaaatcagcaaaaataaaaaatctaaatcaatgagatacaagaaaggctgctttcaaaagagtgaaagtataggtataataatattctagagcacagctcaacagcaacagtgaaagtgatagtaagatgatacctcagtcttttgaaagaaaataaaccttacctagaatactatgttcatggaaaatatattcataaacagtatgttttaattaatataaatggttttatgttgtacctagcttttgtatctttttaaagccaaccaacattttgttctgccagtgttgattgaagtttcaaatactcataattgttatttaagcaactatttgtctgttaaagggaaaaatcttgcagaatgttgtactttggaatttataaccttaaatgcataatgagctaagcattcatcttaaaagtctcaagtaataagcttagaggtctcaagttaggaaaagaacaacaaaataaatatagggaaaatacaaggaaagaaataaagaacagaatataataaaatagaaaacatgcagtagaagggatcaagaagccgtaagatttttttttttttttaagactgataacgttgacactttgatgaggttaggaaaaagagagatcctaaataaccagtattaggaatgaaaacagagtatcactaggatcttgtggatggtttaaaaaaaaactcttaaaattatggacaactattcaaacttgatagacgaaatgggtagattcctagaaataggcaatttcccaaaactgacataagaaatagtaaacctgtatccttattaagtataaagaaatgaaatccataatttaaaatgttcttataaagaaaagttgaaattcaaatggttatactggaaagttctaccataacatttaatatgacagtaacttcaaccttattctaaagaacagaaaaataggatcttctgccttcataaagatatcataacctttataccaaaacccaaggaaagatgatacaccagtttgtcttatgtacatagatacaaaaaaaccatacatacacacacgcacgcacacaaaacaaaaactggaacaacagaaacacctcagaatattagcaaattgaattcagcaatacatatataaaaaggagggtaacccagcatggccacctgaggtgaatcctgggaatgctaggttggtttaacctgaaacaattcagcatgattggtcacttgaacaaattgatgagaaaaacatttcagagatgccaaggagcctttgcttcatgattttaaaaagaagctattagcaatctagaactttgttaaccttataaatcttacagaaacatttgtaggagatatcatagtttatccactgaaatgttaaaaaagatttcccttttagatgggagttcaagatgtggatatcgtatctccagttcaattcagcattatactagaaatgattctagccagtagaacatcaaaaaatgaaaacaaaatacagtgttgtaagagaaatgcctgtgtttttgggggttttcttttttttgagatggggtcttgctctgtctcccaggctggggtgcagtggtgagatcatggctcactgcagccccctacctgccaggttcaagcaattctcctgtctcagcctcccaagtagctgggactacaggaccatgcccccaagcacagctgatttttgtatttttagtagagatggggtttcaccatgttggccaggctggtcttgaactcctgagctcaaggaatccacctgtcttcagaagtgctgggattataggcgtgagcccgtgggcccggcccctggctgttaatattcactgacaatgtgattgtgtattcacaaacaatgtgattgtacatgtggaaaaatcagaatctggaggtaaattgttagaataaatgtctttagaaagaaatatgaaaaatttcttttttctttgacccaataattccgctctcaggtatatatccaatagaaagaaatacgtgcacatctacattgaaagtcatatataaaactggtggtggctcatgcctgtggactcagcaacatgggagaatcgcttgaggccaggagttacagatcagcttgggcaacatagtgagaccccgtatttacagaaaattaaacaattagctatgcatggtggcatctgcttgtagtcccagctactcaggaggctgaggtgggaggattgctggagcctaggaggtcaaggctgctgtgagccatttttatgccactgcactacaacctgggcgacagagtgagaccctgtctcaaaaaaagaaaaagtcatatataagcatgttcctagcagtatttattcatacttcaacctataaacaacccagatgtttatcactattacactagatagataattatggtatattgacatagtaactattcagcagtgcaaaataaatgagcaaaagctacaagccacagcatagataaatcttaaaaacatagtgaaaagaaaaggaccccaagtaatacctatctactatatggttctacttacataaaatataaaaacagttgaaactaagtttatattgtttaaggatgtgtgtttaggtggtgtagctatttaaaaagggcagtgattaaaacagttgaaactaagtttacattgtttaaggatgcatatttaggtgtaattattaaaaaaaaaaacagggtagtgatcatacgtttaggggggcttgtagagtactagcagtcttctgtttcttgtcctgggtggtatttatatactggtgtttgttttataacagtttgtaagctgcatgtttatgtacttctctaggattgtgttattgcaaaataaaaatcattttaaaacacatatacacagacataggaaaaggatcagtcttaaagggaaggtccatcttttttcctggacatgtaggattaatagttcctttgtacctacaagtaaacttacattttgccaagacagcttttctcactgctctcctaggctctagtatattaaatctatcctaaatttaacttagattgtgttaacttacttgagcaacctctgctacccttgtggtttctgccacatcaaagccatactccccggatttggggtttgaaaaccttgtgtacattcactccattctgtatgtctttgcttataactgtatattccttgggatgccctctgctattcaggcctcaatcttaagagctgtagctttgtacagaatcagagcgtatcaagaatacttcattctggggttgtgctcatagccatcacgtacaattctgtgcatcacaaatcgatgcctcctatgtcttcttattgtctgtattctttttttttttgagacggagtctcgctgtcgcccaggctggagtgcagtggcgcaatctcggctcactgcaggctccgccccctggggttcatgccattctcctgcctcagcctcccgagtagctgggactacaggcgcccgccacctcgcccggctaattttttgtatttttagtagagacggggtttcaccgtgttagccaggatggtctcgaactcctgacctcgtgatccacccgcctcggcctcccaaagtgctgggattacaggcgtgagccaccgcgcccggccttattgtctgtattcttaccacatttaccaacttgtttcaacatcttgaagttagttttctgtacttctctaggattcttctcccattcttgcatgctaagtagcatgtcatactacaaacaggtattcatctctttccttccaaacaattgacattacaactaactagcataattcctacatatagttgctgaataggtgagggaactgtgttaaatggaacttaattatattactaccttgtgttttgatggataatttgttttaacatagctgaattttaaacatacttgtttgattcataggctttcaacttttacagcctgaggacttgcattagatatattgaaaaatcgttatcaaaacaataaaaagacaatttctttttatatacttgaagaaacgatatttctcttcagttggaatgagatccactgttgcatgaatcacaagtagtagtgtgttttattttctagataaaaatgtatagcaggagcaaaagaccattaagcagagggtgtagatttcctttaatgcacgtatttggaaagaggtggacaaaaaaagccactgtcttggttttctttgaagtaaaaatagttttttaaaaataatggttcttgtcgttttggggactgtagtctcttttgaaaaagtaatacaatcttgaaccttctcctgggagtgcgggggtggggcgggggcagagaacatttgtaaataagttataacatttggattctgcccaattgttgaaatgccagggacctccaattacaaatttatgtgtttgatgatcttggtaaaactgaaatagtcataagccagaagtcgtagacaaccaccagtaaagatgacacatgtgtttgtagtgtggctggaacaccctgtgaaaaccagcatctgtgtcttctaaagcctgtattgtacagatgttctccattctgtgttagaaaaagaatagtcattaacttcttttgtaaatgtcctccatacttttatttttatcttttaaattttatttctaatagagatagggtcttgctatattgttcaggctggttccgaactctgggcttgagcgatcctcccagcttgtcctcccacagtgctgggatacaggctcactagctactgcacatagccttttttttcttttgaaattttatttacctgcatagttttacatctacctttaaaactcatgagaaacaataaaattttattatgtaaaaaagctttttgattagcaaaattttttatcgtaaaagctgaatgggggggatgtaagaggtcaatttactgttcacttggcttttgggtatttaggtttttctgtagtaaatgggtattggatccctttggaagatggcatagtttattgtaattctgttatggttttgcgaattcgagcctagaaagagttatcttaacatctgtttcactgtggttagttccttaatccacctgccttcatcctggctcagaactaaaaaggttaaagtatgcagtaagatttttgtgctgccacttggaagtagtattaattagtagctgctctatcaagcattcttttgcttagcagtaagcaaacttaggagattttattacaatgctgtttttttaggttttattttattataatgcctttttaaaaaaaattaggctaataagaaaaatcttatggcctcaaaaagtattctactttttctgaaaaatatatgagcagtatgtatatttagctataaaaactacatagaatacccatttttttttagagattagcttaagaaacctaagtcttttatagcaagctgttacagatttgtgtgagttctcatttttgttgttgttgttgttgttgttgttgtttgtaacatgagggctaaaagctttccttaggataaaaaggttttctatccttaactcctttagatggtttttgttctttggaattctgaacttacctagtagaggtatgtagttatgccagtcatcttacattcttttgaaagaataactttaaaaaccacaaaggatgcagtaatatcttttaatttgtttgaaaacttacattctgcctcaggaacccttttttaaatttaattttttatcaaagtaacacaatcatgattttttaaaagtccaatagtttcccaagagttataaatgaaaaatagtgctccaaaccctcagttccaatcccattccccagaagagaaagaactatttattttagtattttttatgacttattattccgtattgctgttttaagacagtcatcttcatacctcatgttacttttgctttttataaatgtgacggcagttcttattcattcgtatgatttaaatgaatttaagatattcctttgctcctttgacattttcccttaaatgtacattttctaaaagtagaaaaaaattacatcattaacaggttaatgtggctggggggagttgaaatggcagttcttggaagggttttggcaccctggatttttgttctttgtcagaactataaggtatagaataattgtgacttttgtagtattttgaaattgcaatccgatacccataaactgccatatgtgagtgttaaaacagaaatgttttggtcatttagaagtaaacgttatgtgtatatacattttcatacatggatacatataacctataatgtgttttttaatacattttcatatgtgtgcttatttttactccctctcaggcttatagcaatagctagttgacttgcaaatgtataatggaagcattaaaagactggataggaggattgagctctgatagtttaagaataagcatagaggctgggcgtggtagctcacacctgtaatcccagcactttgggaggctgaggtgggcagatcacttgagcccaggagtttgagaccagcctggccaacatggcgaaaccccatctctactaaaatcacaaaaaaattagccaggagtggtggcacacatccgtaatccgctactccagaggctgaggcacaagaaatgtttgaacccgggaggtggaagttgcagtgagctgagatgaagccagcctgggtgacagagagagactttgtctccctctcccccgcaaataaataagtaaataaaggaatacagcgtacaaaagcctactttatatctttaaattggttttacattttgcttttctgattctattgtgagaattagtacttctccaatagttgttggtctttatgaagtatgaagacttagtagctttgaagataaaattaaatattcgaatggcagtgatgccacagtcactcaggattcaagaagaagcattagccagtggtgatccctaccagccccgtttcctctctcctcaaccagacataagagctcttaggctgtaactttcctgccttgaaatttaattcatattatttggtatgtttctctatagcaggcaagtaaaatgaaaaattaagattcaaatattctggaaagttgtctgagtaccaggttgctcagctgtatttctgtaaatatactcaatgtgcagaaataatcctggagagaagagaatttacaatctactgagaaactgcttaaatccaatattttttaaattgacagattattgtctatatgaaaatcttaatgtagagaaatataggccataggaatgggtgttaacctgcttgtgccctttcttcactaaggaaaggctgaaggagaaaccatactgctgcttgtttttttactttgatcaatatgatttcctgaaaaggataggcagggttacagggaaggagagaagcacagtcctaggataagctttgcagctctttcaagtcaatgaagcagagagaagtatttggttaactcattaaagatgcctcaactacagtgctttacattgagtcagttcctttttattttggtctgattttcagaagcaatgatttacatagaagccagcaaactgaaggaacttccagatagtgcccaggtaaacagtgtggatagttaagaatccagcctattcttctatgcctggactactatccaggcacagtagtcttaaataaaacaatcataattagaagaaatcagctttgtcttaggaaattaaacataagactcttgagatgagggatcagaggtaaactgataaaacaacagaaggtgaaaagggaactgacagaacagaaaaaaaaaagaaaggataaataatgattttgtagaacttcaaaccatgttgatagcagaaagaaatagagcaggcattacagaaaataggtctggaagacaggaaaaggacaaagaagtaagtagcaactggtaaacatggaggacaaattaagagactggatgcaaaccaaacatattcttaacaactaaaggatcttgaggtaattaatatccaaatgacatttcaaaagagaaagttaagtgcttagaataaagcctagtggaactgctaaagttcaagaataaagaaagaagaaaatgagaaaattattttggccagacttcctcagtaacaacaggtaacaagaaaatagaacactatctctatatgaatattgaggagggaagggattttggccaaagtgagcagttgaacacatttaaacattagaattatgtctaagtagttggaggtgatcaagtttatgagacaaaaaacagttatcattcttgaaagaaaggctacatgatataaaaacaatgggccgggcacggtggctcatgcctataatcccagcactttgggaggctgaggcgggcagattacaaggtcaggagttcgagaccagcctaaacaatatggtgaaactctgtctccactaaaaatacaaaaattagctgggcgtggtggcaggcgcctgtagtcccaggtacttgggaggctgaggcaggagaatcggttgaacctgggaggcggaggttgcagtgagccgagattgcaccattgtactccagcctgggtgacaagagcgagactttgtctcaaaaaaaaaaaaaaaaaaaaaaaattagtgaaaaaattatataaaactgtaatcaactgggaagagctttaggaagttctgaccaaaaccaaagggatgatcaatgtattatttaagttttataaattaagaaatgtatttaagtattaattacataggccactcctagtaaaactaaattagattttagtaatttccaaataaacattgtggagtcaggggtgaatggaccatataataaatacagatcagaacaaatacatgaaactttggtaaaagaaaaagatttctgggcctactacccccaagaatatgagtggatttttagcttcccactcatatttcatttaaaatacttagcagtatttgaaagttcctttggtggcttctagaatggatcaaaaagctataaactccaagccacatgtagtggtgtgcacgtatagtcccacctatactcaagaaggtgaggcgagaggatctcttgaggccaagagttcaaggctgtatgctattattgcatatgtgaaaaactgctgtgcaccagcctgggcaacatagtgagaccctaactcattttttttaaaaaaggtattaactccaatatacgctatttttaaaaatgctgcaaactccagtacatgctatctaaagcacaggaattcagattgatagtaaaagtgttgatgtgatcggacccaacaccaggctgtgggggcgacaaagtccagcggagtcaaaggaatgagaaaagacaagagacaaagtgggaccagggggccaacgctagtatggaggctgcgaaggcctggagctctgggagcccacgctatttattggtgatcaaacaaagaaacaggtggtgaggatgtgggggttaaaaggaagcggtgtatcaagcgaatgagctacagctgtgagggtttagcattttctttgaaacatatggctagttgagataatgggagtgctagaagtaaggagccagcagtctagcaggcatgcaagccctgcctcagcttctctcccgacactcagcttttctcccaacaaaaagaacttgaaatacctgagaataaagttactggaagatgtgcaggatccacatagtgaaaaaaagttataaaactattgagagactgaataggaattggaattaagtaaattaaaagatactttgttcttggctaggaagacaatattatagagtcaattctttcagtcagtttactcttgatataattgtagtaaaagttccaagaggatttgaaaaaaaaattaatgattgtacttaacttgaaaaaacaaatatggaagaacagagaaaattctgtgagaagaatgataaagggatctttgtcaaatattgagaatttatcgactacaagagcagacaaattagtggaatagaatggagagtccaggaataaacttgtctaaataggaaatttgggtatatagtgaacagatcagtggggagagttagattagtcagttactctttaagaagaaactaagtgcttgtaacatgcctgtagacattaagggctccaggaataataaagtagtcctcatggggtttacattctagcagagcaaacataaagagtgattacagttagtaatgttgtaagtgctgcaaaggactgcagagtaacaatgggatgtaattcaagggaaccttatctaatgggggtggaagtgaggagctgtcagagatcagttatttgaggaagctgggtgtaagctggaacctaaaggtgggaaaaagtgtttccaatagatgaaacaacccttcaataagtgattagatttttggattgaaatgaaatggaatcctggctttactccttattacgcaaaaataaatcaacagttttaatggaaacaatttaaaggtgagatctaaatcattaatgaatttccattaaaaaatctttgggtatagaggtcttttaaagtgtgatatgaactgcagaaatcacagtggagtagcacgataaatgtgcctacataaaaattttaaagtggtaattaaacactattaaagaaggttgaaagacaagaaagaaatgaaagaaagcaacccatgaaacaaagatttactcttcctctttgcatactgaacttaatagggaataagatcaccacagaaaaatgtgttcaccttcactaataaataaataaatacaagttaagtctaggtatttttccctatctgatgggctaagattttaatctaggattatttatatgtggcacatttaaatgtccttcagaataacattggttggatatattatagtaaataactacagtggaatattgtgcaaaaatgaaaaatgtagacatttaaagacaaaggtgtctgttagatattgtctagtgaaaaaagcaggttataaatctggactagggtgttacttatatgaaattagggacacatgtctgtgtggctgtatactcatagaatgctgtctagaatgttaaccaaagtatgagagtcattagttccctgttgtcaaattttggatgacagaagtttgtcttgtcttgggagcatgaatatttttataaaacaaggtgtttagctggtttatgaattgatatttagtgttaatctcttatgctttcagtttttcaggtaaaacttggtattttatattatctttttttttttttttaaatttgagacagtctcgctctgtcacccaggctagagtgcagtgcagtggcaccatcttggctcactgcaaccttgcctcctggattcaagcggttctcatgcctcaccctcctgagtagctgggattagaggcacctgccaccgcgcccagctaatttttttgtatttttagtagagatggggtttcaccatgttggccaggctggttttgaactactgacctcaagtgatccacccacctcagcatcccaaagtgctgggattgcaggtgtgagccaccgcggcgcctgtaatcccagctactcgggaggctgaggcagtagaatcgcttgaacctgggcggcaaaggttgcagggagccgagatggcgccactgcactccagtctgggcgacagagtgagactgtctcaaaattgtaggaaagcatttgattttctgctttaaatatattctgattatctgaatcatcagagacattaattttctatttgtatgagttcctgacaacttttaactttctgataatcctcctttttataatgtgttggcatttcgattgataatatgattatttcattgaactatgctgtagtcaaagtatttataaaaaagatatttatttattagtcttaggagaagtgatatggtttgttctcatttgaatgatttttctggaggtacagtaagatatagtagcctttgacacaaagcctaaacaagaccttaattaaaaatattggaaatttcttttgagtattgattacttttaaaattgaaaatctcctgtttgtatataaagagcattatagttactgtaatctgggctttacaacccaaaaagtaattgaccagattgcacattaatatttttgctggttatattggttttacagattgaaaagtttttttttttttaatatctattgcttttcccttttgaatagtaagctgtttcaggaggccagggaacatgtctcatctgaattaattggaaacattgtgctaagtatttactgttatcttaaccacctcaacccaccttaaggtctgctctactatcttctgtccagaggtttgctatttagttaaaactctaggtagtacttggcatatatatactcttgatgtcttagatatggaactactctatatttagatacatattttatgaaaagctaatatgtaatttattttatataaaatgtttgaagatacacttctttgttttattcctcctcctttctcagtaaattaaaaatatttcaaaataatgtttagaaagcaagtctattatgtaaaatgagacacgtaataattatatttttaagatgatttgtgcagtaagataaatgctttactgaagctaatatgtttaaattgctttaactaaaattattaataaaatgaattcatttgtataaaatacagcctacccatgtaaaatattactcttcataggtaccccagcaacagcacaactttaatccttaagttttagttgcagtactgttaaaatactaatagcttaatttcccaagattcagttatttaaaaccaaagtttagggggaaaaaggcagcaaaactcagtctactagtttacatacatacacacacacacacacacactcatatatatgagagtagactgaatttttgctgtttgcaatatatatatatatgcacatgtatacacacacctttatttgctataatttgtaccatgtagcttttatttcctctgaataaaaaggttgttatcttgttttattttaattcaacttcttgcttttccctatagaaagtcaggtttttggagagctctaacagtgtgcaagttgctgggctcttatcctttctgtttaaataatgcaggtactttgatggaaacctggagaagctctttgctgagtgtcatgtaattaatccaagtaaaaagtctcgaacacgccagatgaatacaaggtcatcagcacaggatatgccttgtcagatctgctacttgaactaccctaactcggtgagtatctggtagtttaaggctagtgctgactttgtatttcagagggtaaatcaacttccattatttaaacaaaggaaaatttgtgggtctgggagtagtaacctctaagccataacctatcaatgtattcagtgtgaggaaaggaagaaaaagagtaaaagcttggttcctcttacctccaacccccatttgttttttaaagcagcaacaacttgtccaagttgtcatttatagacctaaatctttctggagtttattctatcaccatgggagaattgtgtaatagtaggcagtaagtagaattctttctcatccaaattaaaatagatttaaactttaagtgttttttaaatatccagaaacactcataaaataccgttaatactatttgctagggaactctcagaattcttcagaagataagattttcacttaatcaaatccattcaaatggagattgttaaatatggtatgtggggacagagttggagcagaaccagtgatatagcaagagaaccaaagaactgatgttaatcccttaagtacaaataaccttcctaaaaatttattgaactgaagctggactcagtggctcatgcctataatcccagcacttggggaagccaaggtgggcagatcacttgaggccaggagtttgaggccagcctggccaacatggcggaaacctgtctcaactaaaaatacaaaaaaattatcctggcatgatggtgcatgtctataatcccagctacttgggaggctgaggcatgagaattgcttgagcctggaaggcagaggttacagtgagctgacatcatgccactgtattccagcctgggcgacagagtgagactccgtctcaaaatataaaatagaatttactgaactgagatgatttacttacttgatttacttgagtgtttactaaggaagtttagtcttaagatgtctaagataacttaattctatgataattacaactgtcttgttcatattctctgctttaatagttaagcatctctttctaataattactatataacaagtctttgacactgttattttaacaattatttggttgatgggggtctcactatgctacccaggctggagtgttatggctattcacaggcacagtcagtgtactacagccttcatcagactcttgggctcaagtgatccttttccctcagcctcccaagtagctggaactacagacgtgcaccatcaagcctggctaatattatatttatattgaaggatttttattgtttatcttagagttgtatatgtgtatctctaatggggtccatttgtggggagttaacttgttcacatgtacaagtgatgagaaaagttttaaaagaaaataaagtactcttagagaaatagaatgatcagtgagttatttagtaggtaaagtggtgaactgaattttcaaattctcaagttctgatcgtaactctaacgtgaaatttttggctttagcgggaggtaagccatttaatgtcactgggtttttcttttttctttctttcttttgagacggccttgctctgttgtctaggctggagtgcagtgatgtgatcactgcagcctcaaactcctgggctcaagcgatcctcccacctcagcctcccaagtagctgggaccacaggcgcatgccaccatgtctggctgatttttctgtgtgtgtgtgtgtgtgttttgtttgttttgttttgtttgtttgttttttttgtagagacggggtttcacctgtgtgtgtgtgttttgtttgtttgtttgttttggtttttttgtagagacggggtttcaccatgttgcccaggctggtctggaacttgtctgagctcaagcagtctgcccacctggcctctgaaagtgctggcattataggtgtgagccaccacgctcctccagttttggtttcttctccttttcttttcttttctttttttttggaggggggggggtgggacggagtcttgctctgtcgcccaggctggagtgcagtggtgcgatctcggctcactgcaagctccgcctcccaggttcatgccattcgcctgcctcagcctcccgagtagctgggactacaggcgtctgccatcacgcctggctgattttttgtgtttttagtagagacggggtttcaccatgttagccaggatggtctcgatctcctgacctcatgatctgcccgcctcagcatgccaaagtgctgggattacaggcgtgagccaccgcgcctggcctctttccttttctcttttttttttgacacgagttttgctcttgttgcccagactggagtgcaatggcacagtcttggctcactgcagcctgcgcctcctgggttcaagtgattctcctgcctcagcctcccgagtagctgggactacaagcgccggccaccacacccggctaatttttgtatttttagtagagacggggtttcaccatattggccaggctggtcttgaactcctgacctcaggtgatccacccaccttggcctcccatagtgctgggattacaggtgtgcaccaccgcacccaacagtttcttttttctttctgatgagttgaataagatactctttcaattttcttccaacctgagtattgtatcatttctcttaccttaaatcacaattctaatttgaatattttttaaaaagtactactgttacaatatattaatattttgactattttattgtctttaacagattctccttgccagttgacatttatatagtgcttacagttaaatgtttctgtgaggtaatactaagacccaggttttacaaggtttccttacttcttggcgtttttcctcctgccctatcatagacagttccttcttaacttaaatcttaactctgatttgagtactgaagcttggctgcttccaaatatccactataactttctcgctgttcttaatatggtctaacaatctcaacaaactagaattcaaaatcatgacttgagatttacagtgtaaatttttgttttgtacttgtaactgatgatggagaaacctattcattgaacacactaggcactattctaagaaacaatggagaataaatacataattcctaaccagataatttgcaggttagttgggtagataagtagtaaggtgacatattcagaaagagtggtaagtgctttggtagggcaaatataagatacgatactgtgggaacgtgttggagggatacctaacccagtttttgatcaggcaggacttaccacagaaatctgaactaacatctgaaggcatggtagttaggctaaggaggaaaatgtagcaagtccaaggaagagagaatgtactttcaagaactgggggatggtaaatagtactaaaagattcagagaaaagatttaaaaagttaatttgaaatgaaatgaaggagtgaggtaggatgggaaaccagacttcatgggctaaagagtcactgacttgaaggtgggaaaggaaatggaagcaataaatgtaatgaaattactcttttacaagaaatttcactatgcaagtgataggataagatagcaaaaggaacaacatgggttggcaagtaaggtaaggcattatggaaactgctaagtgttccgaaaagtatcatgacaaaactaggatgtcctttcctcataatttttagactcatatagaaggataattttaacctcttcagttttggaagtaaatgtcacctgaaactcttcataaagttttattattggatgagtgagttcttcacttacattgtataactcccacattttactactctccaagcatttgtacttttttattatatatatcttcagtatctttatccttccagaaagcaatttttgctttatgcagtgtcacatgcacattttaaaataagtgcttttgatagcttagtttacaaccctttggagttaactgtcctgagtggctgcttctttcaaaacaatgtcctgagacattggagcactttgtaaattcatagattccaacttaatgttttaggttaaagtagttaagataatagctgtactggcccaccactgtgctaggaaatgtagcttcgactacagcgtctctctctctctttttttttttttttttgaggcagagccttgctctgtcgcccaggctggagtgcagtggcatgttctcggctcactgcaacctccaccccgcagtttcaagcgattctcctgcctcagcctcccgagtagctgggattacagccgcccaccaccacacctgtctaatttttgtatttttagtagacatggggttccaccatgttgtccaggctggtctccaactcctgacttaaggtgatccacccaccttgacctcccaaagtgctgggattacaggagtgagccgccacggccagccagtgtctcatttttatgaagtaaataatttgtattttctaagaataagatatgtgaagtaggtaaaggcagagttgaaattgtgaggaagggtggtccaccatcccgtcccccattcctgaagcccctctgtggaatcttggtgctgctggaaactgcttgaaaatacctacgtcccaccctattttccttttaacacattacattttacacacaagggaaccgattcccaggtcatttgttcaatttttataaacaaaggggtttcaattttagaggttatatggacaacttattatggaagaaagattcttaattttcttactgctatttgacattagttgctgtgtatgtaaagtgatgcagataaatgaaacctttaagagtgtattcttaagtttctttaagtccattaatttcttttgtagataatatttcatgtatttttcgtgtactctcttgatcggatgtatttgtgatataaacagggataagtttagtgaatagataatatgatcccctgggacaggggaaagcccagggagccatgtaggtgaacctagctcaaggttatgaggaaacgaatatatcagaggagggagagggaaagggaagtaagacagacaggaagatatctgcgataataatatgttcctcgaaagcacaatgaatatgtatctttagactacagatttgtgtcttggtttttggtgtttttatttttttgctctatctttagacatccatgtatgatttatttttctaacttgtttaatcttgttatctgattagagaagttatttaaaaagaataaaaagcttttatctgtgtgctgaagttgtaacaaggttgagagaggtgcatctcacacgagtgtgattacatttatgaactatctttttatcttaaaatgagctctagactagaagtcaaaaaaggttgagacttaaagtgatcacttagtaaccattgtgaccgttgatctctgttaaggattcctacttgaaaaaagaatgaagcacatataagcatgtgtatatgtttttaagttttgaataaaacattttagagttgctgatatatttactgtatttgtgtcttttacagaataccccttcctttaacagccttaaaaatcaaagactccattagtgatgtggtaacaagttagtgccaaatctccttctctgatggggagtaatgataatagattccctttaagcttgatatttattttacatgtcattctttcagtaaacctaattgcaggactgatacacttcatatatatatatattttaatgagatgaagtctcactctgttgcccaggctggagtgcagtggtgtgatctcggcttactgcaacctccgcctcccgggttcaagtgattcttctgcctcagcttcccgagtagctgggattataggtgtgtgccaccatgcccagctaacttttgtagttttagtagagacagggtttcaccatgttggccaggttggtcttgaactcccgacctcaggtgatccgcctgcctcagcctcccaaagtgctcggattacaggcacgagccactgtacccagccctctcatagatttcttttcatgtccttgtctttgtatttaaaaaatatagttgatgtgctgtatatagaatttctgtcctaacgagatatttgtatctaatatcataagtaacatcagaaattttataagtacatgtcacataatggctaaatagaaaatctaagggaattttaaaataccctttataagagccacgaaaggaaagaataaaagagctaggaataaacttgataagaaatgtgaaagattgctatgaagaaaacttcaaatactaagataaaagaatgacttgaatatttgagatagaagaaataggaaaatattgaaaaagaagattaaattgacaggggagagctgagtgaggactagtcctgctagatacaagagtagacagagcggtggaacaggatagagtcaaatatgcatgaggagaatttagtgtattacagaggaggcatttcaaataaggtgtattatttgatacatggtagcagtggaacaggatacagtcaaatatgcataaggagaatttagtgtattatagaggaggcatttcaaataaggtggattatttgatacatggtgttagagcaacttggtagccatatggaatagaaacttaagattcctacctagcttcataaataaaagttaatgaattcacaagcggtaaatttaaacggtgataagtttcactgtgagtgaagagcttctgtatggcaacaaaatatgaacactaagaattaaagtgggggaaaagatttcccctacttataaatggccaatttcctacataagtaaaaagcctccgtaaataagtgaaaaacccacaggcaaagttggcaaaatatatcaagagagtatacagaaaaagaaatatacagtgtaaaaccttttttgaaatattataatttcatttataataaaaattcaaatcaaaactaaagaagttagtgtgtttttcacctattagattggcaaagatcaaggagttggatcatatactacattgtcatgggcatgagaaatcaagtactcttgcacggcataaatgacgacaatctctttgcaggggagcctgatgatagctattagattgtaaatgtatatatttattataatgtcacctctacagatttgtcctaagatacattcataagatcacaaagatgtatatatagtcaatgcagtagtatagtaggaaaaaaaaaggcagtgtaaaggttcattaatagtagactataaataaaattgtggtacctttctataaagaggcaaacccacaccagtgtggtaccatatgagaaatccattggatttatttttgtttttttaagacggagtcttgccctgtcatcaggctggagtgcaaaggtgcgatcttggctcactgcaacctctgcctcccgggttgaagggattcttctgcctcagtctcctgagtagctgggattacaggcatacactaccacacctggctagtttttttgtatttttgatagacacagggtttcgccatgttggcctggctggtctcaaactcctgacctcaaatgatctgcccgccttggcctcccaaagtgctgggcttacaggcgtgagccaccgtgcccagccctattggatttttttaaacaacaacaacaaaaaaaaacaaggtgcagaagagaatttgtggtactgttacagtgtgtgtgtaagtgtgtacgttagaacacctctggaagaatatgtaaaaaactggaaatagcagttgcttctgggtagaggaaacaaacaacagggatgggaatgagggaggcctgtttttttttttttttgagacagagtctcgctttgtcacccaagctggagtgcggtggtgcgatcttggcttactgcaacctccatctcctaggttcaagcgattctcctgcctcagcctgccaagtagctgggactacaggtgcctgccaccacacctgcctaatttttgtatttatagtagaggcaggattttgccattttggccaggctggtcttaaactcctgactgtaagtgatccgcccacctctgcctccagtagtgctgggattacaggtgtgagccaccgcacccggcctagggaggcttatttttcaacataaactctgaacttgtactgttaaagtaattgtttttagtaatgtctatttaacttactcaattaaaaataatttagaggtaaattatggcaaaatgttctttaaaataaggtaaccattatttgaatctttttaaaagacataatcctccagatcatctaatattatttaaagtatttacttaatgtcccattacaggatactgcttcatttaacgatcccttaactcttaagattttagaacaaagtgttagttactattatccttagctattctgaataaatcttttcataacaggtttattgagatataatttatatactatccagttcacccatttaaagtggttttagtatatgctacagagttgtgtgccatcgccataattttaaaaacattttataaccccccaggagataactttttaaattcaccccctaattcctcccaagtcccccagcccctaggcaactgctcatctgttttctttgtcaatggatatacctattctggacatttcatatgaaagaatcaaacaaggttttggtacggtggctcacgcctgtaatctcagcgctttgggaggccgaggtgggtggatcacgaggtcaggagttggaggccagcctggcaatatggtgaaaccctgtttctactaaaaatacaaaaattagctgggcgtggtggtgcgtttctgtagtcccagctatttgggagactgaggcagaagaatcacttgaacctgggaggcgaaggttgcagtgagccgagatggtgccattgcactccagcctaggtgacagagtgagactctgtctcaaaacaaaaagaatcaatatgtgatcttttatgactggcttattttcattcttttacaagaaatttcactgtgcaagtgataggagaacaaccttggaaacaaggttcatctatattgtggcatttatcagtactttatttccttttatggctgaataatattttatttatggaaatatggaaaaatatttttttcttcagttgatggacatctggattgttttcattttttggctgttacgaataatgctataatgaacacttgtgtacaagtttttgtatggatgtatgttttcatttcttttgagtatatacccaggattagaattgctgggtcctatggtaactctatgtttaatattttgaggaactgcctgattgtttccaaagttgctgtaccattttacatttccatcaacagtgtacgaaggctccaatttttctacatcctcaccaacacttgttattaatattggctttttttttccaaatagagtctcactttgttgcctggtgtggagtgcagtggcatgatgacagctcactgtagccttgacctctcaggttcaagtgatcttcccacctcagctcccctgagtagctgggattacaggcatgtgctaccacacctggctaatttcttaattttttgtggagacagagtctcactatgttgcccaggctggtcttgaactccttgcctcaagtaatcctccgctctcagccacacaaagtgctgggattacagatatgagccagtgtgctctgctttatctgtctttttattatagctgttctagtgagggtgaagtggtgtcttactgtggtgttgctttgttttgttttgttttgtttgagacagggtctcactcctttgcccaggctggagtgcagtggtgtgatctcagctcactacaacctccgcctcccaggctcaggcagtccttccacctcagcctcccaagtagctgggactacaggcgtgcgtcatgatggctgactcattttgtattttttgtagagacagggttttgccatgttgccccgccttcatggtggttttgatttgcatttccatgatgctgaatgatactgagtattctttcatatgctcatttgtctttttatatttaatacaaacattgttgcccgcctttcctaagatgtatgtgtgttcggtgtatctgcatgtctagattcaccatgaaaagttcattttaggagcccatctattgtcaaattggacattttagccacgtaagaaatgtgaccttacagagccctgttgagtcactgtttatagtgagttttctgataatacctttgttaagttcatgttttgtttttcttacagtatttcactggccttgaatgtggacataagttttgtatgcagtgctggagtgaatatttaactaccaaaataatggaagaaggcatgggtcaggtaaagatatcaagttgtttttcagtttttgttgaatttcctatagtgttaagacccttgcacaaatttgcacaaataaaaacaggtgaagctttatgtgtcatgattctagattcaaacaactaaagataataggctttttcctaaagtaatgtggcattccagttaaagagccactccaggtaacgttttctcagccggcatcaatattggtatatgttaacttaaacttgttgcacgattttgtcagattatctcgcttttgcctttaaaattgtgtgtttaaaaaccaattagtcaggttagcaagtctagttactttatggtgataaacatactctcacacacatttcctttaaggagaaagggaaggattgagatcctgtaaacattaaggtattcccagaacctagcaaagtgcctggcgatggtaagcattcattaaatatttgttgaatgaagacagtttaaatttcaatctttttcagactatttcgtgtcctgctcatggttgtgatatcttagtggatgacaacacagttatgtaagtatttttgatagattctgcatgtgaatattggttagttggttaaaccaaattaatttttacttagtacctcaaaggaagtgaaactttttaaagtctgaagaaactttttaatctgcgttccttagtagtagtacaaaagcccatttgtaacttggttaaatgcctgatcactattcttacaaacttagaaatgcatggtagctagattttgataaaccttgggattggagattagaatgtgtgtatgtgttagttgaggtgttcttggaagcagatcccaagatagaataaaaggtgaaactgacttattgtggaatagcatctgtgcaaggtaaacagcaggagcagatagacattgatataggcctgacatctgttaaaagacaaagaaggaagattcaataggaagagactttatatgatacagctatgagagtctttggcagccctgatgggggaacttcagtgcatagattgcccatagaggaatacctcaataagtagaaagagctgggcccagtacacttgatatgctcagttgttggctgggactacccagggagtcatggtctttgctgaaacactgctgctgatttcagatacactacagctggatgctttcagctaacagctcttcttgtgaaaggttctttcttttttttcttttaacttttaggttcaggtatacatgtgcaggtttgttacatgggtaaattccttgtccgtgaggtttggtgtacaaatgatcccatcacccaggtagtgagaacaatacctgatagtttttcaactcttgccgtcccaccctacccactctagtagtccccagtctaaatagtcttttattctcatcttcatgtgtactcactatttagctctcacttataaatgagaacatgtggtattgagtatttctgtgttaattcatttaggatgatgacctctagctgcatttgtattgctgcaaaggacatgattgtgctcacttttttttatgactgcatagtgtttcatggtgtccatgtgccacattttgtttatccagtccactgttgatgggcatctaggttgatttcgtgtgtttgctattgtgaataatgccacagtgaacatactagtgaatgtgtctttttggtagaatgatttattttccctgtgatctcaccaacatctgttatttttttactttttaaaattattttttgtttaatttttttttactttttaataatattccttatgactggtgtgagatgatgtggtacatcattacggttttgatttgcatttctctagtgattagtggtgttgagcatttttttgtacctgttggctgcgtatatgtcttcttgagaaatgtcttttcatgtactttgccctttttctttcttttttttaagtgaaagcaagtttattagagaagtaaagaaacaaaagaatggctacttcgttgacaaagcagcctgctcatttttaaatggggttatttgttttttgcttgtttgattaagttccttatagattctggatatgaggcttttgttgggtgtataatttttaaatattttctctcattctgtaggttgtctgtttactctgttaatagtttcttcagctgtacagaagctcattagtttaattaagtcccacttgtcaatttttgcttttgttgcagttgcgtttggggacttagtcataaattctttgccaaggctgatgtctagaatggtatttcctggattttcttttaagatttttatagattgagctcttacattaaagtatttaatcctttagttaatttttgtatatggtgaaagatataggggtcaagtttcattcttctgcatgtggctagctagttatcccaacaaccatttatgtgtgtgtggctattatcgataggattgcattattaatttggcgcttaccttgaatgttattggtatatattaaatgctactgaattttgtacattgattttgtatcctgaaattttactgactttgtcagctctaggagccttttggcagagtctttagggttatttctaggtatagaatcatcatcagtgaagattgatagtttgacttcttttcttatttagatacattttatttctttctcttgcctgattgctctggccaggacttccagtactatgttgaataggagtggtgagtgtgggcatccttttcctaagtggaatgcttccagcctttgcctgttcagtatgatgttggctatgggtttgtcatatcatagatggctcttaatgttttgaggtatgttccttcaaagcctagtttgttgatagtttttatcatgaagagatgttggactttattgaaagctttttctgtgtcatttgagatgatcgtatggtttttaattctgtttatgtggtgaattacatttattggtttgcccaggctggagtacaagtggcaccatatcggctcactgcaacctctgcctcccgggttcaagcaattctcctgcctcagcctcctgagtagctgagattacaggtgtacaccatcacgtccggataagttttgtatttttagtagagacagagtttcgtcatgttggccaggctgttctcgaactcctgacctcaggcgatctgcccgccttggccttccaaagtgctaggattacaggcgtgagccaccaagcctggccaataactattttcaatttgtgatggtaacaaatctttgtcaagagaattgtcttattaatgaccagagtgacacttgctgccaccttcttgagaatgcctattcttgaagatggatgctcactttcttttacttccttatcaatatcagataaactaagggtggaaccttgtcctaataactgttggctgatgtttgctctcacgtcctggtggtccatgccaggtttagatagctttttaggctaaggccagctatcagaaatcattagggtttgtcataccagaaaagcattatgggtaatacatgtgtaaataagatgtgtgtgtttggcaatcaaggcatctgacttttggcctgatacattccttattattatttattgatataaaatctgtaatataaaactcattttaattacagttatccttagtatactggggattggttctaggacccacgtcctccaccctgaatataccaaaatctgcgcatgctcatgtcagcccagcagaacccatgtatacaaaaatttgaccgtccatatatgcaggtttcacatcccacaaataactatttttgatccctgtttggttgaaaaatattcataaataagtggacccatgcagttcaaacctgtgttgtttaagaagcaatggggttttttttgttttttgtttttttaagatggaatctctctctgttgcccagagtggagtgcagtagtggcatgatctcggctcactgcaacctctacctcctaggttcaagtgattctcctgcctcagcctcctgagtagctgggattacaggtgcctgccaccatgctcggctaatttttttgtatttttagtagagacgaggtttcaccatgttggccaggctggttttgaactcctgaccccaagtgatcacccacctctgcctcccaaagtgctaagattacgggcgtgagcaaccgcacatggccagcaactgtatttttaagtatattatccagtggcttttagtatatacataatattattctacaaacatcacctaattgcagactattttaatcaccttatatccgttaagcagtcattcgctattcctttctccccctagaccctagcaaccactcatctgctttctgtctttgtggattagcctattctagacatttcatataaagggaatcatgtaatatgttgccttttgtgattggcttctttaatgttttcaagattcatccatgttgtatcatgaatcatcactttactccttttcattgctgaataatggttccattatatggacatttccattttttacggaaatgtcttatgtgaacatatgaacatttgtgtacaagtttttcattgaacatctgtttttaattctcttaagtatatatatttcaaaggagaattcctgggtcttgtggtaatgctatgtttaactttttgaggaaccatcaaatacacaaattatttttagaccgcaggttccacttctgtgaaatatggagatttactcatttaaaaaatattaattgaacactttctacaggcgtactggacacctggggatcctttcatggggttgggaggagaaagacagatattaaacaaatgattatacagataactgtctaattaaaattatgataatttctataaagtagatgtttaaggtgccatgagaactgagagggtatctatatccaaacgagtgtggaaactcaggaaaggcttccttgagtaatactttattgtaactgagtgaagtaatacagtaatagcgtctaatatttattgagtgcttactatctgccaggcactattctagtctcacaaccatgtttctgatatctattttacagattagtaactgagaaatggagagttcaaagaatttaccttcaattcatagctagtgagttgtgaggctggcattcaaacctaggctgtcccaccttagagctccattacaatattcttgtctttccaagggaggcagccttatgcacagcctctgaggaagggtggtacttactgttttgaggaaatacaagaatacgaatgtgataggagtgcactgaaagtgccacaggacagggtgggatcttgtggaaggagagaggcctatgaagctcaagagtcaaatgaggccagattggttcatttaaaagattttaatggggttgaactacatgcatgttcttcatgtctttctcagtgggaatacactcagaggagtatttaccatagaactaatgaaacttaaacttcaggattcctcactacgtgggatcctgtgaattctggaaattcttgtgagttatagtgttcagaagaggccaggatgcagtcagtgagcatttctggttaatttctaagagctctcagaagaagaaggctcttaaaattgtatcagctttaggtatcacaaaacctggatccatttcttaacatttctggcaacaatatctgtctcatttcgcatactgatttgggtggggtgtctgaaggaaggtggctgagaattgctgtcttaaggcatgatatgatatcagagtcaaaagaccctgaaatgcgcttatacttggcactagttggtaagtcattaggctgtaataaaaactgggtaaaagtagactatttaaaaaataagaaccatggaaaaaaagtctatgaaaataaaactatacaaactttgaaattattgttctgatcagtacagttatatttgttgatagcctatgtgcatttcagtatttacagcttagggcataaacatgtagccgtagcataaacagcttttgaaactatgttttataaatgtggaaaatactcttgactggaaactttctaatctatttttattcttggtttcaggcgcctgatcacagattcaaaagttaaattaaagtatcagcatttaataacaaatagctttgtagaggtaagtgatttgttttccttcttgtaagaaggaattctgtttattaatagaaatactattttaaaaattataatttattgacagtaaaaaacatctttaacatatttatgaagcatgccaaaatacctttattctcaaaagagtatgacaggccaggtgtggtggctcatgcctgtaatcccagcactaagggaggccgaggcgggtggatcacctgagatcaggagttcaagaccaacatggcgaaaccctgtctcttctaaaaatacaaaaattagctgggcacagtggcacaagcctgtaatccgagctactcgggaggctgaggcaggagaatcgcttgaaccctggaggcagaggttgcagtgagccgagatggcgccactgcactccagcctgggtgacagagcgagactccctcttaataaaaaataaaataaaataaaataaaagagtatgagaaaccagtaagtacatctctccatagatcttgaccttggataataaaattatttttactgtattcttcctttacttttctttatccctagctgagaattgtagtagattactaatcgtgtcatgtttaatcatgtttgagattctaaccctgctatttctctgctcgttttaggtttcattaccagtaaatcttgttaataaagaatgctatcctttattggaccatgcctttgcccatttgttctatgactccttttgtgctacagtggcagagttgagtagttgctacagagactgttctggcctgcaaaaccaaaattctttaccctcttggcttgttacagaggagtttttcagcccctgtatgacaacatcagtaacttggtcttttaattctagaaagtaattatttctgttagagattaaacctggaaacagcctattttagaaatagtgtattatttgaaatggtcaatggacttctgaattctggtgcagagtgtttttttttcataatactataaaagttatatttccttttgaggaactaaaatgcaatctttgcctgtggtttaggaactgggttttttgtttgtttttttttttccttcttacaagagctttttatgggagaagttgtatgtatatcctttagcctatcttgaactattctgtagcttctaaacaccttccttgataaagagtatatctgattttcttgtgtcttttgaaaattgttctgaaatagaactgtaaataaattagtggtttttaatggtcacatacatgatatttaattaaagttattcagtgggattttgaagatagaacaagaggtgattcatgtattttataaaaccaggtcttcagggatcagtcatctttaaaaaaaaaaaaaaaaggcacatctgaagtgttgctatagaagaccacagcaagttttcataagcttgtgtaattatcccccatttgccccttgtaccagagaagcaatataaatagcttgatgtactaggaaatcttgcatcatgacctaatttaatttgctgtctttttttgaggcagggcctcattctaacacccaggctggagtgcagcagatgatcacagctctctgcagcctctacttcctgggctcaagtgatcctcttgcctcagcctcctgtgtagtcgggactacaggcacataccaccatgcctggctaaattcttttttcttttttttaaggtagagacaaggtcttgctatgttgcccgggctggtctggagtgcttgacctcaaacagtcctcccgccttggcctccctaagttctgggattataggtgtgagccactgtgcccagccagctgtcattttttattttctaacttgtatttcagtgcaatcgactgttaaagtggtgtcctgccccagattgccaccatgttgttaaagtccaatatcctgatgctaaacctgttcgctgcaaatgtgggcgccaattttggtaagcaagtgatttcctaaattgaaatagtgcacaaagcgtttccatttctcctgtttattcttggtagtaaaatagcagaaaaaaagtgtttaccttaggcagggagatgtttgatactggtttaaaatagtatatatctctttcagaattgaatgaaaaggtcacatcttaaaaaaatttttcctctttccttgatgttctaacttttttgaatttttttttatggagaaaatatacaactctaatcatatcttcctgtatgctccactgtaacttaatgggagcaaacttgtagatctgggactatacgtttttctttactctgccaaattttaaccttacttatgcaaaggaaatgtgcaggtaaattctgctgatggtctcctttttaactaagagttttcctgtggctcctctcgcccagctttcttggtaacttgggcttttggagttctatagtatactcttcagcctctgaattctagatttgaactgccaggaagtttccagtgccacatattaggggatgtcttaatcagttcaggctcctttataggtgttctagttttttccaaagtggataggctgaaaatttttcaaatttttgacttcttatttccttttgatgaacagtttatctctaggtcattcatctcttcttgcattttctataaacattcaagagaagctaagctgcgtcttcaacactttgcttagtaatttcctcaaccagatattcagtttcatttctctaccttccacaaaacaattcagccaacttctttgccactttatagcaaggatggcctttcctctagtttctaacagcatgttcctcattttcatctgagacctcatcataatggcctttactgtccatatttctaacaacattctgttcatggccatttatttaggttttctctatgattgaggcattccctgcacttctgtctttctgaatcctcaccagaattacccttaacaattcagttcattcacagtgatctaggctttttctagcttgcacttccaagctcttccagcctctacttactacctagtttcaaatcggctttcacatttttggttttgttagaacagcaccctcacttcttggtaccattttctgtcttaatgttcaggcttttataacaaaagaccataaactgggcggcttctaaacaacataaatttatttcttacagttcttaagggtgagaagtccaagatcaaggtgccaaaagatttgttgtctggcgagggcctgcttttctggttcatagatggtgcctacttgctgggtcctcatatggtggaaaggacaaggcagctctctgggccccttttttttttaaaaaggatgccaattccattcacctcctaaaggctccacatcctaatactgtcacattggttattaagttttaacatacacattttagggggacacaaacatttatatcctgctagaagttaagatgattttctgttcctttgagggtcttgaggagtaagaagccaatcaagtcaaggggctctagacccagcaaatagattttttgttttgttttgttttgagagagggtctcactccatcacccaggctggagtgcagtggcacgatctcgcactgtaacctttgcttctcaggttcaagtgattcttgtgcctcttgagtagctgggattacaggcgtgtgccaccacgcctggctaatttttatttatttatttatttgtttatttatttatgtatttatttttaatagagacagcatttcaccttgttggccaggctggtcttgaactcctggcctcaagtaatccacctgcctcggccctccctaagtgctgggattacaggtgagaagcaccatggccagccagattttcttttttgctgcggggtggtttggagggggaaatattttattggtattccatacctttctttttttcctccaaacatctatagaattacacttaacacatcattaataataaatatttccaaaaagagcaggtaagctcacagagattaagtatgtgtaaaatacatactgtttcgataaagattaattatgtattgttattttagagaaaaggtggataatacctactttccaatgtatttttagcgtgacacatttcaaacataaaagtatagagaatacagcagtgaatacctatatagctacaatccagttaaatcaaaattagtattttgtttttcttcattaagagataaaacatgacacatatatttgaagctccttggttccctgctccttcccattccccatctttcttttcagaaataaccatttatcttaacctgatttaaatcaatagtagtttgtttctgtctttagcaaaggactttttgccattcgtaaattacttaattagctaattaatctgtcattttattatttttttcttaagcatttgtgtttgttaattatacttcttttacaagtgtatatgtcatgaacttagaaaacaaaagtgaattactgattaacacatgtttagtgagtatttagtctttttgttttataccttgcccagtaccatttccctctacagggcggaggttcatttgtttaaataatgcaaagatgtgacctatttgcttcccatatattgtttactgtgtattagtactaaattatataagtaacctacaaagtcagccttttattcttcatttagggtgttaagtaaaagattaaaaatgcactgatgaagcatgggttgaaacttctcaatatagtctgaggcaccttagcaacaattattatgaaattgtcatcaaagcgtgtcttcatgcttatagtcattcttcacacatattgagtacccactatgtgctagttctactactaaattctaggtaattaactgtaaagcagacatgggttctctccttgtatttgccagtcactagaaactagtgacaatactgtggaactataaggcatgaaatgattggcttatttacttgcttacagtaggtaggccttaattctattaactctttgtgtcacttaacagctttaactgtggagaaaattggcatgatcctgttaaatgtaaggtgagtttgtctgacatttcaatttttaaataatggcacacttctaagacttagtgactaaaaatcatagctgatgattttgttatctatctattgatagatttttttttatccttttaatttcagatgatcattacatgtattcagaggtaattccttaggataagccaagtcagctcctgattgttattaggataaccatggctaaggcacctctttgtcaggctttgtaattaggggaatacacaccttgcagttgggcttctcttcaagctctaggttccccactcagcttctgccaaagaaaatcctgctttggttgattttatatatactggacattgtagctatgggatttccctggcttaagaggatgtgagcctagtgataatcttattcattggcttttacatttaagcttgactatagttaagtgctaaagtaatttgctatttttaaaagtcttttgttgtatcctaaccgttgttattttcaaacagtggttaaagaaatggattaaaaagtgtgatgatgacagtgaaacctccaattggattgcagccaacacaaaggttggtgttttccttcagtaactcttggtaataaaaatgataaggattggtactttggcattagcaaaagcaatgaggtgacctacttacaggctttgtttcatctttttctccattgagtctttttttttttttcccagaatgtttgcctgttatttcctttttctctttgagtttattttagagtattgagtactgtagtacagcatccacagttctctgccttaggtttcttctactggaaaaaaaattagtgttctgtagaggaaaaagctgataatttttcaagtgtgggatttgtgcttggctgccatttagtatacaaatgcattggagtttactccgcctagcttggttctgttaggctaatttacatttttgtttctaattttttgttttgaagtacattgctcttgatactagtttcaaaattcaatttcaaaattcactttcttaaccccagacaaatgtcttagaagtgtttaaatcttgagtacccttctcctcgatcactaatctaatgagcaagcatttgaatgccaaccgtgtacccagctagtcttttaatacaaagtcgtattatccatcctttatgtaattcagtcctatcctatccccatagtgagtgacttgggtaatgaatggtaggttggttcatgggctattcatttttagtattattttgtacatgtaaagatgatgctttaaagaatgctgagttgtttgacccatagtatataaagctatctttgaactgttgcctcagtcatcacaggacaatgagattaagaagtgtgtaaacaatgaaggccgacgcaggttgtctgtgtgtgtttaaatatacatcttacatacttatatataaaacatgaatttatatttctgtctcccagaaagtagtgaaacagtgaatcttgccacataaaacaaatgcccaagtctttaaggaatatatggtagaaattaatattttttgttccctccaaaaccatcacgataagcataactcacgtcaatcaaagaaaaccttactataaatatactgtaatgtcagaaagtggttacttgttttgttattaaaaaaaaattcttagccaagcattctttttttgaaaattgaagattttcccacaagaaatgttccttaagtcccagaattctttaatatgctctgaaaaactaatatttagaataaggcaattatattttcactaaattgtttaattaaatggtagccttttttctacatctagagaaattcctacttgtaagccccaaagatgtttaaaatagggagtacaggcttgaatatgtttggcttagtttagattgtagattaccaaggaagaatggcaatttgtaaaacaaatttagctgctcagtatttttgagagaaaactgaagagtttttctcttgaggttttagaagcttttaagattattagctccctaaacagatatgcatattgtcagtgatatcctaacattttggaggtttaatactattaggttaattataaccaagaaatgtagaatgtagaatgacgcatattttatgcctgaaatttgcttgtttggaaaaaatgtaaaatttcttatgtgggtgatttcaaaaatttgatttgaaatatataattaaaaagttgctatattggcctattttaaattgctatcattgatgggcagcatagtcaatttcacaaagaaggccaaattgtgcaaatactaatatagtgggtgatccctccttgggagagttacaaacctcaatcacaaatgcaaaaacaaaaaatccataggcctacagagcagtaattttggcttactagcaaccaagaatatgatatgaggccaggtgcagtggctcacacctgtaatcctaacactttgggaggccgaggtaggcagattgcttgagcttgagagattgagaccaacctgggcaacatggtgaaaccccacctcaacaaaaaattcaaaaattagccgagcatggtggcatgcacctgtagtcccactacttgggagactgaggcaggaggatgacttgaacccttgaggtcaaagctgcagtgagccatgattgcactgctgcactccagcctggtcgacggtgagaccctgtctcaaaaagaaaaagaaaatgatttggacttggaaaaaaacaatctaacacgatctctgtagcatacttgttaaggagtacaatgaaaagaatttaaaacatggttatttggtaggagaaagttggaaaatccagtagccacaaaatgaatttaccaatcaaggtctgatttcctagttacctgacactgaagtcagattgcttggatttggatcctgacttgacttatgtgaccttggactagcttctttataatttttctctcccttagtttattcatctgacaaatggaaataggaatagcaccactataagaattatgagttgatgcatataaaacactgagaacggtacatgggatatgggaagtactcaattatttctagatgacactagagagtatagtatatttatatgaatagaatgcttttatctcctatagtactgttattactatatatatgactaaaagtacttaaaatgatttgtctctcagccctacttaaaaagaaatcctaggaaggctgaagtggaaagatcacttgactccagaagtttaaggctttagtgacctatgattgggcctctgaatagccactgcactacagcctaggcaatgtagtgagactctgtttctaagtttaaaaaaacaagtccttaaattgttgtatgtcttaaaagccagtggtaataatggtaacagctcattttaaatagtgcttaagtgttcaacactgttctaagtgctttatatgtattaaccacaataaataaaatgtttaaaaacaaaccaaatctagaactggcttttccttaatgttagtaatgcaacctagtgtagcattgacaccaactttatagtttctcttcataggaatgtcccaaatgccatgtcacaattgagaaggatggtggttgtaatcacatggtctgtcgtaaccagaattgtaaagcagagttttgctgggtgtgtcttggcccatgggaaccacatggatctgcctggtaggttggggaaattaagggaagaatgtgtttacataagtatgtgccatgtattatgaataacatttctacctcatagatatcaccatctaacttgcaagctaaataaatacatagtgtgtgattaatgttataagtctatgcaagacatagagggattagttagatatatttcataaaggaggtaacaatttagatgaactttaaggggaccaagagttcattagttataaaagtagtaggaaaaacatttagggcaaaagttgcaacatgagcaaaggtagaatgttgtgaaaatacatgactttttcagagaataactgtattatcaaatgtgcctctctaggccaaaattgaaaactcagatgctgttggcaaaacccaacctgcaggtggttttactctgcatatcattagacattgtggaatgctttaaagccttgctaaaaggctttgtcatattttttctttaaataagcatatatatgttgctttccttgttttattgatgacttacttgaactaatataagaatcttgggccaggcacggtggctcacacctgtaatcccggcaatttgggaggccgaggtgggtggatcacctgaggtcgggagttcaagaccagccctgaccaacatggagaaaccccgtctctactaaaaatacaaaattagccaggcgtggtggcgcatgcctgtaatcccagctactcgggaggctgaggcaggagaatcacttgaactcgggaggtggaggttgcactgaaccaagatcgccccattgcactccagcctgggcaacaagagtgaaactgtgtctcaaaaaaaaaaaaaaaaaaaaaaaaaaaaagaatcttacacagcatatgaagcagttttctcactggttaagggcataagcctccactgggtgacaggcaaaagtttaagctctgaaactctgtagttatgtgaccttaagtatgtttcccatcctctgtaaattttattcttcatcttctcaatgaagaaaataatgcatatttcataaaatgtttaagggattaaatgtgttagtacatttaaagtcattagccaagtgcatggtatatagtaagcactcatgaaatagctgctcccataatgtaggctcccataactgatgtatagtaaccactccaggggaagtgcaagtcttactcatctatgctctgagctgacctctctgggtatgttttccccttcccaccattctgtatatcatgcagttttaaatgactctgaaaaactgtaatagcaaagcacatagcacagcatctgttacatggtaggctgtcaactgttggttctctgtggtttataaaagagcagataaggtgaataatcctggaaaattagaaatatttggcttaagtaacagatggcctaagagataagattatctctttctcaaaaagttgagttaggaattcagacagtcaataaaggttctagaaggacagtgttttctaataatgataggtgagctgatttgaaatggactgcctcaggaggtggggaatttcctatcactggatagagaactaatttattatagagagaattcaaacactagatagggttagaacagttcctttcagcctgctaattctgtcattatagcagtagaaccctgggtgttttaacatctcaatttctctgttataaaagataacgttggtgttagataatctgtaaatccaggttaaaattctgattttttttttttccttttcattgattttttttttctttatggaatcctctttatttacttgaaggtacaactgtaaccgctataatgaggatgatgcaaaggcagcaagagatgcacaggaggtaagtatatgtataacaggacaatagttgactaagaatgcacgttgtatattcatattcattagagaataattttttttttttttttttgagacagtgtctcgctttgtcgcccaggctggagtatagtggcatgatctcagctcactgcaacctccacctcctgggttcaagtgattctcctgcctcagcctcctgagtagctgggattacaggtgcgcgccaccacaccctgctaatttttgtatttttagtagtcagtctagtctcgaactcctgacctcgtgatccactggcctcggcctcccaaagtgctgggattacaggcgtgagccaccacgcccagcccagggaataattgagtagaacttttcaattctgaaggatttgtgaaagacattccagtaaatattggatatctatttacatttagaaagggaatcttatccaaaatatttatcaagaacattcttatagtaagtttattttcttttcattaatgtagttacatagcacattttagcttttggtagagtcttgctttcaagatccctcctaccccaagaagaacagtagtgaacagcatttgttaaatggccctggtgctatttataggcaatatcttacttacttaaattttttttaaacctttttgttcatcaagaagcgctgatgattataggtgagctgatttggtatggagtgtctcaggaactgagaaattccctattgctaggtagggaaatgacccactgttatagaagggatccaaacactaggtgtggattagattctaaagcacttttcattcctttcagtctggtgattttattgtaattgtggaaccctggaatttaatagttcctacattcacccattccatattgaaattccccagttgtcccagaaatattcttttcaaatgattttcctagccagggtacaatctaaaatatggtttgcatctgtttcttatttacttgttaacatatcttcaaaatgtatttctaataaaaatatcatatatagaaatgagtatatatgtaacctagtctgtcatattgctagaagtgaaagttttgtctttccctttttaaaaagactgggaaatacggccgggcttggtggctcacacctgtaatccctgcactttgggaggccgaggcaggcggatcacctgaggtcgggagttccagaccagcctggccactatggtgaaacactgtctctactaaaaatacaaaaattagctgggcatggtggcttgcacttgtaatcccagctactcgggaggctgaggcaagagaatcgcttgaacccaggaggtggaggttgcagtgagccaagatttcaccactgtactccagagtgagactctgtcgctaaataaataaataaataaataataaaatgactgggaaattatattttgtaactataaatgatgtttcacagaccttcacaatgtttgggtccatttaaggggaaaaaatccctacaaattccaatattgatttaaattatatttattataatattatttaaatatgtataaacaaaaaccagctataaattcttgtgctcttgcacaattctacagccaaaccaagagagccacaaaatcagtgaaactcaagtaaatgttaatttggtagatactgttgttggggttttaaaaatgtattattactgtactgttaaatatcatgagataacttgttctcccaccaattttcttttctttcttaaatgatgtcccttaagtcatatcccactaactttctatatatttctatatttccaacattaatttttatgatgcattacttgatttgcccagaatgtattatggatatatgttcttatcacctttttttctccattaacctgatgtatttatttagccagatatgctgtttatcaacaaagaaaatatatgtggtttatccttgacctcacctggtctttatttggatgccggtagaatccctttctgagatctatagggagggtgggttatgtgcatagcttttgagccagagtctaatgtttagattctagatactaaaatagattatttttctgtttcacatctgttggactaaactagaatcttctataactgtgggagtacaaagaaagatttcctatcactccattggttgtttggttgattgactaattgattgggagccacgcctccctgaaaggatcacaccattgcatgcctatctggcctcctcatctttccccactcccaagctcttggcctagcatttactgggagttgtagtctgaaaaattactagaaggttgacacatattcaaaagatccttgatggtaccttgactgccctgcaaaagatgtacctgtgttatagaaaattgttgactcattatattgtaccacagtgccgacagttgtggatatttgaatcttcttgtcctctagactagggtcagcaaactttttctgtgaagaatcagatggtgtatatttttagctttgcgtactacataatctctgttgtgacggctcaactctgcctctgcccttataatgcaaaagcagccatagacttaaatgagtaggtataactgttccaagtaaattttatttactggctgggcatgatggctcaaacctgtaatgttagtgctttgggaggccaaggccaaggatcacttgaggccaggagttcaagaccagcctgagcaacatagtaagacccccccgccgcccccgcccatctctacaaaaaaaaaacaaagaaggtttttaaattagccatgcatgttggtgtgtgcctatagtctcagctatttgggagctgaggtgggaggattgcttgagctcaggagttccaggctgcagtgagccatgatgacgccacccctctttagcctggatggcagagaccctatctcagaacaaaaaaacaacaaagaaagcaaaacagttttatttacaaagacaggtggcagctggatttgtcatgcaggccagagtttgtatacccctgttctaagcagtcaagtttgttgtcttttccacgctccccaaactgctttcaggtcgctgattacatttctcattccagattctggcatttgattggagaatttgtcttgatcaggctcagtggctcacgcctgcaatcctagcactttgggatgctgaggcgagaggattgagtgcgggagtttgagatcagactgggcaacaactgagaccctgtctctacaaaaaatttattaaaaattagccaggtatggtagtgcacgctggctgaggtgggaggatcacttgagcctgggaagacttcagtgagccatggttgtgccactgcactctagctcaagcaacagagcaagaccctgtctccaaaaaaaaaaaaaaaaaaaaaaaaagtcttattagcagtgatggtatgggtgttcttttttcatgttgaattttagtgagaagcagtttcagaattcttagattaagtcaagtcccataacatcatacatgtcaatatggtaagggagggttttcatttcatttggggaacttgacaggcttggaaatattagtactttaggggaagataaaatgccaagcagattttccacatattttcagattggcataattttcctgttcataagcattggtttgatacttacctgactcttgaaataacatggctgtggttttgttgttttttcattgagatgagggtctcgcagtggcatgatcatagctcactgtagccttgaactcctgggcccaagtggtcctcctgcctcaacctctgcattagctggaactagaggcagcttgaggtgtgcaccaccgcgcccaacttgtgttggttttttgaagtgtttcgttgtataatgctggatcatgtggttagctaattatgtggctcagaattagtatttctaagcaagggaccaaccatagggccaagtagtatctgttatgtaggctttaaaacatggggagagaaagaggaggtaaggataaaggaaaagaacatacgtgtgttaggaacccctttgataggggccgggcgcggtggctcatgcctgtaatcccagcactttgggaggccgaggcgggcggatcacaaggtcaggagatggagaccatcctggctaacacagtgaaaccccatctctactaaaaatacaaaaaaattagctgggcgtggtggcgggcacctgtagtcccacctactccagaggctgaggcaggagaatggcatgaacccgggaggtggagcttgtggtgagccgagattgtgccactgcactccagcctgggtgacagagcaagactctgtctcaaaaaaaaaaaaaaaaaaaaaaaaaccctttgatagtggttgcatttagtaagcatttattaatggttttctgcaaatcaggtattggaaatactttatctttttaaaagtccattccctctagagatttatggtataatggtagaggcctcatatgaataattatatattataatgtaataatacaaaacaaatctaaactagatacattgttgctttgataacaatatactttacatatctctaaagacagactctctttacataactgtaataccattacagttgactcttgaacaattcaggggttagggacactaacccgccctacctccgcaatggaaaatccacataccacttttgattttcccaaaacttacctgttttaatagcctactgatgaccagaagccttaccgataacatagtcaattaacacatattttgtatgttacatgttttattatactgtgtgcttttttttttttctttttttgagacggagtttgctcttgttactcaggctggagtgccagtggcaggtctcagctccctgcaacctccacctcccgaattcaagcgattctcctgcctcagcctcccaagtagttgggattacagacatgcgccaccatgcctggctaatttttttgtatttttagtagagacgggatttcatcatgttggtcaggctggtcttgaactcctgacctcaggtgatccacccacctcagcctcccataatgctgggattacaggcgtgagccactcactgtgcctggcatatactgtgttcttaacaatgaagtatgctaggaaaaaagttattttaaaaaattgtgaagaagagaaaatgtgtttactttttattaagtagaagtggatcagccgggcccagtggctcacgcctgtaatctcagcactttgggaagctgaggtgggcagattgcctgaggttgggagtttgagaccagcctggccaacatggtgaaaccctatctctactaaaaatacaaaaattagctgggcgtggtagcaggcgcctgtaatccgagctacttgggaagataaggcaggagaatcacttgaaccctggaggtggaggtcgtggagagccgagatcgcaccattgcactctagcctgtgcgacagagtgagactccatctcaaaacaaaaaacaaacaaacaaaaaaacggatcatcataaaggtcttcaagttgagtaggctgaggaggaaagaaaatacaggagggcttggttttgctatatctcaggtggcagaggtagaggaagtcgaatgggattcaggagatgcaggcacacttggtgtaactttacaggaaaaccttacgaaccgttttgcattttcatttctctaaaaatgtttctgtatagtaacaatcctctttccatttgctttagtttcagtgctggtataatagaagggtccattcataaaggaagtccaaagcagtcttaagtaatcagaacccttctgccaaattgtctaatgtcaatttattttctggcactgcttctttagtgtcttcttcctcatcatctggcactggtttggaagcagctcatctccatcaagtggtcttttaattcctctggtgtggtgtctgttagctaacccttcaccttccacgttttctttgccatatccacagtctctttcgtgatttccttgatgggctctgttgtagatactgcgaagtcacgcgcaacatctggacacagttttctctaccaggagtttattgtttcagtcttgatgatgccatggttttttctataacaacgatgacatcttcagtggtgctctccttccagacttccatgatgttctgtgggggttctcttcgatagcattgacagtcccttccagagtaccgtgtgcatctttacgtttgtttacatttctctcaatgtgaatggtaccatatacggtctgtaagagtttgtgtgcataagttttgataaatctcaactttttattaatagatttatgtatattttatcgtagtaaatcataagataggctacatatgtcttatgcattcatgacaactctttttcttaattttggtttgtccgcaagtgttttcaaattgttggcaaacctccaaaaaatatttcaatatatttattgaaaaaaatccacatataaagtagacttacagtttaatcctgtgttgttcaagggtcaactgtatatgttttaaagcaatactctgttggtatcaactatctattgttcaaatatccccaattatcttaaattttgcttttttttgttttttggtgttttgtttttttttttcagaggtagagtctcgttctctccccaaggctggagtgcagtggtgcaactcggcaattctcctgcctcagcctcccaagtagatgggattacaggcacatgccaccacgcccagctaattttttgtattttagtagatacagggtttcactgtgttgcccaggctggctcaaactcctgagctcaggcaatccacccgcctcagcctcccaaagtgctaggattacaggcatgagccaccacacccagcctatcttaaattttcttttatagttggttcaaattgggatccacataggtccacaaattggatttaattgatatctcttgagtctcctctacctgttgttccttctcttcccccctccttgcttttttttctttgttgaagaaactagatcgtgttgtcctgtagagtttcccacattatggattttgctggttgcaactgcatggtgtcatttaataggttcttctatccctgcattttctgcactggtgattaattcaagaaacttgatcaaattcagattcagtggttggggggggagcccagaatacttaattgattatactttctattgtattatatcaggagttacatggtatgtagttgccactgtagttttctacttaaaaatatctctgctttttgcttgttttacatcttgtggcatactgtagaacagtgccatccagtagaacatttttgtaatgatgtaaatgttctttatcaccagtgtctaatttggtagtcactaagcacatgtgactattgagcgatgaggaactgaatttttagtttcttaaattgaattttaagtagtcaggtgtggcttgtggctactgtattggaaagtacaattaataggacatttttcaagagtattaaataacaaaagtagcagtagatgtctattcctgattttagcctagatcacagtactgtttcatcagtaaatcagctttttaaattattaatatttttaatggacaaatcataattatacacatttatggagtacagtggaatgttttgaaatatgtaaacaatgcaatgattaaatcaaactaattgttgtattgccttgccttaacatttttatggtgagacatttgaaatgatacttattttgaaatatatattattattgactatattcaccctgttgtgcaataaatctcaaaacttactcatccagtctatctgaaactttgtactctttggtcaccaactccccattccctcccttcctacccctctatccccgcaagcctctggtaaccgtcattatactctgtatgtctgtgagttcaacttttttagtttctacatataagcgagatcatgtagtatttcttttctgtgcctggcttatttcacttagtgtaatgtcctccaggttcatccatgttgtcacaacagaattccttttttgaggctgagtactcgtgtgtgtgtgtacatacatgacgttttctttctgtgttcatccattgatggacactttacatggattccatgtcttggctattgtgaataatgctgtagtgaatgtgagagtacagagatacctttgacatactgatttcaattccttttcatatatacacagtagtgggattgctggattctgtggtggttttgttttcagttttttaaggaacctccccataccattttccataatggctatactaatttacattcccatcaacagtgtatcaagagtctccttctttctttatctttgccaagacttatctttcatctttttgataaaaaccattctaacaggtgtgaagtgagacttcattatggttttaatttgataatcagcttttatgtacagtttatgtgttataattatatcacccaatttttcttaatgggacagcgatctagggcagccctgcagaggtacctgttctactgtaatcgctatatgaaccacatgcagagcctgcgctttgagcacaaactatatgctcaggtgaaacagaaaatggaggagatgcagcagcacaacatgtcctggattgaggtgcagttcctgaagaaggcagttgatgtcctctgccagtgtcgtgccacactcatgtacacttatgtcttcgctttctacctcaaaaagaataaccagtccattatctttgaggtaggagtagttctgggtgaggaaaaagcccaccttgtatcataggtctacctgatctttcatatataagatacagagttttcagggttcttgtttgttcagaacatgtaggtagacgaatgtatttattacaaagatacaagaaatttctatttcttgtcctaaattatattcagatcgatgtggtttagccagctagtgattaggtatgcaggttctggagtcagccctagattttaatctttacttcattatgttttagctctgttgatttggagcaaattccttaacctcttatttgtccattttaaagtgaggatagtacctttctaggttgttatgaggtttaagtgagacaatttgtgttttatgtgagacaatttgtgttaattgctatacggcacctggaacatcataagttctcaataaaagcctttattcaggctaaactaaccctgcaatattagaagttaatgtggtggttatctttagtggagaaataatgactaaaaagccagcttttagcagtaaaggttttctcaagtaaagatgttcatttaaaattgatgcataaaacattgatatctgtatatgactagacaataagactgactagcagatgggacttcagttgggtaacaggtacaaaactagccatagtggtaaaggatgatacaatttgaatcttccatacagtgttttcttataagaaataagtatagccagatgtaagcaataataggtttctattttttctcatttacctttgagttttcagcaaagagcagctctcagaacgagaagattccaaaagacattttaaatcctttcaaatggtcttcagtattcttccaaaagtaatgggtgaaatctttcgttcttttaacatttaaaaaattgttctggaaaagaacaaacaagttattagagatgaaagcccatagagctttacaggtgcagttaaaccacctatgaaagttacagaatgagtgttgagagcagtctgtagtcaacaaaacagtgaaaatggtttatcttttagctttattttgaagccaaaatttactttcattcttcttacagaataaccaagcagatctagagaatgccacagaggtgctctcgggctaccttgaacgagatatttcccaagattctctgcaggatataaagcagaaagtacaagacaagtacaggtaatttttttttaagctgttgaataaaactttctgccagtgatgatccttactggtaaagttcagtgatagtgaaactgggtttagcatatccagcaactgagcttttgccatgtttctcacagattgcttctgtccgttgggcactaaattgcaggtaatagtattggtgaagcatacatagagaaggaattcagccatttattctattggctaattccacttctgttcagttatttagttgctaccttgcaaggaagaaagaatccaaaaaggccaagtggcctttaggatgagagtgagaattgaatgttggtcttagcctgagaatcctatgtatgggtcatggctattcacaaatgagctatggaaacttactttttagagtttttattacatatatatatatatatttttttaatctaaggagatacttgtcctaggagtcgatttttcaagatgtgccgcctcttaagctagagatgcaaaatgttttatttctcaacatgaagctctttctcccaaagtgacaaatgctagtgtcttttgaaagttgtaggaaacttggggagtttggaagacttggagatttagtcctaaccaatatcttcccttcccttagccaattttagctaccatattttgtttacagtacttttacagttgacagagattttaaggacgtgaataaagaacccatgaaattatttctgaacctgtttatctgcagaactgtgggattgaattatgatttctaaggtccatcagaacttgtaacactttattgctttaaaattaattcccatggaatcatggctttcagaaaataccattttaatattagaagcagtttgatgtgtctgtacatctagacctgaacatgtgcctattaaaataaaaaataggtgcttggttccgagtctggataaactatagggatgccttaaaaataagtaaatgcctctttttttattattagaggctgacaacaagtttttttttttttctctttgattacagatactgtgagagtcgacgaagggttttgttacagcatgtgcatgaaggctatgaaaaagatctgtgggagtacattgaggactgagaatggccctgcataaaatgaactctgaaaactttaccatctagagtgctcatgcaattaaaacaaaacaaacacaaacaaggaggcactaagcctattctgacaccactggtctgtagtaccagaattgttttgttaatggaaagtttaagtaaattatattgtaataaaaaggtagataaaccattgt

SEQ ID NO: 36004 - DNA, 56595 bp, Homo sapiens
gcgggcggcccgcgggcgggtcgcctcccctcctgtagcccacacccttcttaaagcggcggcgggaagatgaggcttcgggagccgctcctgagcggcagcgccgcgatgccaggcgcgtccctacagcgggcctgccgcctgctcgtggccgtctgcgctctgcaccttggcgtcaccctcgtttactacctggctggccgcgacctgagccgcctgccccaactggtcggagtctccacaccgctgcagggcggctcgaacagtgccgccgccatcgggcagtcctccggggagctccggaccggaggggcccggccgccgcctcctctaggcgcctcctcccagccgcgcccgggtggcgactccagcccagtcgtggattctggccctggccccgctagcaacttgacctcggtcccagtgccccacaccaccgcactgtcgctgcccgcctgccctgaggagtccccgctgcttggtaaggactcgggtcggcgccagtcggaggattgggacccccccggatttccccgacagggtcccccagacattccctcaggctggctcttctacgacagccagcctccctcttctggatcagagttttaaatcccagacagaggcttgggactggatgggagagaaggtttgcgaggtgggtccctggggagtcctgttggaggcgtggggccgggaccgcacagggaagtcccgaggcccctctagccccagaaccagagaaggccttggagacttccctgctgtggcccgaggctcaggaagttttggagtttgggtctgcttagggcttcgagcagccttgcactgagaactctggtagggacctcgagtaatccactcccttttggggactgacgtgaggctcccggtggggaaggagactgacctctcggttcacgtgtcttgccatagagccactctcctgagtgggtttttctcctgatcgtttgggccaagtgacttctctctgaacctcatatttctcttctgggataataaatggtcaccctttcaaggggttgttttggaagatattgtgaacaatggtaaataagggcttaattaatgagggtaagccctcagtaaattgtcactgtgtgttcatttcttcctctgtgtggatcgtgaccgagagcccttccccctagcctcctcctggtatgggtacccaaaacctaggtgagcagggatctctcccaggggcagagagcttgtgtactctgggtgttagagggctaaaatataaccagtcaacaccacgttgcccatttctggtacttccggtagcagcctgagtctcaattatcttgcccagatgatctgaactctgacctctagcctgtttcagcataggcagagagcttgagtaggtgagtttgcattcctcatagcagctggctgagcctagtctggacttctctttgacctgtaacctacaggcccacaggcccaaggcaaccacaggttgcttccagggttaccacacaggtggtttctcatttctaatgctaggttttagataattgttgtaagtgaggggccctggcaggcaggatgacatcctgccaataggagttttctgtcactttcccacagagccctggctactacatactcttgctcaatttcgccagtaattgcgtcaatgtgttcatatcaagtttgggaagaacatcttggaattggtcagacgtgaactgtggtaataatgggggcttgtttttttaagcagataattaaattcctttgcatttgatgattattctgggaagcagactagtcccataaaatgaaatggactctgccttgctgctaagtgtctgacttgagacatgctatcgagtttctcaaaatctcttccttgtgtaaaatgtggttgtcgatgattaccttacaggggtttttttaagactaaatgagatcgtgtacattaaatacaggcactcaggctgggcatggtggctcacgcctgtaatcctagcactttgggaggctgaggggagtggatcacttgaggttaggagtttgagaccagcctggccaatatggtgaaacaccatcccatctctacaaaaatacaaaaaagttagccaggggtggtggcatcgcagctactcaggaggccgaggcaggagaattgcttgaacctgggaggcagaggttgcagtgagtcaagattgtgccagtacactccagcctgggcgacgaagcaagactgtctaaaaaaaaaaaaaaaaaaaaaaatacgggcactcaatacaccgtataataataatatagtaataatatttgcttaggatctttaaaaagtttcattttttcagactcccacagaaatggctctgcacagcagagtgaagggggagagagactgagtctccaggccagaaaaaggccaggttttttgcttttgtttttagttgttgcctggatattgcacagaaagaaaaaataattagcaagttaaacaaaagtaccgcaaagttgattacattggtatttgagtatcacatcttctctcagaagcgtaagagacaaggtcgtgaccatacctctgcttagttttgttttgtaatggtgttgctagtgatcggcttgtcaccagttactggtgtttctaaatggactataattggctacttgaaaggacttcctgagaaagaacattttggaggacgaggagagagtgccttctctattttggctgctttcatgtgacatgcaagagaccatgacgtttaggctgctgctgaggcagccccagaaatgggggccgagaggtcttttcttcattttaatagggtctgtaggtttgggtggttaggtacagttctcagaatggaggttcctggctatgaggccttgagaaagctgaaagtctccttgggagtgtgtgggtggggggagtcgagcccatctgttcatgggcaggtgtcagccaaagcccttgcgggtggttttgaggttggtgggagaaagcatccgtggggtttagagttgtggccttttcactacttgcagttcctttccccgacttggctttactttctggtgtccaggggtctgggccagatgctgagattcctctcagctgacaggtgtgggttatgggcaaacccttccctggaggacataaggcaccggattggactgctgatgggttgctgttggagttgtcagggccttggaatagtcttcagatagacttgggttagtgtgacctggggcaggctgcaggtttggagccatagtaccccccgcccccacaccgggcaccctgctctgggctaatgtgaggcttgcaggagtgagtgatgcagtgggaaggggggcctttcctgaggattctacagctttctccagggaatcctcccaggtagtttaggcctgcaggtgctatgctatccttctttcctaaccctgtctcaggtcctcagcggggccatgcggcatccacttataaccctgcagcgaggccctcttttctggccacctgggtgtttgcctgctgagatgggaggaacagtggccttgggcttcttcccccgtcatgtttatctctgctcagattgggcagcagctcaatgggacttgaccagctgtggcactgccagtctgaagatgagtagggtgatggggggaggtgggcagtacctgaagctgaactggtgagagaggcaggctggcctgggggctcagctggggcctgggatggttggtacagtcccctcaggggggtaggggagtgagtgttagactgcttaagcctcagaggccgctcttgcccacctatgctttgaggagatcctcttcatttgttcaaagggaagactctgatctagagatgggcacttggaccagcaaacagcagctacaggtagccagggcacccgaggagcacttgctcatgagccggtttccctggtttttatgggggctgttgctgagcgtctgccagggtttgtgtcctagcacttgctggtctttgctgggctctcagctctcaggtgtttctctaccagcacgtttccccctccctcatatgcacacatgtggacacaagcaggctgcccaggacagagtgtactttgaggcttgggaaaggactctctctcgcccttttggggatgagccttggaacctcatcaccttccggcttggggtggagcttcatcctgggggttgaagctttaggctcagataactagtcttgtaagccagttttgtcctgttgtttttttcgtggaaaataatgtattgacgtatacacagacattctttgtctaacagtctgagattgagaaataccctccatgactatttggtttgctttcatggtgaaacttggtcgctttcttagacacagcctatggcaataagagtgatccctggctgctgtaattcattccagactttgagcaaacacaaggcaccgcctccacctgcagtggagcctctgatgaaccaaatggaaactccttggggaatggggagtaagagccaaatgtgggattggacttaaactgcagcttcttagaactgtagcattccacgatgggattgtctagtgctcttcctggaggttactattcaatagttggctagtgcacaggttcaggggtgacctgatatgccctagcgtttcagaagatccctgcaaggtgtgtcttttggtccatctgaagggtcttgtatggtgatcttgtatggatatccgtgacggctaaggcatctgataacttcattccttcagttccagcagtgttcctgtattatgctgggcactagagctacaaagaagaaaacaaagtgcctcctcttcaggaactcttaatttaggcaggggaggcataattgaacagtgctgaggtcatctaggggaaccaaagtgtgtatttatccccttccctatcactcccctccctccttcatttcttcctttcttctttcagaaactccaagttcatatcaaaattctccagccctggttttatttggttgtgtgaaaattttcctctaatttctgaagctatgcattagttctgctgagtaatctttaacttgctgctttataatgattataatgagatatcactgggtattatggtctttgggtagcagcagggtagggatttccaggctgggactaagctaatttatgggttgggaattatggggcagttaatagcaaggcagtccaagctttccacagattccaccctagggaccatccagacttaaggaacagggccggcaggctcatcccctttgcactcagctgggctatgggtgtgtgtttgtgaaagaggtttattcagtagtcatacctgctgatttccctgctatctgtttacccagtgcctcctgtaccttgtttcttactctttgttctctgctcttactatgaagaagcagagactggaattctgcttgaacccacatctacctggaaattccagtttttcttgtccagtggagcagcaatccagttgttttaggacaaatggtctgcccttgaagcttaaatcctttgagggcctggcatggtgacagttttacatttggctttggtatagactggtgtggtccctgggcagtgaggtcactgtaaggccagccagccagaccctggctcctaggggaattaacaaggcatgggattagactcacagggtccctcctgtccctaaacttggtaggggttcctgggagccagactgcgattaagattgtagagacctgagacctgagttgtaggggcctctgtgttgatctgggccattgccgggtgagctgaggcggtcactagctcaaggagtgatctcaggatattgttctgtaagtcagagacctccaggttggagagtggggcttgggggtgggggacagggtttagtggggagctggttctgggtgaatgtggcctaaagggatttgtccttagaagacagaggggtgagtcacacactcagtgcttcaggttccactttgcggcttggcctcagcccgccccttccctgcacaaatgaaggccaggggctatataattggctgttgctgaattctttggcagtgattttaaagtctggtctgggtgtgttatgtagctgcttctctatccactccccacacccgctgcttctccagagcccctcacaaagcccaggcagagagagagagagagagagagagaatgacttgcctcacagagatgttggggatagggataggggtatgggtctttgcttttgccttttgaggggggataatctcttccttcattttaaaagtaaaaagtaatgcaggctcattgaaaataatttgaaaagttgaaagagatataaaagcacacccaaattcctatcacccaaaagaaacataccggcatatttcctactagtctttttcatgtttaagaatatagctgatatatttttttttctttttctttttgagacagggtttttgctctgtcacccaggctggagtgcagtgatcacggctcactgcagcctcgacctctcgggctaagcgattctcccacttcagtctcccgagttgctgggaccacaggtgcacaccgccatgcctgactaatttttgtattttttgtagagatggggttttgccatgttgcctaggctggtctcgaactccagagctcaagtgattcacctgccttggcctcccaaagcgctgggattataggtgtcagtcaccacacccagtgttatagctgttgtctttatagatgaacagatagattgacatagattcatgtagatagcctggtgttcagcatttttcatttaagattctgtcacagacttgaccctatacctttaaaaatcacaaaggcagtatcatagtctgtcagctgaatatgccataacttaaaaaaatcattcaactgttgctgaacacacacatatacatatatagtttttgttttttcttagtgatgtagtgatgcttgtgcagaaagctttatgtactttttggatggtttctgtaggagagctttctaaaaaaggaaaaaaagtgttgaatgttttttgagaagggctagattttcaagccagtcttacaaaaggatagactcattggaaattccagatttgcttagtgctggcagatgagtatcacttattgctgaacaatgtgtctagaattctgattaaaaaagaaactaggtccaggaagtgcctgggggcaggggcaaagggccaggctgcaggataggctcttaggatctggctgagcagaaatctgctgtgaacagaatcggtgggggtgatgctttctcagtaacttctccatttgtttctttagcagctaagtccctgtgctggacttctgtggactactgtggctctggggctgtggttgtgggtgaacaacagctagctaaaccagtgctgttgacatcattgagatgtgacgcacaggaaggtgggagcaagcttgcaaatcagattctgaaacatatagcacagctctcccacctccaggtggtcctgagatctagggaggagccatagtgagaaactttaggtttctaggaattctcttagggagaagctctcttagggagaggcagaacctggttctcagttggggctgattcaggtgggttagatcaataaagcctcaggccagtgtgccaggctattcccaaggagtatactttgaagttactccctttagaatgtcctcagtggagataaattctctctgaggagcagttttgtctgccggggtcatttggcacaaagcctggagtgctagggcgaggttgcactgagggaaggggcaggattatgtcagcagtgtgacggatacagtgtgaggtcaggctccttcctgccccaccacgggggcctagaggtcatggggagggtccctggcaggggattcaatcattgcttggccccatgacagagtatattctaaaaatgccttaagtttttttctttcaaagtttcttcctgttttgcataatggccttttgcctttgacatcctgaaaccgcagagctgtcattggtgttgcaggacactgccagcttgaaaaaaatcaacaacaaaaaaagaaacaggaaaggatgtggagttcagggtgcggcctagggaagctggtatttgcgttatgggattgtggggatgtggtattaaggtgttgggtagcgcctgacatttagaggagtactctgggcagagtccctgcctgcccaagaataggtagaattgagtcttcacaccaaagtcaggagagaccccctccccccaggaagagaatgaacagggactcatttcctcattcagcaaacttttattggtaactacactatatgaagtgtgagagatagacatgaacaagagaggcccccactcttgggcagtcccttagtagtagtagatagactctggcaatatggtgtggtcagagagaggaagcctgggtgctttgagggtactgaggaggtgcagggagccaaatgggtggtctgggccagggccagagtcagaatgaaggacctctcttccagacgttgattttagcatctctgtctctcagtatgtttgaacagtctcccttattggaagggcaggagtctactgctaaaagtaacctgcgatttcctctacttgctgtcatgtggaaagaatactaaagctgaaattccaaaagttgcacacctttaccagcagggcaggagaggaaaggaaatggaggcagagtgagctgaagatgataaaagaaagagaaggtggtgcagtttggactgttatggacagaggaagtctgagggtagctggactgagggatcaaagggaggcagttgaaagggaagagagctgcagagagggatttcttggtctgcagagggtaggagcaagccttgaaggctgctggagtgaggattccgagccctggtctttattctttttctaattcattacatcattttaggcaagtcctaactcctttggtctctgttgtctttctgaaatttgagtgggctgggcctgctggtctttagcctctgtctttctctacctcctagattccagtttggcgagtgggggggaaaacctggttgtatatgcaacgtgaaaggcctctggaattccttttgaagctcactacccatgaggcttctgctaaggatttcatcatgtctgtctaagcagacataaaaattttagcaggtggatgacccgtagaaatggcacaaggaatgtttctttctgtcacactgtggtatttgatttaagaaagttgttatcctctctgtgcctcagtgttctcacttgtaaaatggcaataacagtatccacctcatagatgttatgaaatacaggtagtagccacgaaagggcttaaaacagtgcctaacacagaataagttgtgaatatatgttatttattattggtagtataatgcttatttgtgaagattttggcttttgctttataggaccttttttttttttagttgaaaatacaatgttaccatgttaaatgttaaaaaaaattctacttaccattgtaacagaacatgctcccacttctgtaacagagcttgctattacttttcaaatgcatacatattccaatgcatatattccaatgcagttgtagagtgaaactgtttgcatgcagccatttttatccaacattatcttataaaatgttatgttgtttatgattatcctaattatcttttgttgctgtctagtatccttatagatattccattagcatacactattccaggtttcactatcgtcgataatctagatatgaacatttttgtagtgtgtagctctttgcttcagttgaattactttcctgggataaattcctggggaagaatttctaggccagaggatatggtcatcttgacaatactgattcacattgctgcattgctttccaagaggtttggaatcattcacaggttctaaattggaaaatcctggcttttgaagtatgtggattctaagggcgatttggatctagctggagcctcacactgacacttccagccagtgtgtgtgtgtgtgtgtgtgtgtgtgtgtgtgtgtgtagttccctatgctggacaccgtgtgtgtgtgtgtgtgtgtgtgtgtgtgtgtgtgtgtagttccctatgctggacaccatgtggcctttctggacattagggttttcctgtgattgcctcagagcagttcctgttgaattcactctgtgtccacaaaaggagccttactgtggctctttcaacacccacctacctttgccaagttggtttacagaaagtaagaacattctttccttcttccttgatatgtggcgctaaacctatagcatggggcaggctctggctttaaaaacctgacttaaaaataatggtgttgatcaaaaagtttgtggatcagtttttggaaacactgcatgtagccatccatagaaacttatattctgttgggctagcctgggcgcctgatcatttaactcatgtggatgaacttctatgtaatagccctggtgtatgggatccagaaacagggccctaatgaagaaaggcttttaaattatgttggataaaaataagttgttacaatagcccaaagtctgcaaatatgaattgccagttctgtccttgtagtcatccaccatgtgcctgcatcttttgtagactcttgtagattcagaagcccactgaattgcataaatgatggaatgattttagacttagtgatttcagtgactaaaagtttacagatcctggccgggcacagtggctcacacccgtattcccagcactttgggaggccgaggtgggtggatcacctgaggtcaggagtttgagaccagcctggccaacatggtgaaaccttgtctctactaaaaatacaaaaattagccgggtgtggtggcatgcacctgttgtcccagctacttgggaggctgaggtgggagaatggcttgaacctgggaggcggaggttgcagtgagcccacatcaggccactgcactccagcctgggtgacagagtgagactctgtctccacctcccccgccccccgaaaaaaaaaaaagtttacagatccagcagatggggcatattcaatttgtgacagccactcccttcaccttatagctatgtcatatgtcttcttctcctttgactgcattctgcagcagtcagttgtgacttaatatggcactctgggcccactgaattaggtcagagctgctagtagtatattgttcctagagacctagggcaagattttcttactacataaaatgagggagataatttcttacctcaagatgttggtaagaggagtgaatgaggttagttatatggtaatatcagtactctgaatgtcttttgatcaatgcctaactcatcttcttgggcacaaaaggcatacagtcagcacccttaggccacatataaaattcctccaaatgcaggttttcatctgccttggggcagagtcaagagaaagaagaggaagaggcgtgaggctctgaccacaacttagggacagaatatagcccaaagcgagtaccccaggccacaaggagaaggccgctatcttgttgaatccacagcactggaaacttggagtgtgtgttcccctgtgtcagttacactggaattttatggctgctcacattcttcccttcaggtggacgttgttcatcagtatcctgggcaagaggccatcataaaccacagacagctgagtgattaggaagaggagctgaagagggagcattagatgtttgattgagtcttaggtgagaaagtatatcattaaaacaaaaagatagatgtaggcgggctcagtcttgtgtgcctggtgtgttggtagaaaaactaaagcacaagcctgtagataacctgctttattctacctcggggctggtgttggaatccaggatgccagaccctaaagtccagctctctttccaacctactgaataatccgagagaaatcatgttctctctctgggcctcagtttgcccatgtataaaatgagatgaaggattggctgggatgctctccagagtctcttcctgcctggagttctgacgtagccatgtactcctgctcagcatcgctaaatggctttgtggtaggaccattgagtgctgcctccattagggccagctatgtaatgctggggtggctgtcactgggccctaagagccaggattggtcttactggagaaatccacatccacctaaacttaagacccaggggtgtccaatcttttggcttccccaggccacactggaagaagaattgtcttggaccgcatataaaatacactaattatagccgatgaggttaaaaaaaaaaaactcaatattttaagagagttcatgaatttgtgttgagctgcattcaaagccatcctggccgcatgtggcccatgggccatcggttggacatgcttgctttagacctcccagcaattctagtctctaaacaggaaatcaaaagtcaagatgaatagataagttggtcagtgtgaaaaagtaattggtgggagccactgtagatgcagggttctaggctccatcaacaaccacctacatcactgaacgaaagataatgcttgttcagcacttattacatgccaaccatggtaaaaatacttcagatgcattgttttcatgaactctcacagcagctctttttcttgcctaaatgccccgttagaacctccagtacaatgttaaatagatatgctaagagacaacatatgtgtcttgttagggggaaaatatccagtctttgactattaagaatggtgttagcagtgggtttttcctaggtgccctttatcaggttgaggaagttcctttctattcctggtttgttgagtatttttatcatgaaaaggtgatgggttttgtcaaatgcttttctgtgtctgttgagatgatcatgtttttttgtcatttattctattgatatggtatattatacattgatttttcagatattaatcttgcatacctgggataaatcccacttggtcatggtgtataattctttttatttgttgctggattgagtttgctagtattttgttgatttgtattcataacagatagtggtctgtagtctttccctccctccctccctccctccctccctcccttccttccttcctctctctctctctctctcccctcccctcccttcttttcccctcctctcccctccccttccctttcttctctttcatagttgtttaccactgtcagaaaaggtctgttcgttttctttcgtcgtgagatctttgtttggttttggtatcagggtaatactgcctcaaaaaatgagtagggaagtgttccttcctcttctgtattttgagagagtttgtggtcggtttttattaattcttctttaaatatctggtagcgttcaccagtaaagccatctgggcctgatgttttctttgtggaaaactttttgattcctaattcagtttctggttataggtctattcagaccttctattttttcttaagtcagttttgatagtttgtgtcttccaaggagtttgcttcatctaagtcatctaatttgttggcatacatttcatagtgattccttatgatcctttttatttccgttaaagttggtgtagggatagtccctctttcattactgattataataatttgaattttctttttttcttagtcttgccaaaagcttgtcatttttattgatcttttcagaggaccaactttgagttcattatttgttctctttgttcttatttttctgcttcattaacttctctaatctttattctttcattctgcttgcttttggttaagtttgctttttctggtgtcttaaggtagaaggttaggttactgatttgagatttaaagatcatgctctttaaacgttttgatagatactgtcagtttgccctctggctttttctcattaacagtgtataggagtgcttattcctcacactcataccagccctgggtgttactaacctttatatatttgccagtatcatattcagacatagtatcttgttttaatatgtttctctgattactgatgaagttaagcaaattttcacgtgtttattggccatctgtctttcttttttcatcctttctttcaagatgggagtctttgccatgttgcccaggctggactcgaactcctgggctcaaatgatcttcctgcctcagcctcctgagtagctgggactataggcgtgagccaccatggctggcttgcccatttgtatttcttatgtgagtattttttctttttttttgaagtggagtctcactccatcccccagagtggagtgcagttgtccgatcttggctcactgcaaccaccgcctcccaggttcaagtgattctcacaccttagcctcccaagtatctgggactataggtgtgtgccaccacacctggctaatatttgtatttttagcagagatggggtttcaccatgttggccaggctggtttcaaactggcctcaagtgattcacctgcctcggcctcccaaagtgctgggattacaggtgtgagccactgtgcccagctgactttttttttcttttttttaacccttttttttttttaccctttttttggcccatttttttttaccctttttcttttaacccatttttctattagttttaaaaatatgtttgcaggagctttttatattgtggatttttcttgtttattacatatcatttgtaaatatggtctctccatctgtcactcttctttatctctggtttctttagctatgtagaagttgttatgttatgttatgttatgttatgttatgttatgttatgttatgttatgttatgttattttttggagagggagtcttgctctgtcgcccaggctggagtgcagtggtgaaatctcggctcactgcaacctctgcctcctgggttcaagcgattctcctgcctcagcttcccgagaagctgtgattacaggcacccgccaccacacccagctaatttttgtgttttagtagagacggggtttcactatgtaggtcaagctgatctcaaactcctgatctcaaatgatcctcccaaagtgctggggttacaggcgtgagccactgcactcggccagaagttttgaatttttatgtgtttaaatctatgttttcctttatgacttcaggttgctttcatacttaagcaggtcttcaccatcccaaaatgataaaatttttctcctgagttttcttctaagttggttctttagaagccaccaacttggcttcgacagcaaaagatgaacagaatttctgttcaactctcatgctgcaagaagctttatgtaatactccagggaccctttaaggtcccagagttttcctccaaatctatcagtgattctagtggctaagagtagaaatgtgaaaatttagccatgtgtgctgatagagctgtagtaatttgtaagctctgaagttctaaggagtcaggggagaagggaaagtaacatttattgaacatctattagctcaataagaacatgcgataagtatgtatatgtattatttcacttacatctgaaaggaaggcataattatccccactccttagagaaggaaattggagctggctacatttaaagtagtcctgacaccagagagatattgccaggagtacttggctggctgagtgcccagatggcccataggagtagtgggccctccacagtccaaggtctggttctaggtggagagagaaggatgtgctcgtagtcagcaccgcagctccagaaaatctgctggggctccaaaactgattagaggggcagctgactcagtaataaaactcccaggagacttacttacatactggaatgcaaagttgcagctttactgggaagattagaactgttattgagtagcttagaaatctctggctgaattcactgcaagggaagccgcaggataagctaactgctggtgagtcagcagtcagagcagggaagtgaatttaacattagatgggtcagtctctcgtggctgatgaattcatccccacaatactgtacacctgccttagggacctttgtctggactaggggttggggtccccctcctttgtacagccctggaaggacacatccagctccatccgccatctctcccttacttatttccttccttccttccttctttccatccagccatcaagcttcctttcatggccaataatcatcattggggtctactcatggactctcttgcctcatgtatttgttttattttgtcctcattcccacttctatttcccaggtatatcacaggcaactattctaacgtatttatagtttgtgtatctgtttttgctcttgccaaaatggaagccactgctttatacatagatgtattcttaactttaaaaaaaatttttttagattaacctacaataaaattggctttttggcatatagtctataaattttaacacatacatatttttgtgtatctaccaccacaatcaggatacagaacagttccatcaccccaaaaaaatccctcttgtagtcacattctcctcccacccttaatcccaggcaaccactgatctattcttcattactattgttttgtctttttgaggatgtcacataaatggagtcacacagtatatatacatttttttaaacatatgtaaatggcattttatagctcattttgattatatgtttttcatccagttctgttttttttttttatttttaaaaagtttgacataacttcagacttacagaaaagttgttagactaatacaaagaattcctggatatcctttggagtccctaaatgttaacattttactatatttactttttccttctctctctctctctctctcgctctgtgtgtgtgtgtgtgtgtgtgtgtgtgtgtgtatctacctgtagatagatagatattaatataattttagatagatgtatctagatctctctctctcatatatatgtgtgtgtgtatatatctatatctatatctatatatatctccttttacccttaaatattcagtgtatatttcctaacaacaaggtgatttaaaaatatatatataaacatagtataattaacaatcaggacatcaacattgaaacatttctgctatgtcatctacaggccttaggaagactttgtcaggtgccccaataatagccttgatggtagaagaaaaccatgtgttgtattcagttgtcatgtctcttagtgtcttgtaatctgaaataattcccaagccctttggatttcatgacagtgacattgttgaagagtacaggccagttattttgtagaaggtctctcagtttaggtctgtctgatgtttcctcctgatcagattcaggttattcacttttgacaggaataccactgaaatgatgctgagttcttctcagtgtaacgagatctagagacacacactgtcagtttgttccttattggcagtgtgaaccttgaggatttcattgtagtggcatttggcattactccattatagttactattttaccattttaaattaaaactatctggccgggcgtagtagctcatgtctgtaatcccagcactttaggaggctgaggcgggcaaattgcttgaggtcagaagtttgaaaccatcctagccaacataacatggtgaaacgccatctctataaaaaatacaaaaaattagcctggcgtggtggcgcatttgtagttccagctactcaggaggctgaggcacaaggcttgcttgagcctgggaggcggaggttgcagtgagctgaaatcacgccactgcactctagccagggtgacagagtgagactctgtctcaaaaaaaaaaagtaaataaataaaaaaattttttaagtatcttatgggcatatacttgtcctgttactcctcaaactttcatccacttttttttttttaaattttttttcttacctttcatcgttttcttgatatccactgggttttagcatctacaaatgattcttgcctgaatcagttattatggtagttgatggttttctaattccattattccttctatgtttgttaattttggcattcttctataaggaagagcttaccctttttccctattaattaattcatatattaatgcagacctatgcattcttacttcattaaatcataatcctttactatcattatgtattctgatgttcagactatcccagatttagccaataagatccccttcaggggaatggtctttgggattcctctttagaggttcctggttcctgttttcttttgacatatcctattactctttgagcatttttttttttttttttacttttaggcacagcaagaagttccatggtcctcttgttctttccccaactcagccctagagtcagtcacttctccaatgagctctagttccttttagtagagaatcataattagaaaacaagaatcagtgccaagtgtgcacctttgtttttaaggtccatccacgttgccgtgtatatgtccagcatgttgattctaactgctgaataatacctcatgattgtcatccatcccagtgtttctttttcccttctgtaatgagggactcctggactgcctccagcattaccttcacaaatattgctgtgaggaaaatccttaaacgtttcctttatgggcaacgtgtgagcatgtttatgttgattcaggggtgccagacacagctccagaatggctgcctcagtttacatttccaccagcagagcatgacaggctctgtgtctccgtgaataatcagcattaaccagcttcctattttttgccaaactaatagatgtgctaggataactctttgttttaacttgtttttctctgattaccaatgagctggagcatttcttcatatgcctgatggtctttgggattcctcttaggtaaattgcttattcattataatcctttgcctgtttttcactggagttcttatatttttcttgaagatatgcaggaattccttatacatcctagatattaatcccttcctggtctcagacattgcagatatcttctgaatctgttatttacttatttatttacaattttttttttaagagttggggttttgctctgtcacccagactggagtgcagtggtatgatcatgactcattgtggcctcgcaatcctgggcttaagcgatcctcccacctcagcctcctgagtagttgggactacaggtatgcaccaccagacttggctaattttattttattttttagagatggaagtcttaatatgttgctcaggccaatcttgaactcctggcctcaagcaatctttccacctcagcctcctgcatctattatatatatgttcactttgctcatgctgtattttgttgcaacataaaactatttttcccattgttttgtgcagtctctcaccagcactcttctttttctgtaactgtgttaatgccctttgttcttccatatgttaggtatgctggtatagttgaactctgctgactctcctcagtaaacagtctctttttatgacaccttatcctctactgaattctctctatcaagaatgacttggccgggcatgggggctcatgcctgtaatcccagcattctgggaggccgaggtgggcagatcacccgaggtcagaagttcaagaccagcccggccaacacggtgaaaccctgtctctatgaaaatacaaaaatcagctgggcgtggtggcaggtgcctgtaatcccagctacttgggaggctgaggcgggagaatcacttgaacctgagggggaggttgcagtaagccgggatggcacattgcactccagactgggtgatggagaaactccatctcagggggaaaaaaaaaaaaaaaaaaagaatgacttgtcttcctcttagagtgtgaggtctacatacaaatattattcttgtattcagcaaatgtatgtcataggcctagtgtgtgttaggaactgtgctgtcaccaacaaagtttagagaggttataaaacttgactgtagctttttagaggtggaggagtgatttgaaacctaggctgtaattccttcctcctgtgattccttcctactgtgttgccttcccttgaaaattgcatttgggggccaggtgtggtggctctcgcctgtaatcccagcactttgggaggctgaggcgggtggatcacctgaggtcaggagttcaagaccagcctggccaacatggcgaaaccccgtctttactaaaaatacaaaaattagctggatgtggtgtgtggtgacatgcacctatattcccaggtactcagtaggctgaggcaagagaatcacttgaacccaggaggcagaggctgcagtgagctgaaattgcaccactgcactccagcctgagtgacagagtgagactctgtctcaaaaaaaaaaaaaagaaaagaaagaaaattgcatttagttcctgtagactgtgtgtcaaatgtctaaatctcttctaacaaatggcctaaggaggtgcaaagcgaagcatcctcaccagcatcctgacttggcagtgaggcatgggaccctggagggagtagtggtaagtgtgactctggaattcttcctgggctacttgtcagtgactggctccagattgagaggagagcccagaggacacaggtggctgccccagcctggaggtgaaagtcttaaaataaaatgccagatgcctagaccattctaaacctttctgagaagctgaaatcatcccttctggaagcgctctagttctaaaaggacagatatacagcaagatcttcctggggctaatatggagtttataggcaagtaggcctcagaacctttccctggtagtgatatctgtgggcaggcacagtttccacactttccagaaattccagcggaaggagtgagaaggaggaatctgcccttgagtgaggaccaaagaaagcagaaattcctcttgggaatttttcctccagagaccaaacactacttgggagcttgtttactgggctttaaaagcttgtgacccccagtcactctttcttgaccccaaggctttgcatttctgtggcttccccactggacagaagtggaactgtcatgctgcctgttctggggtctcccagaggtttccccatgtcctctccttgcttctactgccccacagaattggggatctgtgaccacatatggtatagaattaatgcttgagaatggtttagttcagtgatgtcaaataagattcacttttatgccacctccatcagttgaaggcccccctggcccctaaattggaaaagattctgagacagaatccccgtgggtacagcgcagggacagtaaaggcacgtgtgctgtgatttgctatccactgtgtggatgcatccaggaatatcagaaccctggaagattatttaaggggaagttaggacagcttttttgccaatccaagggtgttcttgaggaagtctgtcttcctgtatggccttcagtttctttcctgtgtaaccatggggccaacacataattcccacagctctattggcccttgtctgccaggattctctagggtctgattcgaggtggatcctggccctttgaggtggcagaatctgatcatggtgctgtttccttagatttaggccttgatacccttggcgagagcatcctgggctgagtgaccacctgaggtttttctggtgattttgtgacccatgtaaaactttgagctttgggattattctctcaaggaaatagtgacatttggtgaagagcctgtttggtgtggctatgtgaggcttagccaagaaaatgcaccatttttattaggaggttaggccatccgttgccacaaagtgtcagatgctaggcctagagcctggagaaaacttattttaaaattgatggggtgctggaggggttggggggtggtggctgtagctcatgaatcaggtgctaaacctagaaacaaaaggcctcatgtggcagactgtttctgagcacagatgaatggatgagcaactggcgcaactttgcccagttggtccagcttcccacttggccacctaggcttgctgtgaagacctcgtctggcagaaatgagagtgtttttgccccatcttgatcttaactgtaatttaagactaaaatcttagattctaaaacatcaaaggcaagatggctcccagctctgtgagctcagcttctcacctcttagttgaacaagtgcagtgtgggtcaatacatgattgctgctcttgctgccaggaactgtcccagcatagaaaggaatgggacacaatccctgccgtcaagattctaagggaggaagcaggcaggtcgactggtgcctcatctctgcagggctccagccaaggtttgtgaaggattttgcaggcatatggagtggggactgattgatcccgagaggggactggggaaagctctgaagaggggatgacatttggtttgaactccaaaaaatggttgctttacctgtttcctgaagtttttgaggtggcttataagaacatataccataaaaaggaccaatataaatttaaaatcagaaaaagagaaaatgggctgggcatggtggctcatgcctgtaatcccagcactttgggaggccaaggtgggtggatcgtgaggtcaggagatcgagaccatcctgcctggccaacatggtgaaaccccggctctactaaaaatacaaaaaattagctgggtgtggtggcacatgcctgtagtcccacctacttgggaggctgaggcaggagaatcgcttgaaacctgggaggcggaggttgcagtgagctgagatcgcaccactgcactccagcctgggcgacagagtgagactcctcctcaaaaataaataaataaagagaaaatggaacttagaaaattaagaggaagagtgaaaaggtagatatttagtcaggcacagtggctcatgcctgtaatcccaacactttgggaggccaagacaggaaaatctcttgagaccaggagcttgagacttgcctggcaacatctcaggtgagaccttatctctacaaaaaatttaaaaattagctgagctgtgtggctcgtgactgtgatcccagctactcaggaggccgagaccacagcccaggaggatcgcttgggcccagcagtttgaggctgcagtgagctggcaccactgcaattcagcctgggctacagagcaagacccagtttaaaaaaaaaaaaaaagatattcaaaccatgggtcccaacgtagttattatatttgaccatttgcaaaagctgaaagcaaaacatgttacacattttcagagaggaaaatacacagtagttcctgagtgtaagttgtttttcttgacctcattcttaaattgcttcatgagggtgggagggaagtggtagttaataagtgaacctgtaaaccagcgtttctcaaaatgtagtccagggaattgcatcaaaattgcagttacctacagtgcttgttaaaatgcagattcctgggcccctgccccaggcttatcaaatcaatctggtgagtaggactcaagaacctgtaaattcacatacttctgcagatgattcttcttgcactgcacagcatgaaagcctctgcaatagacagaaagctaccagcattgcgaaagcaacttgagtgcttggcctttgaaggttgagtgggactttaatgagggagagagtaaggcatgagaaatggcagttccactgaggtcagtcagtggttcattgctgacgaagtcacttttaagtcatgttttagaagaactaccaagtgtggcaggtcaggcatgtggcaggactgtttctgagcacagatgaatggatgagcacctggccccactgtgcccagttggtctagcttcccacttggccacctacggtctgctgtgtggaccttgtctggcagtctcctttaatttattttttattatttttttctttttgagatggagtcttgctttgttgcccaggctagagtgcagtggcatgatctcggctcactgcagcctccacttcccaggttccagcgattctcctgcctcagcctcccaggtagctgggatcacaggcaagtgccaccacgcccagctaatttttgtatttttaatagagacatggttttaccatgttggccaggctggtctcgaactcctgacctcaggtgatccacccatctcagcctcccaaaatgctggaattacaggtgtgagccaccgcacctggcctattttttttcagcaaattctttgtttttctctctgttcccaaatgcagggtactgagaccacagatgtattctgtttcctgttgaaaaaatgtttctcacttagctgggtgtggtagcatgcactgcagtcccacgggaggctgaggcgagaggattgcttgagcccaggagttcgataatcatgccattgcactctggtctgggtaacagagcgagaaactgtctcttaaaaaaaagaaaaagaaaaagaggtcctagggaaagaaacaaatagtggcttggatggtgagttggtggaaagaacagtgggtgttgggggtgttgaacttgtgtttgtgtgtggtgtacccaagacatatcatgtcagcattaagaatagactattcctgttttctggtcactgagttgtatgttttgacatccttattttggaagatacttccttactaggaatgggatagggagggggtcacctttcccatctgtgggtcatattttaaaatatttattgttcaagtttaaagatataaccaaaggtataaagaaaaataccacaaacatctgatttaagaaacaaaccagccgagcgcggtggctcgtgcctgtaatcccagcactgtgggaggccgaggcaggcagatcatgaggtcaagagatcgagaccatcctggccaacatggtgaaaccccgtctctactgaaaatacaaaaattaactggtcatggtggtgtgtgcctgtagtcccagctactcgggaggctgtggcaggagaatcgcttgaacccaggaggcggaggttgtagtgagccaagattgtgccactgcattctagcctggcgacagagtgagactccgtctcaaaaagaaaaaaaaaagaaagaaatcatttcctacaccttcgaagccttcatgagttagattttgaaacagtgcaaaatgcttcacgtgagaatcgagagtcccttctggtggctctccatcccctgctcttctgtcaggttttcttgtaggtttatggaaacctttgttacttgtgcaggtggcagagaagcagagaggatagctgcgcgccacccacacagctaggatttattggcgtactcccacgtgcatggcagccaagtggacacaactctgtgatgaatcctcccaagagaactgaggggccctgatggaggagctgcttctttgcaaagctttccttgactctcttcctgtcccctagttgattccccttctgtgctagttttagcttattgtttgttacctgtcacacttagcagtactgttggctttgctggtctccttgactactgggggtaaagaccttttgttgttgttgttgagacagagtcttgctctgtcgcccaggctggagtgcaatggcgtgatttcggctcactgcaaccttcacctcccaggttcaagagattctcctgcctcagcctcctaagtagctgggattacagctacaccacacccggttaatttttgtatttttaatagagatggggtttagtagagatggggtttcaccatgttggccaggctggtctcaagcccctgacctcaaggtgacctgcctgtctcagcctcccaaagtgctgggattacagacatgagccaccatgcccagcctcaaagacctcttctttacttgctcaccctgccgcccactcccctaccaacccctgcatgccctataccacctggcacatgatacatactaactgggtacatgtttgaatatgaatggatgtggtgctgtgaatgcttaggggaagtgggtgaaatgcttaagaaccaaccttgagtggtctgggaaggcttcctgggagggtggtgtttgagctaaggccaggcagctgttagatttgttagactgaagcccttgcagacttagagagcttgtgctcttcccagaatgacgggtgagccacgtacagtaaatggtgcttctcatttctagcccaaggggcctcaaggggcaccgtgatttcacgagaatgctgcaagcaaatcttttctcaagctggggaatttggtggtaatgcctggctcagcttgcggtgcgcacctggcctttggaagattggtacagagagaagcggcccatccacatgagcctgtggaacagcactggtgggggagctgatttgtgaagaggggctgtgcagtgtactgtcaggtctgagacccaggaagaaattccagtatcccagctctcagaatcacagagttctaggcactgcctagttccacgtgttcccaaatgtttcctgaatacttggatttcctgtccagagaattttcaaaacaaacttagaggcctgacccatggctgccaaggaaggattttttttttaaattaaattttaaaaatcagtccagcatgaaaatctatgatgatttcataagagaaaggacattttaatattcaaagagtaagaagcacttaatcttggaagaaagggcattcctatactttgattacctttagtttaattaaaaaacacctacatggtctttacttctgtgatttcattcctgggctagtgaaacattgtcacaataaagcatcaggccaacgcttctttcgacccactggccaatcagttgacaaacagtgactagatgtttcagcctattttgctgaggctaaaggattgaactagtgcttcagccagcatgaaaaccagtcaggagtccgtgctggtgttggcttagattagcagggcctttgatggaggggcatgtatgtgtttgggtttgctgtgccaggcaggggagcagtggaatttgtctgaattgagctcacacattgaagttattgagcgacttacatgcaaggccatgacctggactcccagccgagaggcccacgtggcggggcttgagctgggggagccgaggacagcttacatctgctcatctgcttacgtaaccctgcctcccagcttccagagccaagaaaacacacaagccagcccagcggggccgagagcctgtggtagcacacgccatgcgccgcacagcaagggcgccttggctcggcttgaggcctgtcatgaagccctcagccctctgcctcctcccagagcttctccccaccaccccaggcagtggctctgaaacctggtcgcaggtctgcatgattctgaacagaggtagtcgttgccttcctggagtctgagctctctggagtttctcactgggacagagccaggtgtgtagcagagcatggtccctgcagtatggcaggaggtgtgcagggcattcaggaggcctcctggctggcactcgacccaattagtcattcaacgccaggtctggggctgctgtctgttgtctcaaaggtgtgagctgcaagatccttagagttgtggagaaaaaattgccagattggcaagaagggcaggattgggggtcaaggtgtctcagtgtgttggaagcatgatgggggttgtgcaaggggcacagcgagttcagaagggagcaggagagtgagaagaggctgttcagtgataaagctctgcacagagccattggaggagcaagctccttgaccatccttaaaccagggtaattttcatttaggttctgccacacgctcagcagggaactcctggaaggcaggatttgtcttgtccatcctccctccctacctcaacccactcctccttgggctggcacacagtaggtacccagaaagtatcaattgaaacaaattgaaagtggtcttgatacatatcacagggcaagtttgcagttaacagacatttcagagtaaagactctctggcttggtgctcgatcggcttctgtgggttgtcagcatgctgtggacagccccggcatgggagcgagtgggcgtgtgtgtgtgtgtatgtgagggtgagagagcgttagtgtgtgtgttggggttggggagagaggagggggaatagaagatggaccacccgggtatcagcttctgccctggggagatggtggtgtcagttgctgagggaatcctgagaagcaggtctggctgtaggtggtgatggtggtggggttgcatgagaatccatttggggcaggttgaatttgaggtgcccatgacatatggctagccatgttctgttggctgtgaggtcaggagagagacatgagatggaaacagaggtttgggaactgtcatgtgcttaaaccaaagacctgggtatagggagagtgagaagagaagggggcaaagatggacatccaagaaagaagctgagaaagcctaggaatttgaggtaagaggagacgtaggtaaatgtgacgcttggtgatcaaggcttctttccacctctcctatgctggacactcacgtctcctgtctgcttggaaattcatgctgagggcagggaaggtgggagcaaggatttgtctaaagatcttgctttggatccctgcactcctcctggtttaccaagtgtcactggacacgtcagggcgttctgagaccttagagagcatccagtcctgtccctgcagtttacaaatgaggaaaccagtaccctgagagtggctgtactatccactctcaggataccaaagatcatctggaaagtcactggtggagctggaccggggcccaggcatctcttctcctgtccggggctcttgacttcaggaccacctttctgaaacccatgatggggcaacaccaggacactttccagcctgcaggtgtctgtcccgcggaagcgagccaggccacatgtgaattcctgttttctgggtgggtttcagaaggtacgagcaagtcggcagggtgacagcccaggtgcttcttgggttccccaaaacgcggttatgtttagcagcatcctcagaaccaaaggtggggtgggggctgcagatgttgtgggggccctctgaagtgaaaagagccctgtgacagatcttttcttcatgtttttcacaagttcactgtgcagcagggcccccccagtagcctttgcccagggttgggtgttgggcagcccaggcctggctgaccttgtggggaagggtgtgaatggtgggaatccccgagggccctctttgcccgaaagccctaagccttgacatcagatgcccatcagatggtccatcggagccctactacccagcttgcccagtgagaatcatctgggctccttgttaggtagccatttaggtccttcccaaaatccacagactctctaagggaagggcccgagatgctgtacttgtactaacttcctcaagcaattcttgtgataggtttgggaaaaacttgtccagggtgaccactgactgagtcctggtcttctctgaagagcacagtgcctgctcactttagggcaccctgggaggtgggagctggctcagcaggcagtcttataagggactgagcttcaaggcctctgtccctccaggagggaggtgcatgaccagagagggaggcctgaggatcttcttccctgccccagagggtctgctgcctgagctctgtgatagcgcagagagtaaaaggatcaagcttgattgaggcctatctctcaatgcgaaagtttgctagttaagaggagagtgggaagggcatttctggcaaagagaaaagtgtggacaggcatggcttaagggatggggagggagacagacagagctgagggtgaagggccttttgctcagctgtgggccttggccttcccttgtgcagggacacacagccttagagccactggaggttttagtgggaaagtaatatggtcggggctgtatctcagaagaaaacaaactaatgggaacaggtcctgtgatggtggacctgggtcagctacggagggagggaagatgtgagatgtgtactggggaagggggtggaagtggcagctatctggtgagaggaagcaggcccacagctttttttctcaagctgttgaattcagaagggcgagtgattccgggagtagggggtgcttggagagccacgcgttattgataaacagggcaggctgaagcctgctcactggccctgggcgggttctcaccagcatgtttcaggttttgatctgtgcttgtggttggtgttcctacctgttctctaggttccttcctttgttcttgtggctcatttgcttcacaggtgaagctggttacactagagtaacagttcccaaagtgtgttccctggaaaaatggttctgtagccaaataagcttgggaaatggtgggttaaatataacgaagggggtttttcgactgcacaacttctcagagcctttggtgtgtgtcgtgactttgcagaagcaggatttaatacgcagcattcccgttcttatttgaccacgagacatgtttttccattaagcatcttgctgggtctgatgttttctggaacccattttgaggcggtctggtctgcagagagtatggggagcctgggttcaagccttggctcttgactctcagcagagccttgattccctgtgttgcctggactgcaccacgtgtaccacatacccggtatgtgacgttttcctcatccctcttcccacctgccgttacctcacaatccacaatctgcacctcatccatttttcttctgaggcaagcactctcttactaacttacttatctcatctgcatccatgttcttctaggccagaaacttgggagtcatccctccctctttgttacttcttcttcctctttgttactttatcccctctgttactaaacattcttctgtgtttccagctatttcttttattttccctcggtctcctttggggtttctttgcctccatctctcccagaccttggttcaccttccatcgagtcccttcctgggacatgggcactcatgccactcctgctaccttccacttcgaagctaactccctccacactgacgtccccaacatgcatgcatacacacacacacacacacacacacatacacacacacacacacacacttccccagttaggctagaatcagagagatgatgtcagccatttgtccaaggccacgcagctgggaggtcacagagctaagtctcaacctcaggggttttgagaaattgccttctcatccgtgatcactgatttctacaacagcctgtcaggaagtctgggtagaaattacttccattttacagtggagtcagagcggggagggtcctgggcaggcgagtgcttcacagagtgaccaaccatctaggtttgccccacactgaagggggtttctggggatggttggtcaccctaatgctggatgtggtgcctgatgctgggcaggagggccctctccgtggccacgttgcctcccaggaggagacatttcctctgcagctgcagctgcagcctggccatctgatgcagcctgtggagcggtggcgagtcctgtggcctgctaacttctccctccctccacctctctagtgggccccatgctgattgagtttaacatgcctgtggacctggagctcgtggcaaagcagaacccaaatgtgaagatgggcggccgctatgcccccagggactgcgtctctcctcacaaggtggccatcatcattccattccgcaaccggcaggagcacctcaagtactggctatattatttgcacccagtcctgcagcgccagcagctggactatggcatctatgttatcaaccaggtgaggcctgggaaggtggaatgagagagggtgtgtgtgcatgcagatgtgtatcagatgtgtgtgtaatgagggcaggggaaggggagtgatttcacagacacctggcacttacagcgaggaaccagccccccagccaccaccagtgcagatgaggtaaacgccaaacagtgtgcttgcctattgctgtcaactctatagccaagggaaatgctggagtgttttcgttgttctgtttttgttttctggaagtagccttccagcaagattgggaaaaaagacaaccctaattattccaaagtacacactgattattccctggctttgtgtagctgtgtattttccttttaaaaataaaaccaccatttagatgtcagacttttaggtaacttcaaagtttatccagtcagtcagagcgtgtctcctggggcacctggagacagtgcccttagttcaggtcacatgcctacatgccagcccctggtgaaatatctggagaagtctgattcgtgggccatctgagagttatgtggactgggccgagtctgagaaaaagtttctcactgctcgtctgatccatatgtgttgggctttagccctgcttaggaaagtaatgctaaggataggtcaactttcatcaccatggcatggagaatcagattgatctaagaggcatctttattgaaataaatttttcagtttatttgaggagcattattttcccaagagtataactttgatatttcaagattacccctaacacttaaattcatgtttttagactataacctcctaggtgcaatgacacatctaacttatctaagcacccagtttcattgaaattcatttgaagagtctgagtacgcccatttctacaaggcccaatgtccatttcatttcgagataaactctgctttaggtaggaggattgttggcagtttacggcttccatcaaggtcaaggaactctgtgcaccttccctatgaccccaggggaagcactcgaggactgctgtggcattgtgctgcatcacttgctgcagggagattctgaagaagtgtaaggtctcagtcctgccctgtcccgaagcctccaacccacttctggcaagtgggaccttcccagggaacaatttgttaacagacccaaatatcctgtgattggatggtggctgccaaatgctttggaagctcagaggaaggagagagagcaatggcttggaagaaccaggatataaactaggttctaaagtctgcagggagatgggcttctcagctggggccagtgagcagggaccttaaggcagaaaggagccttgcatgttcctggaaattgagatgcccactggggtaggaaagcaccagaagctctgggaccaggtgtcagagttaagcctgtgaggcaggagagagcagaacaagccctgttacaaggaaactgaagcaggagagcaggtggtgggcaaaccccttgaggctgtttgaattcttcggccaagtgaggtacagaccagggccctatgaacacctgcaagcaagacagccacgcagttgtgggtcaccttggaagaatattggagaatgcaagagagaacaggtaaatgtcctgcaaaatgcgggtcactttaacccaacacatattcatttaagaaaagctctgtgattgagaaacatttgtctgatgccagttagcacataccaatgacggcaagattcaggagcctgttattaaagcagtggcagcgagcacctggaagaggcggccaccatcaccaggagccagcagggatgactaataagccgtgccagctgcatctcgtttctctcttgacagttgctatgccagtagatgagggatgtactgtggatacaatgctgtcatatcttattcagcagggcatctgatagcatcccacaaatctgcctgagtagaagacagacagctgtggtctgggtgccatataggtaggttaaaatatatatttgggcctaggcgcagtggctcatgcctgtaatcccagcactttgggaggccaaggcaggcggatcacttgaagtcaggagttcaagaccagcctggccaacatggcgaaaccccgtctctactaaaaatacaaaaattagctggacatagtggtgggcggctgtaatcccagctactcgggaggctgaggcaggagaatctcttgaacccaggaggcagaggttgcagtgagccgagatcatgccactgcactccagcctgggcaacagagtgagactctgtctcaaaaaaataaaataaataaataaataaataaaatatatacttgggtaaagaggataaaagagttagcgatgatgctgaatttttgaactgaggtggctgttttcaaggaagactggagggtgggatgctacgtctagatatgttgcagtttaggtgaatgtgagacttccctgttttgaagtcaaatattggaccagtaaaatctagccatcagcttaaattcctatgatacaatttacatactccccaggctcaacacagtagatttctgaatgtcctctgccagctacatgctcctgcccacctcaatccgagtagatggaacaactaaccaagccagctcagaccggtggcacagctgtgctggctaacactgggcaccacctaagagagtgcttctccaaaagtgtgcttccccaaatggagcgaaatacgcttgaggaatgttgggttgaaccatgtaaagcaggtctcattcccgcagagcctttggtaccccggtgtacactgtaaccccagaagtgtttcctgagcttgcctgacgagacaacttttccaagaaccgtctcaagtgatgagtgttttgtgagtcacactttggggaaagcgggcctaagttagcatctcctcccagctgcctccctgctttccctggaacactaggaactgcccgtcctccctccctccctcctcttcccacttcacaacttagcatcaggaatattttagttttggtttttcaaacatatatacctccttttttcttatcttgtcaatatcatcttttttttttctttgcttttcctcatacttttttttctcttcatcctttccttctccaagggttaactttccaccttaggagaatcttttctgctttttctcccacttccccagctactctcttatcatctgctccaatctcaccctaattgatcattttgggaaaatatggtcagagtccagataactaagttgagaaatgcttaaactctgccatacctttccagtaaagaatattacctaataaataataaaatggtaatgggaaacctgaaccctgaaaaaaaagaggtggaaggagaaacatttggagcacatcctgtctacaaattaggaactgcctgtgttatctgttttatggttatattctagaagaagaaagggattttgtagcacctggttttgacctttctgcactgtttgttgagcaaataaaccttatgggctgttagccctctttatagcctctcagcttatccctggcccagacaccctgctgtcattttgacttttcattcccacacacacatacacatgcacacacatgtacacacacacacataccatttaagattagacagaagtaatgctcaaaatggagtggcttctgagacatttagtccaagggttcccaaacaggcttttcagtatcagatttctttctgccccattgaaatgctacacaaccttccgcttacagcaggtcacaagggtttcattctacttgaagtaggggccatgtcccatttccacttccttggcttcccattcagtcactgctaggatttgcctagacccctgaggccagacaatgtagaaacttctgctccatgtcacaggtgaggaaacaggctcagagagggacaggctccgaaagtcacatagacaacagtagggctgcggctcaaaccccagcgtctgactccaggtttagtgccttctcagggcatcagtgacactcctcatggccagggtgcccccagtgttgctcacagtctggtatccagggctgagagtgtgctgtgtgctcagactgcctgggttcagtcctggcactgccactttacagtcagtgacctcaggcaggttacttaagctctgcaggcctcagtttcctccttggtggggagggttatgaggcatccttctcatggtaaaccttcagtaaataccagccgttactaggagggtccactcctgcctctccactctccattcatcctgcctgtttcctctgcctgcttcctctgcctgcttctgtggtggtgaattcttcatggctcccaccgcctcctgctgcacccccactcagggcccgcatcaggacccttcctcctattggtttgaactccttggagtcagagggtaatggatagtggagtgagccaggtggcagaatctcagaggccatcccgggcctataagcctcttcaaaatagggccacgtatcaagctttacacacaggagtgaactttcacaagttgttatgactcatactctgtctatagtaagctgttaaccactcccatttggcttatgcctctgtaattattgtactaacttatatcttaaaataaggatattgaaggaatgagccgggagaggctttcctggttgagatatagaagaacaagagttgctctttttccttaaggtctctcctcccacccctgaccttagctcaccagcatgggagaatactatttgactccttgtactctgagacgtggatttcaagatatagcattccaacttcaacggcagcaagaaaagaagcaacagaaggagaagacatcatagcaaacagggatgcatgctgcatttcctaatactcaaacccggaaacgagacttcactcaaggtgaagggagggcaggtcaccacctggtagcactagccctaaattaaggaatgcagaatgtttgtgggattgcccatcataaaaattacaaaatgagtaaggaatgcaggcacagctggccaggtgggtttgtcacaaccatggcagccctttgccccacagccagtacacagaactggtctctccaattccgattgcatatcttctggcacctctgttcctctccctcagctgcccaggatttttctggttctgaccatgttacttcctcttttaaacctgttagcatttcacgactgcctacaggcaacggtctaaatggtcggaaggcccaagcttagcatccgagaccctgacctacctccagccacttcctcctcctctccacttcactggactccccatctccacccagacacctctgttctcccctctgtgtgcctttgcttatgctgtcccctgtgttcctagtgtgtctctggctatcttttaagcttccctccccaacctcattagttctgtggagcccctggaatagagctgacttctccttccctgctgctcccaggctgctcagaactttctggaaagggatgattatctgagttccagcctcaccccagcccccggactctgagtccctcatgtctgcctcccttctttctctctgaccacacagctggtacatagtcagtacagacgcagtcagtgagtggagcacggggcttctctccaggattcctgcccctttgtttatccctagtctcaggactccctactcctggtcttctgcctaaatctgtgcctcttggaagtgaagcctccgttcccagtggggccaggtcctgacccttgggaacttgcaggatccctcccttgggcctctccccgaagcttccagctcaatgctgaccagagcacaggctgcctgtgacagtccttggggtgacctcccttatcaggaaaaatgcagaaaacctattaataccttagccttgtgattgttaatggtcacaaaactcctttagggtcctttggactcagcacctttatggtctcactttgaattttgaacctcccacctccccccatcccccagagtaaggcaaatggtcttctgattgttcctgcagagggaaggctccacaggtaagcacacgatggccaggaagcagagctggagcctgcctgaaaggctgtggagaaatggagggagggctgccctgaggactctgtctggctttgaagttttctactgtttccttttcttctgtgcactgttttaggatgatggggtgatagttccaggctggttgaggatggatttggagacagtcctttgtaccctcagtgagcaagagtatctgtcaccctacctcagcagttgtctctgtcactggtccaagcagctggttcctacacaaggtcaagatcaactggggagaagcagactcctgggtctatcccattagtgaggacagctgcctgggcttatggcctcattggtttggtttctatcttgatcatctctaccatccccccatcccggccttccattttctacctcagctgtcagtgcacagattgatgtgtgtgggaacggagcttgggaggagtggggtagggctggtcctgtcctgtagcctccccttccttcgggcacttggaccctttggagcttgccggggtggggaatgggagtgggaaggccagggagtgtctctgcaccatcactgtttgagtgttgcccctttgctgtgtgccccacctagtctatgtgtgtctctgttctctggggactcaatttgctggtgaattgcttccatggacattgttctgggaaatgccattttttctgctcacccatgactctgtgacaaggaatgacagcttattaggaatttgtttttgcattggaacagtggtcatcagaatgggccccttttcccttgcagctttgacatttgcctctcttttcctcacctctctcccttgcatccacccttttctctttttcttcttttttgttttccttctagcaggggccttttacctttacttgttaatcctgtttgtagcaaagcaagtggaaggaggagttcctctctgatctgcttcttattctccacctaccttctcttctgtactttccgcctcctagagagagagagagagagaggaatgccgacctaactaccgctgccactgctgctgccaccaccgctgccaccaccaccctggtaatgttcacatgtcctcaaatcaacccagagccagggccctgctggtcagggggaggctatgtaaataatcccatgagtgtgccatcctcaggccctggggtctcctaggcaagaccagggcctctgtgggctctctcggaaatgctgaggttgctggaagccagcccgtcatacagggtctgagagtttaacttcttttaaattaaaccacagttgagctcatgctgtgtgtgtataaacttttgtatcctgctttttccttaaattctttatcatcagcatcttcccatgttatttcatagtcttcatcatcatcactttccataccttcatagtagttgatcgtagaattccatcataattaacttgtcttttctctcttagaagtcccttaggtaatgtccaattttccgtgagtgtaagtaataccataatgaacatcttggagtctgaagtttattctgtgttggtttgttccacatttaggatcattttcccaggctagattttcagatgtgggattatgggttcagatatggtttacacatttttatagttcttaatacagatggccaaattgctttctgaaagagaagcttttcttaagtatttttctccaacttgtatcttaaacatcctgaacatgcttagcaccactgtcttgatatatctgcggaaagccacgtctccacttttcagtgtgtcgggccctgggagaggcaggcatcctgcgctggctccttggagctgggtttaaaattgtctcctctggctgggcgtggtggctcacacctgtaatcccagtactttgggaggccgaggtgggcggatcactaggtcaggagatcgagaccatcctggctaacatggtgaaaccccgtctctactaaaaatacaaaaaattagccgggcgtggtggcgggcacttgaaaagtcccagctactcgggaggctgaggcaggagaatgatatgaacccgggaggcggagcttgcagtgagccgagatcgcgccactgcactccagcctgggcgacagagtgagactccattttaaaaaaacaaacaaacaaaacaaaaaaacaaacaaacaaaaactgtctcttctgtgctcacttcacccagaatccctgttgggctcttcaaggagctcagttctctctgaaagcaactttatagcctcagtccagtctgtgttcctgtgtggcaggggtcaagggtatgctcactcttgagagtggtgtctttggttgaccaagaaccactcccatagcctggtccctaacccttgaaggcccatctctctcactcactggggtgaagagtttaaatctcagatccaagttttgttgagagctctgagctaccatattgctatggttaacaatagttaacaatgttaacaatggttaactatggttaacaatagttaacaatgtttaacaactagagcccagctgggtgtggtggcatgtgctaacagtcccagcttctcaagaggctgaggtgagaagattgctggagtccaggagctcaaggccagcctgggcaacatggcgagaccctgtctcccctgcaaaaaaacaacaacaacaaaagcaaaactagagcccaactgctgtgaactcatggctgagtagatattattagccctccacaaactcagcatttgtataatcccaggctgtttccagtaattctctggggatcatctcccagcctgtccactgttccaggatccacacttaggcctataggaatgccccgtcagagcttctgctgccgctgatctgttactgtttcatgcaacccactcggcctagttccttcctcttactgtctcagtgggcacagaaaagcatacagagggtgtttcagcaaacattgccactggctgcagacctgcccccggatctgtcctgttgagagcttagtgctgcgttcttgcatggtggggaggggtgtggctctgtgatgagccagggcatgtgtataggagcaacagtgtctctcttatcacgtagaagttctgactcattgcgagtcttggctttgggttaatggttccagccatgttgctgctgtgtcttttggtgcaggagaggctgggcacagttggtccctaagccattatggataagggatgtgtctgctgatatacacacatggacctgacatccagggaaggcagggtgattggacagaacagttcttccagaagctgttggaacttggacaagagtggcccttggctttctgtagttggtcatctgtcccctgttgcaatcaggggaaggccacacttgccttccttaaccacagttaggattttcttggggattagaccagattctagcacctgtcctgaacctctcgccccgcccctacaaaggctgcttgcaagtgtagtgcacatacacagggagcaggtggggcatggaagtggaagtggagcccctgcctttggcccttgggggaggcactgtctgcttacccacggttgttgcctcataggaatcatacaacagcttcctaactggtctccttgccttcagttggattggggcacaaatccctccttgacatataaaccatggtttaaggctccctgtggcctaaataaagataaagcttaagtatcttaacaagcacctaacccttctccccagcctcggtgatttggctcatcgctgccttcatgtttcattctggcttcactcattcggaatttcttgtagttccttggctgttctcttttccttaccgcctttacaaatgctctcaccatgcatgcttttctctgctcctacagatgccttctctcccagcaccgcctccagagtctatgtctggtcgattctgtctgctgtctccagtccccatcttgtggcagtctctgctcaatcatttggggattttatatgttttctggcctttcttttgggggcctgtcttctccttctaaaagcagccagttgacctagaaggaagggataactgtaactcttgtctaccaacataagattaggcccaccctttaaaagctgcgtctttgaaagggacacctgcacccagcatgctggcttctcttcaccaagcgtgacttcctacgcatttcacaggcctccagaggtccccctgactctcttctgctgtgagaaactctaatcatgtaagccacaggctaattcccttgagccttaaatgtttttagtaatttcccattcatcagagaagcaggatttgggaggaattttgaagcaaacactacagaaggcagagtctccaggtaggatatctaagagacatttggaatggtctgactgttcaagatggatgggaaagcctcttcctgtaatgatagtagccaacatttgttgtcaggcagtggggccccatttttgagatggggtctctgtcacccaggttggagtgcggtggtgctgtcatggctcactgcaacctcagcctccccgggctgggtcttcttaattctgaaaaacccagcttttaaagggtggacctaatcttatgttggtagacaatgttgtctcatttaatacaatgcacatgctctccccataacacaaaagagggaactgaggcctggaggtgtgatgtaccccaagtcacatagctaataaataaagaagccagcattcctgggattaaaaatgcatgtgtctgtcactgtggtgtatttggtgcttgatcaatgtttacttgagcaaatggaggggcagaggtaccgatgagtgtgctcagtgaggagggcaggagtgaagctgggcgtcttcccgcctcttgtgagtggtggggcttggtgagcttgccagggcctgtctttcttatcaaagaaggtgtgtgccccagtgttacagcatttcacccaaagcagcctagaaaatgcttgacttttctgtcattccggggaggacactttcctcctccactgttctgctggcctggtgtacccacggcccctgatagatgatagcacctgctaaagtgcaccatgcccttccgtctcactgcatcccacagatgaggccaggctgggatgagggagaaagggagggatatatagttcaggttattttggaaaactgcctgaccaattttaagtctgggccggacactggggcatctcaccacgttgaaagggccgtggcaccccgggcggtgaaaggggctggaaccaggtctgcttcttgggcttctcctccagggtgccattgctcatgggccttggctgcagaggtgctcattcgtggttccaaaattccaattcctgggagaggaaaaatgcttagttcagtctcagttaggcctctgcttagatcaaacagccaaggccagtaggcccagtcctatggtagagacatggcctcaaagagccctctgctgcagttgttggggagtgtaccaagagaagggagcattgtcctgggctgggcagccctgggggtctagtgcatagatgtagaaaggctctgttggtatacctccctttgcttgttggaaagtgctcaacggggctgaattgtgtttgacagtgtaagtctgggctggggtgagggttgttacaagattgtcaagatgattaaatgaaatgccatttgaaacacttatccatgccttgtgtatggtatccccaccagtgaatattcacagtatattataataattccaacaacttcataattttcatatgcaatttctaaactttgaacttttttttttttttttttttttttgagacagtgtctcgctctgttgcccaggctggagtgcagtggcgcaatcttggctcactgcaacctccacctcccggcttcaagtgattctcctgcctcagcctcctgagtagctaggaatccaggcgcccgccaccacacccagctaatttttgtatttttagtagagacgggctttcgccatgttggccaggctggtctcaaactcctgacctgaggtgatccaccgccttggccttccaaagtgctaggattacatacgtgagccactgtgcccggcaattttttgtgtttttagtagagatggggtttcaccatgttggccaggctggtctcgaactcctgacctcaagtgatctgcccgcctcagcctccctaatgctgggattacaggtgtgagccaccacgcccagcctaaactttgaatttctttgaacccatgacttacacagaattagctgaacgcagaattccaaatcaactcagcctgtgggacagccaaaaaacacagtgtgcctttgggctccttcactcaccacgcggggttagaaaactttgtcagaggctttaaaaaaggagctcttgtgtgtaaaatgtttccttgattctctttctggtgcctctctttctctaagtggtttgcttccccaagttccccacctgagtctgggtggctgtggcacatctgtgcattctgtacgcacacaggcagccttttggagtgccagtttccaggtcttggttttatttatttatttatttatttttttgagatgggggtctcactctgccgcccaggctggagtgcagtggtgccgtcatggctcactgcaacctcaacctccctgggatcagttgagcctcctacctcagcctccagagtactagggaccaccatgcctggcaaatttttgtaattttttgtagaggcagagtctcaccatgttgctcaggctggtctcgagctcctagactcaagtgatctgcccaccttggcctcccaagtgttaggattacaagtgtgagccaccatgcccagcccaggtcatcttttgagggcatggagagaagactttgagcatcccacttttgagattgtgtaccagtcgcaagcccctatgacacactttttccccaaagtagagggctctgactatgttgatcccaagagagatgggaaagagcattgaatgaggattccaaagtattgggccttagttcgtttcctcatgttggtgttgtgaagattctggttaggataacagcatgtgtgcaggaggctttgtgaactgctgagagtgaggcgtggcaatgtcagtgctaggtttgtccttactaacctggggccatgggaattgataagaccagattcccaactctaccccacaatgtgatccctgtggtgacccctcacagggctctttggtcgagcttcccagaagggatcaccatctgccattgtatgttgaaccccattcattcattcattcattcagccaaccagcaactatttgttgagctcttattgtgtgagaagcagtcttcaaggaactgggtgaataaaaaaaacaaaacatcctaaccttcattgagcttacattcttactgaaagaaaacaaataaaacatacatgtaatcctagcactttgggaggccaaggcaggcggatcacttgaggtcaggaatttgaaaccagcctggccaacgtgaaacccatctctactgaaaattaaaaaaaaaaaaaaaaaaaagccgggcatggtggcacatgcctgtaatcccagctactcgcgaggctaaggcaggagaatcgcttgaatcctggaggcagaggttgcagtgagccaagatcataccattatactccagcctcagtgatgaagcaagactccatctcaaaaataaaaaataaaaataaaaatatgcattccctttgcaccagcacacttggtgcctggggacctcgtggttggcaccctgaagcaggtgtccctcttctgtcttgcacaccttgcttctgtcctggtgtgtatggcatggccttctgccctccatggtgagcactgtgagggcagaggttgagttgggtttgctgtatttctcaggtgcctaggtttgtgcttgacaggtagatggaaggcacacaatgtggtcatcaaacctcagtcaaccatataaggaaggtagaagtgaaaagtcccataggtacccaactaatgtcaccagtttcctggatacctttcctggagtttatttatagtgtgtataaataaatgatgtatgtgtttaaatgcctttttcacctttccttttagagctgcctctttttaacagttccattccattgtatggatgtactatgatttattgaaccagttccctactgattattctgttttttgcagtcttttgttatgatgaacattccacagtgacaatgttgttcatagtcattcacacacatgcaagtccttctgcaggatatatttctagaggggaattgctgactcagaggttttggtactctgtgttgattgtagagtgacggcagaaaagtgaggcccaagagtttcctagtgaccatgtgtagtggacaagtcaccagtccctgtgagtgtttggcccaaaggctttaaggcatttgatatcactgtttttgtttctgcaccaggcgggagacactatattcaatcgtgctaagctcctcaatgttggctttcaagaagccttgaaggactatgactacacctgctttgtgtttagtgacgtggacctcattccaatgaatgaccataatgcgtacaggtgtttttcacagccacggcacatttccgttgcaatggataagtttggattcaggtaagagatactcagtcagaatctgtggtaaacatgtctctctcatgtgttgactaggaaatgcagtcctggcagctcaagagtgcctctttaagctctggagcagaatgcctcctctgagaaatgggtgctttgtattagttgagatggaaagaagagaccagaaatgcctgtagtctctgcacatccagacaaaaacaaattttccccccttttttttttttgtttgttttttgagacagggtctggctctgtcacccaggctggagtgcagtgccgtgatcttggctcaccgcaacctctgcctcccgggttcatgccatcctgtcacctcagcctcctgagtagctgggactacaaacacttgccaccatgcgcagctaatttttgtatattttgtagagatggggttttgctgtattgcccagtctggtctcgaactcctgagctcaagcaatccatctgccttggcctctcgaagtgctggattataggcatgtggcaccatgcctggcctaagaacagtttttagcatttgggaggggctctcatctttaagctccaaatgatactgtattttcttgcttttttctttctcttgccccacaagttttggaaagtaaattggaatagttttcccccactgaattatttagcttgtatacctcagcagatgttccttggcctgttttgttttgtttttgagacagggtcttgctctgtcacccaggctggagtgcagtgacacaatcatggctcactgcagccttgactgcctgggctcaatccatcctgcagcctcagcctcctgagtagttgggactacaggcatgagccagcatgtccagctaattttttatttttagtggagatgaggtctggctatgttgcccaagctgggcttgaactcttgggctcaagtgatcctctcacctcagccttccaaagcattgggattacaggtgtgaaccactgctcccgcccttggccctataagaaggaatgtgattctgttttccagcagggcacaaacttctgcttaaatacaaagcccaaatttttccaccaaaatgcccctagtgaagtggccagcccagatgcccgactagcgtattatccaaagcatattgtcattggtggaaaatggccttatagtccattgttttgtcttaaaagtaaatatataaataaacttgtatattgtttcctaattccgtgtttatattaacataaaagtgttttaaattacctgtcagtggccaggtgcagtggctcgtgcctgtaatcgcagcactttgggaggccgaggcgggcagatcacctgaggtcaggagttcgagaccagcctgaccagcatggtgaaaccctgtctctactaaaaatacaaaaattagccaggtgtggtggcaggtgcctgtaatcccagctactcgggaagctgaggcaggagaattgcttgaacccgggaggcagaggttgcagtgagttgagatcgcgccattgaacttcaacttgggcaacagagcaagactctgtctcagagaaagaaaaaaaaaaacctatcagttgaataacaaaaccctttccttccttgctttaagtgaatctgaagatccaggagctgtgctgcaggtaccctctatgttgggtacccctggtttaggctgactagtacagtgtggttggctcatgtagacagcagaccctttattttagatacaactttttttctttttcttttattttttttgagacagagtcttgcttgtcacccagcctggagtgcagtggcgtgatcatggctcactatagccttaaactccctggctcaagtgatcctctcacctcggctttcctagtagctgggaccacaggtgtgggccagcacccctggctgatttaaaaaaaaaaaaatttttttttttagagatgtctcactatgttacccaggctggtcttgaactcctgggggctcaagcaatcctcctgctttgacctcccaaagtgctgggatgacaggcatgaactactgcacctgctgagatgcaacagctttctgtcagactcattttattctcatcatttcttcctgtcctcccttgctgggagcatgagagctgtgatgggaatataggaatgtatgaagtccttctcccagatcaaaaatcctaacttcttgtcttaaagggaggaaaatttgaatgtaaccttacttttagactcttcagaaatccttctatacccttccgtccccgctttcacccttcctccctctccgtgtgtgtatcttcttctcttgaaacacacaggtttataccctgacccctcttgattcatcccttgaagcacagtggtgaacaaggaaggggcccgtgatgccctaattctttgccacagcaccatgtttgtttcacaaggagcctggcaggtttgggcttggggcagataggggagagaaagcagcagagacagcaaaaccaaatcatgtcagcttggcatgtacttccctctgaaatagctaagaatccatttctgtaaaagcactgattatcagaaaaccttattggcctggccacctttggttcaaaccctcacattaataatgtggacagtagtatgaggtgtgccaaaggtggatgactcagcacctaagtgatgacacctaattacgaataggttcattaaagcagaccccctggggacctttgcttgaggatccttacagtcagaattcctgaatatatttgaaaataataattgcatctttattttcatatgttctgtatggtttggctgacttccccctcaaagtctgagttagagttttccttaatttatgtgatgggtttggtctttttggattccagaaagagctgggtgtggtttggagctgcactcagagtcacacaaaaccacagcctttagagaacccacaggaaggctttggggcacgtcctgattcttgacatttctcatcagtgctgactttgtatcccttaggagttcacaattcataaccactgaaatattaaaatacaaaaagttttggaaggatgagagcccagatgctctactacttgaaaatatgttaaaacataagttcatcattatacattttgctaaatcaggataaagtctgaagtttcaaagaagttttattttagcaaattttcagaaacactgcctcaactgttagggccagtgttctagtcagtatgcctttggaagcatgaaagctggattggtcgataggatgggtgtggaaggggggctgtgactgggtgggtacagagaggctctgaaacaatctcagattccaggagttcctggataaggacttcatgtgcgggaacagagcacaggagaagcagattcctgagccactcaggaagaactgggcctaggcctgctcttgtcactgactggctttctacataaccacagaaacagcactgtgttgtagaaagaggaagatcatactttttgatatctgtgtctaatttaaggtcatctgagccctgatagaaaagcaaaacagacaaaacccttgtaactgctccctcccaccccacccaccatcaaaaaagctttagagaggctggacatggtggctcttgcctgtgatcccagcactttgggaggctaaggtgggtggatcacctgaggtcaggagttcgagaccagcctgaccaatatggtgaaaccccatctgtactaaaaatacaaaaattagccaggtgtggtggcacacgcctgtagtcccagctacttgggaggctgagacaggagaattacttgaaaacctgggaggcggaggttgcagtgagccgagatcacgccattgtactccagcctgggctacagagcgagactccttcaaaaaaaaaaaaaaaaaaagatccggtttggtgtcttacaactgtaatcccagcactttgggaggccgaggccggtggatcacgaggttaagagatcaagaccatcctgaccaacatggtgaaaccctgtctctactaaaaattagctgggcgtggtggcaggcgcctgtagtcccagctcctcaggaggctgaggcagaagaatcgcttgaacccgggaggcggaagttgcagtgagcctagatcgcgcccctgcactccagcctggcaacagagcaagactacgtctcaaaaaaaaaataaataaaaactctagagaagcaaaaagaataactttaaaagtgtttatgttctcagcaagctttattttggggatgtcagaacttaactaaccactgctccttctgtgtgtatgtttttcctccagcctaccttatgttcagtattttggaggtgtctctgctctaagtaaacaacagtttctaaccatcaatggatttcctaataattattggggctggggaggagaagatgatgacatttttaacaggtaatggtcataacttagatatctttctcctctgtcaaccttcacttccagttttttaaccaatgcttggttgttccccaaggactgaccctcagatgggatgcacccctagtcagcccacattcttaggtgtggcttcctacaggtcctgcaggtgctaaaagggatctgtaggaaaatgagtttctgagatttttgtattggcctggaaaaatgtcaaatgggaaccaagtgacggggcaagtttactttgacttgctgcatgccgttttgtactcaaggagtaaaccaatgtcctttgtaaaaatccctcctttcattatggtcccctttcactgtgaaacaagtttccttgagcagaatcctaactgtcttcacagaagctttgtgttatatttttattttggagtattttcacatatacaaaagagatactgtagtataataaacctttgaggacctatccagccccagcaaccattatggcctggtcagttctgtcccatccacatcctggggctctttttaagctggtaaatcattatgatgtgggttgtcatttacagtggtaaaaaacatctatcagtagcatttgaaagaacattctgctcagtcctctggctgtagaggcttcaaccccaccagccaccgatgagcaccttctccctccaggagccagtctgagctcattactgagtttaatatcagaatacaccctggtgcagcctttctaaattgcagtaccagttaacagaaggtgtctgtcagagcaacacccaagtcattcaagttaccattgtgtgcaaacttaacagagacccacgtcttcaatataagccttgaaggaaactccagttttagtatgtagatggggtatcaagtgtgtgcacattgaacatctgctgcatacagagcactgtgccaggcaggcccaggacactgaaaacctggacatagggtccagacagaagcaagcctgcttccacagaggcactcctgggcagacactctggactgatatgacagtgtgcagggccgacaggataccacaggtctgaatggtcagaacagctggggagggagggagcatccgcaggcatctagtcccatgctaacgcagtggcactagaaggatgggtggtgtgtggagcaactttcttgaaagataaaggacctaacactttctatgcaccacttactgtgtgccaggcaaggccaggaatgtttaagtggtctgggatcagccagttctgcctcttaactaactttgctgtcctgctctccaggctttcattttggtcctcattccttttccttggaccaacacagaatcctccaccctgttctggctgcctctagtcttgttctcagccctccatttgtttttttctgccttttcccacatgttctgaagccctccattcgtatactactttccagagacttccccatggctaaaagcattttggaaatactgtatattaggcccctttcagatactggcaaccgtttgtgggatgctctgagaaggcctctgtgacttagcctggcccttttcagcccatcacctgccacgtcctaccccagacccttgtcaccagtccccaggagcttacgttgctccctgagggcactaggcttgctctcacttccatgcctttgcctgtgccatcctggctgcccaaaatgctatggcagatacctgttcatcctcaactgggctctgcctaggcttgctccagcagaggttacaaactctatgcttcttcctctgtgtctccaacctcatcttcctcttctcacctccatcctggccctaaaggccctatgtttgaagcattcacactgtatattctgtggggcacacggccccagtgtctggcacatggtagtcaacaccacaaaccgcagaaccagttgtaaaaggacatggagtcggaatgtgagttttaaccagggtcatgctgggctgggttctggcatgatgctgggttgtgggctgagtgagaacagcaagggtgatggtggatggagcaacagtcttgcagccggggctctcaggccaagtgtatggcagctctgtgataatgactttccctttactctttgcagattagtttttagaggcatgtctatatctcgcccaaatgctgtggtcgggaggtgtcgcatgatccgccactcaagagacaagaaaaatgaacccaatcctcagaggtgcattctttgtttattcatactccttccccctttaggatgaggtaggctgcaggtccgaggctctgggcctagagggaaattgaggtggtcaggttacagtggagagggaggaggaagtacgtgtgatgatttcttcttaagatttttgttttaagacaatctccttgtgctcttttccttgtaggtttgaccgaattgcacacacaaaggagacaatgctctctgatggtttgaactcactcacctaccaggtgctggatgtacagagatacccattgtatacccaaatcacagtggacatcgggacaccgagctagcgttttggtacacggataagagacctgaaattagccagggacctctgctgtgtgtctctgccaatctgctgggctggtccctctcatttttaccagtctgagtgacaggtccccttcgctcatcattcagatggctttccagatgaccaggacgagtgggatattttgcccccaacttggctcggcatgtgaattcttagctctgcaaggtgtttatgcctttgcgggtttcttgatgtgttcgcagtgtcaccccagagtcagaactgtacacatcccaaaatttggtggccgtggaacacattcccggtgatagaattgctaaattgtcgtgaaataggttagaatttttctttaaattatggttttcttattcgtgaaaattcggagagtgctgctaaaattggattggtgtgatctttttggtagttgtaatttaacagaaaaacacaaaatttcaaccattcttaatgttacgtcctccccccacccccttctttcagtggtatgcaaccactgcaatcactgtgcatatgtcttttcttagcaaaaggattttaaaacttgagccctggaccttttgtcctatgtgtgtggattccagggcaactctagcatcagagcaaaagccttgggtttctcgcattcagtggcctatctccagattgtctgatttctgaatgtaaagttgttgtgtttttttttaaatagtagtttgtagtattttaaagaaagaacagatcgagttctaattatgatctagcttgattttgtgttgatccaaatttgcatagctgtttaatgttaagtcatgacaatttatttttcttggcatgctatgtaaacttgaatttcctatgtatttttattgtggtgttttaaatatggggaggggtattgagcattttttagggagaaaaataaatatatgctgtagtggccacaaataggcctatgatttagctggcaggccaggttttctcaagagcaaaatcaccctctggccccttggcaggtaaggcctcccggtcagcattatcctgccagacctcggggaggatacctgggagacagaagcctctgcacctactgtgcagaactctccacttccccaaccctccccaggtgggcagggcggagggagcctcagcctccttagactgacccctcaggcccctaggctggggggttgtaaataacagcagtcaggttgtttaccagccctttgcacctccccaggcagagggagcctctgttctggtgggggccacctccctcagaggctctgctagccacactccgtggcccaccctttgttaccagttcttcctccttcctcttttcccctgcctttctcattccttccttcgtctccctttttgttcctttgcctcttgcctgtcccctaaaacttgactgtggcactcagggtcaaacagactatccattccccagcatgaatgtgccttttaattagtgatctagaaagaagttcagccgaacccacaccccaactccctcccaagaacttcggtgcctaaagcctcctgttccacctcaggttttcacaggtgctcccaccccagttgaggctcccacccacagggctgtctgtcacaaacccacctctgttgggagctattgagccacctgggatgagatgacacaaggcactcctaccactgagcgcctttgccaggtccagcctgggctcaggttccaagactcagctgcctaatcccagggttgagccttgtgctcgtggcggaccccaaaccactgccctcctgggtaccagccctcagtgtggaggctgagctggtgcctggccccagtcttatctgtgcctttactgctttgcgcatctcagatgctaacttggttctttttccagaagcctttgtattggttaaaaattattttccattgcagaagcagctggactatgcaaaaagtatttctctgtcagttccccactctataccaaggatattattaaaactagaaatgactgcattgagagggagttgtgggaaataagaagaatgaaagcctctctttctgtccgcagatcctgacttttccaaagtgccttaaaagaaatcagacaaatgccctgagtggtaacttctgtgttattttactcttaaaaccaaactctaccttttcttgttgttttttttttttttttttttttttttttggttaccttctcattcatgtcaagtatgtggttcattcttagaaccaagggaaatactgctccccccatttgctgacgtagtgctctcatgggctcacctgggcccaaggcacagccagggcacagttaggcctggatgtttgcctggtccgtgagatgccgcgggtcctgtttccttactggggatttcagggctgggggttcagggagcatttccttttcctgggagttatgaccgcgaagttgtcatgtgccgtgcccttttctgtttctgtgtatcctattgctggtgactctgtgtgaactggcctttgggaaagatcagagagggcagaggtggcacaggacagtaaaggagatgctgtgctggccttcagcctggacagggtctctgctgactgccaggggcgggggctctgcatagccaggatgacggctttcatgtcccagagacctgttgtgctgtgtattttgatttcctgtgtatgcaaatgtgtgtatttaccattgtgtagggggctgtgtctgatcttggtgttcaaaacagaactgtatttttgcctttaaaattaaataatataacgtgaataaatgaccctatctttgt

SEQ ID NO: 36005 - DNA, 6673 bp, Homo sapiens
aatataagtggaggcgtcgcgctggcgggcattcctgaagctgacagcattcgggccgagatgtctcgctccgtggccttagctgtgctcgcgctactctctctttctggcctggaggctatccagcgtgagtctctcctaccctcccgctctggtccttcctctcccgctctgcaccctctgtggccctcgctgtgctctctcgctccgtgacttcccttctccaagttctccttggtggcccgccgtggggctagtccagggctggatctcggggaagcggcggggtggcctgggagtggggaagggggtgcgcacccgggacgcgcgctacttgcccctttcggcggggagcaggggagacctttggcctacggcgacgggagggtcgggacaaagtttagggcgtcgataagcgtcagagcgccgaggttgggggagggtttctcttccgctctttcgcggggcctctggctcccccagcgcagctggagtgggggacgggtaggctcgtcccaaaggcgcggcgctgaggtttgtgaacgcgtggaggggcgcttggggtctgggggaggcgtcgcccgggtaagcctgtctgctgcggctctgcttcccttagactggagagctgtggacttcgtctaggcgcccgctaagttcgcatgtcctagcacctctgggtctatgtggggccacaccgtggggaggaaacagcacgcgacgtttgtagaatgcttggctgtgatacaaagcggtttcgaataattaacttatttgttcccatcacatgtcacttttaaaaaattataagaactacccgttattgacatctttctgtgtgccaaggactttatgtgctttgcgtcatttaattttgaaaacagttatcttccgccatagataactactatggttatcttctgcctctcacagatgaagaaactaaggcaccgagattttaagaaacttaattacacaggggataaatggcagcaatcgagattgaagtcaagcctaaccagggcttttgcgggagcgcatgccttttggctgtaattcgtgcatttttttttaagaaaaacgcctgccttctgcgtgagattctccagagcaaactgggcggcatgggccctgtggtcttttcgtacagagggcttcctctttggctctttgcctggttgtttccaagatgtactgtgcctcttactttcggttttgaaaacatgagggggttgggcgtggtagcttacgcctgtaatcccagcacttagggaggccgaggcgggaggatggcttgaggtccgtagttgagaccagcctggccaacatggtgaagcctggtctctacaaaaaataataacaaaaattagccgggtgtggtggctcgtgcctgtggtcccagctgctccggtggctgaggcgggaggatctcttgagcttaggcttttgagctatcatggcgccagtgcactccagcgtgggcaacagagcgagaccctgtctctcaaaaaagaaaaaaaaaaaaaaagaaagagaaaagaaaagaaagaaagaagtgaaggtttgtcagtcaggggagctgtaaaaccattaataaagataatccaagatggttaccaagactgttgaggacgccagagatcttgagcactttctaagtacctggcaatacactaagcgcgctcaccttttcctctggcaaaacatgatcgaaagcagaatgttttgatcatgagaaaattgcatttaatttgaatacaatttatttacaacataaaggataatgtatatatcaccaccattactggtatttgctggttatgttagatgtcattttaaaaaataacaatctgatatttaaaaaaaaatcttattttgaaaatttccaaagtaatacatgccatgcatagaccatttctggaagataccacaagaaacatgtaatgatgattgcctctgaaggtctattttcctcctctgacctgtgtgtgggttttgtttttgttttactgtgggcataaattaatttttcagttaagttttggaagcttaaataactctccaaaagtcataaagccagtaactggttgagcccaaattcaaacccagcctgtctgatacttgtcctcttcttagaaaagattacagtgatgctctcacaaaatcttgccgccttccctcaaacagagagttccaggcaggatgaatctgtgctctgatccctgaggcatttaatatgttcttattattagaagctcagatgcaaagagctctcttagcttttaatgttatgaaaaaaatcaggtcttcattagattccccaatccacctcttgatggggctagtagcctttccttaatgatagggtgtttctagagagatatatctggtcaaggtggcctggtactcctccttctccccacagcctcccagacaaggaggagtagctgccttttagtgatcatgtaccctgaatataagtgtatttaaaagaattttatacacatatatttagtgtcaatctgtatatttagtagcactaacacttctcttcattttcaatgaaaaatatagagtttataatattttcttcccacttccccatggatggtctagtcatgcctctcattttggaaagtactgtttctgaaacattaggcaatatattcccaacctggctagtttacagcaatcacctgtggatgctaattaaaacgcaaatcccactgtcacatgcattactccatttgatcataatggaaagtatgttctgtcccatttgccatagtcctcacctatccctgttgtattttatcgggtccaactcaaccatttaaggtatttgccagctcttgtatgcatttaggttttgtttctttgttttttagctcatgaaattaggtacaaagtcagagaggggtctggcatataaaacctcagcagaaataaagaggttttgttgtttggtaagaacataccttgggttggttgggcacggtggctcgtgcctgtaatcccaacactttgggaggccaaggcaggctgatcacttgaagttgggagttcaagaccagcctggccaacatggtgaaatcccgtctctactgaaaatacaaaaattaaccaggcatggtggtgtgtgcctgtagtcccaggaatcacttgaacccaggaggcggaggttgcagtgagctgagatctcaccactgcacactgcactccagcctgggcaatggaatgagattccatcccaaaaaataaaaaaataaaaaaataaagaacataccttgggttgatccacttaggaacctcagataataacatctgccacgtatagagcaattgctatgtcccaggcactctactagacacttcatacagtttagaaaatcagatgggtgtagatcaaggcaggagcaggaaccaaaaagaaaggcataaacataagaaaaaaaatggaaggggtggaaacagagtacaataacatgagtaatttgatgggggctattatgaactgagaaatgaactttgaaaagtatcttggggccaaatcatgtagactcttgagtgatgtgttaaggaatgctatgagtgctgagagggcatcagaagtccttgagagcctccagagaaaggctcttaaaaatgcagcgcaatctccagtgacagaagatactgctagaaatctgctagaaaaaaaacaaaaaaggcatgtatagaggaattatgagggaaagataccaagtcacggtttattcttcaaaatggaggtggcttgttgggaaggtggaagctcatttggccagagtggaaatggaattgggagaaatcgatgaccaaatgtaaacacttggtgcctgatatagcttgacaccaagttagccccaagtgaaataccctggcaatattaatgtgtcttttcccgatattcctcaggtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtggggtaagtcttacattcttttgtaagctgctgaaagttgtgtatgagtagtcatatcataaagctgctttgatataaaaaaggtctatggccatactaccctgaatgagtcccatcccatctgatataaacaatctgcatattgggattgtcagggaatgttcttaaagatcagattagtggcacctgctgagatactgatgcacagcatggtttctgaaccagtagtttccctgcagttgagcagggagcagcagcagcacttgcacaaatacatatacactcttaacacttcttacctactggcttcctctagcttttgtggcagcttcaggtatatttagcactgaacgaacatctcaagaaggtataggcctttgtttgtaagtcctgctgtcctagcatcctataatcctggacttctccagtactttctggctggattggtatctgaggctagtaggaagggcttgttcctgctgggtagctctaaacaatgtattcatgggtaggaacagcagcctattctgccagccttatttctaaccattttagacatttgttagtacatggtattttaaaagtaaaacttaatgtcttccttttttttctccactgtctttttcatagatcgagacatgtaagcagcatcatggaggtaagtttttgaccttgagaaaatgtttttgtttcactgtcctgaggactatttatagacagctctaacatgataaccctcactatgtggagaacattgacagagtaacattttagcagggaaagaagaatcctacagggtcatgttcccttctcctgtggagtggcatgaagaaggtgtatggccccaggtatggccatattactgaccctctacagagagggcaaaggaactgccagtatggtattgcaggataaaggcaggtggttacccacattacctgcaaggctttgatctttcttctgccatttccacattggacatctctgctgaggagagaaaatgaaccactcttttcctttgtataatgttgttttattcttcagacagaagagaggagttatacagctctgcagacatcccattcctgtatggggactgtgtttgcctcttagaggttcccaggccactagaggagataaagggaaacagattgttataacttgatataatgatactataatagatgtaactacaaggagctccagaagcaagagagagggaggaacttggacttctctgcatctttagttggagtccaaaggcttttcaatgaaattctactgcccagggtacattgatgctgaaaccccattcaaatctcctgttatattctagaacagggaattgatttgggagagcatcaggaaggtggatgatctgcccagtcacactgttagtaaattgtagagccaggacctgaactctaatatagtcatgtgttacttaatgacggggacatgttctgagaaatgcttacacaaacctaggtgttgtagcctactacacgcataggctacatggtatagcctattgctcctagactacaaacctgtacagcctgttactgtactgaatactgtgggcagttgtaacacaatggtaagtatttgtgtatctaaacatagaagttgcagtaaaaatatgctattttaatcttatgagaccactgtcatatatacagtccatcattgaccaaaacatcatatcagcattttttcttctaagattttgggagcaccaaagggatacactaacaggatatactctttataatgggtttggagaactgtctgcagctacttcttttaaaaaggtgatctacacagtagaaattagacaagtttggtaatgagatctgcaatccaaataaaataaattcattgctaacctttttcttttcttttcaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctctta

SEQ ID NO: 36006 - DNA, 169118 bp, Homo sapiens
cagcgggcggccatgttggagcagcggaggcggcgcagaggcgcgtcttgggtccccgcggcggcgccggtaggttggagccgcgggcctagccgcgccgcggaggggcggcccgcgaggcggcagggcggacgggcaagcggccaactcttcccggacccgcgtcctccgccggcctggccgagaccccccaccccacccccaccccgcgcccagcgaccccaccctggggctgtgcggtcccggtagggctagcaccgttcaccctgtacatttcgctgcctcagtgacccccgcctcacggcttgggccctaaggacgtgcattcccagcctgagggccccgatctgccccctcccccggtctgcctgtgtggcgcctctctcacgccctatcttccgtcaacttctcctgccttccccgggggcacgtgtgaagggaagtcggaggccgggcaggagcctctgtttccgaagcttctcgaaagcccagaaaacccctcccaagagcccagcctaacctgggtggaagagcccccaggtcaccccaaatatttgcgctggggcgcgtgtgagggtgggaaataggtccctctctcttctacagttcacagctctgggaactacatcccttcaaaaaacattaataaagaactaaagtcatgtgcaaggattgtgcttggagaacggtctctggggaggggaagtgcccaagacacctgaggatccaagaatgtttccaaacaaagagccctagggcatttcctccagggtattctgaagacttcatctgctgcattagagcggtgggaagaaactacacagacgggcctcatggcccgagggacctgcctgatcctggctgatcttttaatgctctggtgcagctggggagctgcctcttgcttctgggaaccctcagtgttgggttgggtattagatgttagttatgattgatgtccacagcttctttaaagaagtctgggagtagttaggtgttctcagtcacctccatctgggctgtactgaggtctgtggccctccaagtcttaggtaggacagtgcataccgctaatgtccccttgactcaccatcctacttgcagcctttggctcccattgtccttaaactttgggatcttggtctggcttcctggtccctggtctgcctggttgcctagagagatgtcattggcacctgctactcatcagctttttagtttctgttgaagaaaagtccgactcttgattaggtctccatgcctctggagctagaaaatgggttgctgagtaccctgtctagagactgaaaacagaacttctggtgggcagggagattcccccaccccactccagctccacacatgaacagcagcagctggagaaacagatgggcatggacagtgggtgtaagtctgggccctttggctaacattcagggttctttgttgctctatcctcgcctgttttttcacctagatcccagatcccacaccaagtatgccttaaccctttctcactttggagccattgcattagctattcccctttttgttccatttccatctaatcatttttcattcatcactcatatcctagctaggtgttgtctctcccaggaatcctttcctgacccattggcaaactgagctgaatgccagcattcactcccaagaatcttaacagtgtctttttctggccttctaacctaggttccttgaggacagggatattgcctgtattcccagagctgagtaattctaggtttctggcttcagaaaatacagagttgaattaaaatgtaccaggctcaaatcttttcagggacccggcagcaggttggatggctctgaggtatttctgagcatgtatcttgaagaaactccctgatccttagcctctcctcccaccccagcatggtagagggtcaggagaccagggttttacaccaggaagtgtctcactctggccagattcctcagtgtcatggagattggggcactgattgacttgtctatgtgttctggccccttgtcttagtgccattcttattgactcttttcctcttgtcttggaggtgccaagcgctggtttgcggatacccaggcagatctgcagtgcctaatgccatgagtgtggtggttcagcatgtggaggaaaaagctgtgcactcctggtcgcgcatctccacggcagggaagaaggccctggaagaggcactgcttgtctttaacccaatgagccaggatctcagtgccacagaggcccagcttgtggccttcctgcagggcctgcgagatgatggcttccaacctaccatcctgcgcagtggtgatgtctatggctatagttcatgcacagctaatcccccaagccagacgaaactgcaagctcgtgcccctaacccaactgccacatcacctccagccagtgctccccgaactgccatgcggttgcctgcaggtcgggccacactgcttcccatgccgctatctggcagactggccaaagcatccacaccagcccttgccaagcatgctaccaccaacctgctgctgagctctctgaagcaatcaagtgccagccatgcccggggtgcagcagtgggcttccccacccacctttatccaggtgtctaccctgccatgcggctctctgttgtccttgaggccctggttccacttaagactcccatgccctgcttgggtgccaagcacaaggcacagtcactgcagctctcacttgcagactctcctctgaaactgcggaaaagttcagggaagggtccggggaaccctcggcccaaagctcccagaaaaaccacaagcaagggccccaagtgtctgactcgcaaaggccctggggctggaccccgacgaggctctgggcaccagagcaaaaccaacagagccactgggtcccccagtgtccggcgaatgaaagggggctctgccctgggcaccaaaacagcccaggccaaggtagctcgaacactggccaaagctgctcgtgcccaagccaaggtggctcgaacacaggccaaggctgctaaggcccgggccaaggccaaggcagcacaggtcaaggctaaggccaaagctaaggcagcacaggtcaaggccaaggccaaagtcatggcagcatgggccaaggccaaggctaaagccaaggcagtacgggccaaggccaaggtggctcggacccagcccaggggcagaggcaggccaaagggatctgctaaggccagaactacaaggaagggccagaaaaaccgccctgagactgttgggcagaagaggaaaagggctgaggaggcaaaagatcttcctcccaagaagagaacacggcttgggccccgatctcctaaggcatggctagggcctggaacagcaaagctgctgaagttccgtgccataaaggtagataggcggtcctcggatgatgaggtgcggcagcgggctcagcggatcctccgcgtgaacctgtcacctgtaatacggctccagccattgctgccatattcagcagtctgattccttcacacggcaatgtttggggaaactaagcccagctgtctgtgtggctagtggcacagtgtgctatgtccgtggactccacaatcttgaggactcccggtgcctctctagggccctggtgaccaccagcctcctttcagaaaccagagtgggtggggtacggtggggtgggtgggcgggaggggtgttttcatggcgcgatgcactgtgacttgttattcaagttgtatgtctactgttccatctatcacgttttatacctttccaccttccagtctccctgcccaccctccatggtcttctgtgtgtgtgtggctgctggcaggccagcttgaagatatagggaaagtggtcccagaaataggcctgcctatttccgggggttgtgggaggaggcagctcctgggcccctttggagagatgaggggaaattggcttctgtggttgtctgagaggcatcccctgaatgcagaagcagagccactgtgaagtaagacacttccctttgaggctgctctggtttgtgatccagacaggccccattcaggacagtaggccccatgcaggacagtaggttccatggggaaccttgcagctagtgggtttttaggtcctggaatggagcctttgtggtacttccctagggaccaaacagacagcctggctaaaatcttggggcttagcctgggcttttctggtgtgggtccaggcccaaaggggttgaggtgcttctccccactctgctctcgtggcagagagtaactatcctcaacttcgattggtggcaaggtactggtggttgagtcaggaccacagagcttgccctcagtgaccaaataattttctccttggttgggtgaggttttccatgactgcctcatcagcagtgctttctgtatgaatcttaagtgctctctctactcccaggtccagcctcatcatgccctccaacatggtccatatgttaaaatacattgtcacccttcctgctttagagagggggctgggccctgggacctgaaggaggtaactgtcctgcccatctgtagtccatcactggctgcccaggctgaatggcagtgcctggggttggcagggaggggcacacattccccctccctggggtaggggcatcatttcagtgagaatcagatgttttctgtttctgggtttgggccccacaagctgccagctgccctgggtggtggacctgtggagaagctctgtgcttcttggtgccctcctgccccttctgcatcttgtggcatgcttcccctgggtgtgtcctcccttggtttcccaagctctgggaccttgctcccagctgtgctgtcgccccactaccttacatgctacttgcctctgacaactctttcattcatgatgtgaatatggggaatgacctgagagccacactcagctcctcaagggcagcccagcttggggctcacgcctgtaatcccagcactttgggagtccaaggcaggtgggtcagttgaggtcaggagtttgagaccagcctggccaacatggtgaaatctcatctgtactaaaaatacaaaacagccaggtgtggtggcacacacctaaagtcccagctacttgggaggttgaggctggaagatcacttgaacctgggaagcagagtttgcagtgagccaagatctcgccactgcactccaggctgggcgacagagtgagactctgtctcaaaaaaaaaaaaaaaaaaaaaaaaaaagaaaagaaaaaaagaaatcaaggttccctgtggggtggggtggagaggggtgggtattcctaggatctctagtcagatgctgcccctcctagtccaggctcctagaacagtttcccagggagtgccagatatcccttcccgatctggctgcatcagcatcctggttgttggctggggccagagccagagccttcgaacttcatccagtaggccctgagccctacttcattggcagtcacctgcaggtgagggctctggaggctggtttctttgggtgtcctgggctggttcagccctgttgggggtctgggtcattgctgggagctagaggcatgtgctgtgaaattttggagtagagatctgatgattaacctctctagtcagtttccttgagtcctaacccaaaactcagaattgcccctgtctggccgggcgcggtggctcacgcctgtaatcccagcactttgggaggccgaggcgggcggatcacgaggtcaggagatcgagaccatcccggctaaaaaacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaattgcccctgtgactcttgcgaccagggaggccatgacattaagaacgtgatctcccagagtggccgtggtggcaacaagacctggtaggcagagagtggtgagggtgcagtgtgcctacgtgtggaggtacggggtcagggcctagtcactcactagccctatggctgcaggtgttgaaaatgtcaccatcagccgggcgcaatggctcatgcctgtaatcccagcactttgggaggctgaggcgggcggatcacaaggtcaggagatcgagaccaccctggctaacacggtgaaaccctgtctctactaaaaatacaaaaaattagctgggcgtggtggcggtcgcctgtagtcccagctactcaggaggctgaggcaggagaatggcgtgaaccagggaggcagagcttgcagtgagctgagatgacaccactgcactccagcctgggcgacagagcaagactccatctcaaaaaaaaaaaaagttaccatcaaggccgggcacagtcgctcatgcctgtaatcccagcactttgggaggccgaggcgggtggatcacgaggtcaggagatcgagaccaacctggctaatatggtgaaaccctgtctctactaaaaatacaaaaaattgtccgggtgtggtggctcacacctgtaatctcagcactttgggaggccgaggtgggtggatcacaaggtcaggaggtcgagaccatcctggctaacacagtgaaactctgtctctactaaaaatacaaaaaattagccaggcatggcggcgtgcgcctgcagtcccagctactcaggaggctgaggcaggaggatggcgtgaacccgggctgcggagcttgcagtgagccaagattgcgccactgcactccaccctgggcgacagagcgagactctgtctcaaaaaagaaaaatataaaaaattagccaggcgtgctggcacatacctgtagtcctagctacttgggaggctgaggcaggagaatcgcttgaacctgggaggtggaggttgcagtgaaccgagatcgtgccactgcactccagcctgggcaacagagcaagactccatctcaaaaaaaaaagaaaaaacatcactatccagctggacctagagggtgccttctacttcacccacctcaagactttcccagtgccccagcctgaaggcttgcttagcaagtgctgaccctgtgcttccctatttgatggccaccagtgatgcttgtccctagtgactccccagacattccacctagcagctgtgctccttgagcactcagtggaccatgccgctcctggcacatgtacagatactttgttcacaactgcccaagcctctttcttgggatccctcctacccctagccacagagtcagtgacctcgtctgtgaccagcattactcagacatcaagccttccactgagggcaaggtcaggcccagggaaaggggggttgggccctgaggtgaaataggatgctcaaacctgcttctttctcccaggtgattttcaaagttctggacccagccattccagtagaggatccaaacaaccctgagattcagggtaatcatccccagaggcaatcctgtaccatttgtgtgtcaggacagagcttgtagatactgggggaaacaggccctgccccgagtgggcaccggtgggacagggcaagtaggcaagctcagtcttccagggccgttccccagccctgccccatcatggtcctttttgtggcctcccatttataccccatcactgttccccatacttgtacccagtgtatagggactggcatggggaacaatttcaataatgactctgccccattattgaatccctttgtgaggccccatcatagttcctcatttcctcatacctgtcccccgtctctactatcactgcccctcataactcttccctttgtgggcccccatcactgcccctgtcatagtctacctgtcattgctcctccaactccattcatgaccctgacctttgccctttgtccctgcagctgcctctaggtggcaccagggcatctctggatgtaacaccttccttgtaaagaagtctttgttaaagactcctagtaggagagcccagaatcaggccaggagggtaccagagcaggacaaacgccaaactagttttttctctacacccaatgggcactccttgccccccttaactgcagttattaccagctgctcaccttgagccctcatggtaggtctgcaagctgctgttgtttttcacctcagatcagaaaagaggagaggcctgcagaggaaagatacaggaggtagcggacctcctgtatcttagtaatggacctaagatgtggagcagggagaggagccatggacccattcctttacctatgtattcatataacaagcacccattgagctgtacactctgtcaggcatcttctgggcagtgtttgatgggaagcagcagaaaaggtatctgccttcttggaacggacatcaagtcagaaagacagttgataaataacccatctgtgaccatgcattgtttaatgatggggatacattctgagaaatgtgtcattacgcagtttcatcgttgtggaaacatctagagtgtacttgtatagcctaccacacttctagactatctggtatagcctattactcctaggctacaaacctgtacagcatgtgactgtactgaaaactgtaggcagttttaacacaatggtatttgtgtatctaaacatagaaaagggacagtaaaaacatggtataaaagatgataaatggtacacctgtatagggcacttaccatgaatggcacttggagtgagtcagtgaggagtggtgagtgaatgtgaaggcctaggacattactgtacactactgtagattataaacactgtacacgggctatactaaatgtataaaaacaaattttttccttcttcaatagtaaccttagctttctgaactttttttactttacagacttttaactttttacagcttttataacacttagcttaaaacacatgtagagctgtacaaaaatatttcctttctatccgtatttgataagcttttctctgttaaaaattttttttttacattttaaacttttttgttaaaaactaagacactgccaggcgcggtggctcactcctgtaatcccagcactttgggaggcggaggtgggcggatcatgaggtcaggagattgagaccatcctggctaacacagtgaaacttcatctctactaaaaatacaaaaaaattagccaggcatggtggcctgcacctgttgtcctagctgctggggaggctgagacaggagaatggcgtgaacccaggaggcggagcttgcagtgagccaagatagtgccactgcactccagcctgggtgacagagcaagactccgtctcaaaaaaaataaaataaaaactaagacacagacatacacattagcctaggcctacatagggtgaggatcatcaatatcactgtcttccacctccagatcttgacccactgaaaaagatctttaggggcagtaatatgcatggagctgtcatctatggtaacaatgccttcttctggatacctcctgaaggacctgcctgagactgttttacaattaatttttttttgagacagggtctcactaggttgcccaggctggggtgcagtggcaccatctctgcccactgcagcctctgcctcccaggctcaagtgatcctcccacctcagcctcccgagtagctgggaccacaggcctgtgccaccatgcctggctaagtttttttctttttttcttttttgagatggagttttgctcttgttgcccagggtggagtgcaatggcgaaatcttggctcactgcaacctctgcctcccgggttcaagcaattctcctgcctcagcctcctgagtagctgggattacaggcacccgccaccacgcccagctaattttttgtatttttagtagagacggggtttcactgtgttggccaggctggtctcgaactcctgacctcaggcgatctgcccgcctcagcctcccagagtgctgggattacaggcttgagccaccgtgcctgggctttttttttttttctttctttttttttttttttttgatggagtctcgctctgttgcccaggctggagtgcagtggcgctgtctcggctcactgcaagctctgcctcccgggttcacgccattctcctgcctcaacctcccaagtagctgggactacaggcactggctaccatgcctggctaattttttgtattttcagtagagacggggtttcaccatattagccgggatggtctcgatctcctgacctcgtgatccacccgccttagcctcccaaaatgctgggattacaggcataagccaccgtgcccagcctaatttttgtatttttttgtggagacagggtttcaccatgttgtccaggctggtcttgaattcctgaactcaagctagcgcccaccttggctcccaaagttctggaattataggcgtgagctacagtgctcgaccatgttttacaattactttttttaaaaagtagaaggaaagctgggcatagtggtacatgcttgtagtctcagctactcaagaggctgagatgggaggattgcttgggtctgggaattccagtccagcctgggcaacatagaacttttctctaaaaaaaaaataaacattggccgggcacagtggctgacacctgtaatcctagcactttaggaggccgagcgggcggatcacctgaggtcatgagttcaagaccaacctggccaacatggcgaaatcccgtctctactaaaaatataaaaattagccaggcgtggtggtgcacacctgtaatcccagctactcgggagattgaagcacgagaatcacttgaacctgggaggtggaggttgcagtgagctgagatcgcccctctgcactccagcctgggcgatggagctacactccatctgaaaaatgtttttaaaaagattaaaaaaaaaaaactagaagacacacactctaaaataatgataaaaagtatggcatagtaaatgcataaacaagtagtagtcatttattatcatgaagtattatacactgaacataatttttttttttttgagacagggtctcactctgttgcccaggttggagtgtagtggcatgatcttggctcactgcaacctccgtcccccaggttcaagtgattcccctgcctcagcctccagagtagctgggattacaggcacccgccaccatgcctggctgattttttgtatttgtttagtagagacggggtttcgccatgttggctaggctagtctcgaactcctgacctcaggtgatccacctgccttggtctcccaaagtgctaggattacagctgtgagccactgtgcccagcctactgtacataattgtatgtgctgtacttttatatgactagcaatgcagtaggtttgtttacacagtatcatcacaaacgtgagtaacgtattgtgctacatacaacattatgacagccaccatgtcactagacaatatgaatttttcctctccattgtaatctgatgggtgcacgattgtagtacctatgtggtttagctgaatgatagtagatttttagtttggactatgggatgacaagcagaatcctttactgcattagggaagcaggtttcagatacctgatgataccatggtggggtgtccaggaagtagtgggatgtgcaggtctcagttcaggagtaaaatcaggattggagaaaggggatcctcactacagaagtggaattatcaccatggggaaggctgtggtcatcttaagacagcattcccagggaagcagggatgacagaaccccatagcatgagggcaggaggagtggatacaaggatgtggagaggggaaagactcccccattcctttccctcctccctcgtcatagaaagtgaggaccaaggcacccaaggtctgaccatctgtgtctccagagctcctgcatgtgactaacctctgtgtaaacttctccaaactgcacaccctgggtgacaggcccctgggaggcctcaagggacaccccttctactactatgccttctatgagcttgtagccaaaggcagttgcctgtgccttgggcacacctctaagtgcaggtctgcacctggaaccccagccaatgtggtgaggacaatgggaggggcattctgttgctggtggggtgggcaagctgggactccagagcaggcctgccttgccctcctccctatcaggtacatgggctttgcatctgtccccaccagtcggtgcacactgtgagtgctgccaagacctgcaccaggatcatccatgacatgcagcagagcctgggcacccccatgcctgctgggatgaatgccatgctctactctgcctggccatacctgccacaggtccgcccaccccatatctacctttctggttctgcctcagaatgtgagtgccatgggcatgtctacagttgtcactttgacacagctgtgtgtctggttatgtgagtggaggtgtgtgtgatgtgtgtcagcacaacacagctgggcgccactgtgagttctgctggcccttcttctactgtcatccctgagaggatccctgttcccctcggtcctgcagacatgagtccttcaacccctaatcccaacactgactcttatccttcagctccatggtgacctctgacctaattccatccttaacctctgacctctgatctagcctgtgactgtgaccctgtgggtgtctggaaggggatttgtgtgatgctcacattaatgagatccatggcctcctctctgggcagtgttgctgcaaagtgtgtgtatggggtcagcactgtgactcctactggcctggtcactatggcctgagctccacccaacctcagagctgccagtgtgagtgacactcagggtgggcccccgcctccatgtcctcctggctctgcccccagttactgccctgataacacacgcacctacccacctcactgcagttccattagcaagctaagagccctaagccttcgcctgcaggtgtgaccccagggttcaggtccctggtactcatgtctgttatccctccagtggtacctgtcactgcaaatgctttgtctctgggcaggacggtagccattgtctggtgaggcttggcccaccttctgatttaaccttgacctttggcactgagcttcttggagctatagccttataatgagtataaggctatagttatcatgactgtggactgagccttgtacttgggtgggtgccgctcactgacttggtcaccagggtcagcatcactttggctagctgaacctgtatatgccctcaggtgggagtttcggaaacaaaagggaaattgattaaacttgtattatacactggatttaaaggcttttgtctttgtttttgtttttgagacagagtcttgtcttgctctgtcacccaggctggagtgcagtggtgcaacctcggctcgctgcaacctccacctcccgagttcaagcgattctcatgccttagcctcctgtgtagctggaattacaggcacacaccaccacacctggctaatttttgtatttttagtagaggcgaagttttaccatgtcagccacgctggtctccaactcctgacctcaaatgatctgcccgccttggtctcccaaagtgctgggattactcgtgtgagccaccacacccggccaaaggtgtttttttgttttgttttgttttgttttgttttttttccagcaaacttgtttagaggaagacttagtccaaggaataactccatcctctctttgcctcgaatgttacaaactctttgcttaactttttttttttttttgagatggagtctcactctgtcacccaggctggagtgcagtggcgcaatctcagctcactgcaacctctgcctcctgggttcaagtgattctcctgcctcagcctctcgagtagctgggattacaggcaaccgcaaccacgcccggctaatttttttttttttttaagtagagacggggtttcaccatcttggccaggctggtctcgaactcctgacctcgtgatccacccaccttaacctcccaaaacgctaggattacaggcgtgcgccactgtgcccggcctcttggcttaacttttatttaaccctggttgtgtcctcatctccttcttatgtctctctgtgaagttactcaggagtgcaccatgatcttctctctcactttcagatgcagtcagaggaacattcaggccctttctcaccccttttcccaccataggcagacccaatataagacttatcaggcccctcccctcctcttcctgtccagatcttcttgccttccccaacccaactacagtctcctacagcctgagttctagggtctgggcagtgaccccgcccccacccaggctgctggccctgtgactttaactttgcagatgctacagtaacaggtacagggcggggcctggaattcatggtcaaatggcaagaatcaagacttcaccctgacccctcctcacctctgtgctccctcaggtattctgcagtggtgagtctctgcatatcccacccccacctctgtggctgccactgccatgagcactaatctgggtatttctttttctttttttttctttttttttaatttgagacagcgtcttgctgtgtcgcccaggcagggtggcatgcaatgacacaaactcagctcactgcaacctccgcctcccgggttcaagcgattctcctgcctcagtctcccgagtagctgagattacaagcatgcaccaccacacctggcgaatttttgtatttttagtagagacgaagtttcaccatattggctaggctggtctcgaactcctgacctcaggtgatccgcccaccttggcctctcaaagtgctgggattataggcgtgccacatggcgcctggtctaatctgggtatttctgtgctgcccttggccacagctgaagccaaacttggccaggttctccagcaagtataagtatcaggagggtcagaagcagaaagaaatcaaagctcagacactggggctcactggaagaagtgaacgtccagataactatttggaggaagagtctgagcagggttggaaagacttggaaatccaggtatgggtgtcagcatggtcaaaagttcagtgtcttggacagaggccatattattcccaggacagtatgggaaaggactaggactcccacttccttcgagggagccccctggcctgctcctttccactgtacagaagccccagggactgcctctgactggcttcagccccgacttcagagatagcatcacgctgttttttgttttgttttgtttgtttgtttgtttgttttgagatggaatttcactcttgtcgtccaggctggagtgcaatggcatgatcttggctcattgcaacctgtgcctcctgggttcaagctattttcctgcctcagcctcccaaatcactgggattacaggtgcctgccaccacacgtgactagtttttgtatttttagtagatacggggtttcaccttgttggccaggctggtctcgaactcctgacctcaggtgatctgcccgccttggctttccaaagtgctgggattacaggcatgagccaccacacctggatgatagcatgacccttgatgtgccctccaccctgtctggcaagaccattacaggcaccagctgcccaaagtgaggagtctggggaacaagatgaagtcacaggtcactaggatcttaagagggataagggcctgggaatacagatccttgggttcttgagggaatgggagtctaagccctgagggtcgtaggtcctggaatgggaagtctgtgtctcacatgcaggccccagaaaagccctttcccctgcatgggcagctggtcctgtattttggactggcttgactttgcccatgtggtcagtgagggttgcccttctctcctggtgcccattggtgcctcatgccctgtagtatgacattgtcctgctctatgaaacctaggtcagtggtgtggatgtcaggagtgtggatgggtggtggtagggatggataggagtggctctgtgactgctgacccctaaccccaggaacctgaagactgtcaggcattagtcagtgtctgtgcccaattcctgcccagcagcacccactgtgcccatctgctgccctcagagcagctgtttcaggtggccctgcttcgtgcacacagctaggcaagaccctgtgacccccaaccctgtcactcccaataccaggaccccattatgctgcccacacatttgaaacacaccaaaccgtcagtatggcatatcatcatgtcgtaaaacaagcaaaacaggtacttagtttaacaataaagcaggatttaagaagttggtctttttccattcatgatgaaatgttgggctcactaagtgcacaatagaaatgaggcatcccagctgggcacagtggctcatgcctgtaatctcagcactttgggaggacaaggtgggcggatcacctgaggtcagaagttccataccagcctggccaacatggtgaaaccctgtttcttttttttttttctctttgagacagagtttcgctctttttgcccaggctggagtgcaatggcacgatcttggctcactgcaacctccgcatcctgggttcaagcaattctcctgcctcagcctccccagtagctgggattacaggtgcccgccaccacgcccggctaattttttgtatttttagtagagacggggtttcaccatgttggccaggatggtctcgatctcctgacctcatgatccgcctgcctcgacctcccaaagtgctgggattacaggcgtgagccaccgcgccctgcttttttttttttttttttttttgagatagagtttctctcttgttgcccaggctggagtgcaatggtgggatctcagctcaccgcaacctccgcctcccgggttcaagcagttctcctgcgttagcctcctgagtagctgggattacaggtacgtgccaccacacccagctaattttgtatttttagtagagatggggtttctccctgttggtcaggttggtctccaactctcatcatcaggtgatctgcccgcctcagcctcccaaagtgctgggattacaggtgtgagccacagcgcgtggctttttttttttttttttttgagactttgagacggagtctcactttgtcaccaggctggagtgcagtggcacgatctcggctcattgcaacctccacttcctgggttcaagcgattctcctgcctcagcctaccaagtaggtgggactacaggcgcgtaccaccatgcccagctaatttttgtatttttagtagagacggggtttcactatgttggccaggatggtctcgatctcttgacattgtgattgtcccgcctcagcctcccaaagtgctgggattacaggcatgaaccaccgcacccggccgaaaccccatttctactaaaaatacaaaaattagcctggcgtggtggcacacacctgtactcccagctactcgggaggctgaggtgggactgagccgagatcgcgccactgcactccagactggacgacagagcgagcctccatcaaaaaaaaagaagaagaaaaaggaaagaaagaaaggacggagggagggaggaaggaaggaaggaacgaaggaaggaaggaaggaaagaaggaaggaaggaaggaagcatggaggcatctctgggaccacatgatcattgcagcatcacctcacctcttctcctctccccattcactgcagggttgtggttctatacagactttctgctttgatccaggaacatgctgctactccacgacacaggctatggcagaccaagagggagtgtggaggactgagggaagcttcatccatctgcattcagtgatgtcctaggggctgcaccctacatctggcagagacataattttttttttttttttttgagagggagtctcgttcttgtcacccaggctggagtgcaatggagcaatcttagctcactgcaacctccgcctcccaggttcaagcagttctgcctcagcttcctgagtagctgggattacaggtgcccactgccacacccggctaatttttttttttttttttttttgagacggagtcttactcttttgcccaggcctgagtgcagtggcgctgtctcggctcactgcaagctccgcctcctgggttcacgccattctcctgcctcagcttcccgagtggctgggactacaggcgcccgccaccatgcctggctaattttttgtatttttagtagagacggggtttcactgtgttagccgggatggtctcgatctcctgacctcgtgatccgcccgcctcggcttcccaaagtgctaggattacaggtgtgagccactgcgcctggcctttttaaaatttttttatatatttatttattttttgagatggagtttctctcttgttgcccaggctggagtgcagtgatgtgatctctgctcactgcaacctctgcctcccaggttctagcgattctcctgcctcagcctcctgagtagctgggactacaggcgcatgctaccatacctggctaattttttttttttttttttttttagtagaggtggggtttcaccatgttagccaggatggtctcaatctcctgaccttgtgatccgcccaactcggcctcccaaaatgctgggattacaggcttgagccaccgcacctggctacccggctaatttttgtatttttagtagagttggggtttcaccatattggccaggctggtcacgaactcctgacctcaggtgatctgaccaccttggcctcccaaagtgctgggattataggtgtgagccactgcgcctggctcagagacataaattttattttatttattttaatttttttgagatggagtctcactctgttgcccaggctggagtgcagtggcgcaatcttggctcactgcaagctccgcttcctgggttcatgccattctcctgcctcagcctcctgagtagtagctgggactacaggcgcccgccaccatgcttggctaatttttttgtatttttagtagagacggggtttgactgtgttagccaggatgatctccatctcctgatctcatggtccgcccacctcggcctccaaaagtgctgggattacaggcatgagccactgtgcctggccaattttatttttttattttattttattttattattattattattttttgagatggagtcttgctctgtcacccaggctggagtgcagtggcgctatcttggctcactgcaagctccgcctcccacgttcacaccattctccttcctcagcctcccaagtagctgggactacaggtgcctgccactgcgcccagctaattttttgtttttgtatttttagtagagatggggtttcaccgtgttagccaggatggtctcgatctcctgacctcatgatccacccgcctcggcttcccaaagtgctgggattacaggcgtgagccaccacgcctggcctattttattttattttattttattttattttattttattttattttattttttgagatggagttttgctcttgtcacccaggttggagtacagtggcacaatgttgactcactgcaacctctgcctcccaggttcaagcgattctcttgcctcagcctcctcagtagctgggatcacaggtgctggccaccttgtctggctagttttgttttattttattttattttatttttgtgtttttagtagagagagggtctcaccacattggccaggctggtcttgaactcctgacctcaggtgatctgcacgcctcggcctcccaaagtcctgggattacaggcatgagccacctgcacccggcctctttgtttgtttatttacttatttattttgagacagagtttcgctcttgttgcccaggctgtagtgcaatggcacgatctcggctcactgcaacctctgcctcctgggttcaagcgattcttctgctgcagcctttggagtagccgggattataggcgcctgccaccatgcccagctaatttttttttgtatttttagtagagacgggatttcaccatgttggccagactggtgttgaattcctgacctcaggtgatccacctgcctcgccctcccaaagtgctgagattacaggcgtgaaccactgcgcccagtctctgagacataaattatagcaagacaggattggtgcagtgaggctgggaggcaggggatcatagaggcctggagttgcagcaagaggattaagacctacatagatggagagtgtaggcagaggagcccaggcaggggaaacagctcatgcaaaagacagaagataagaataggcaagtgccagatctcataggaccttttgggccaggagaggggcttaacctttatcccaggggaagtggggaaccatggaagagatttaagcagggaagagatgtggggagaatttattgtttggtggaaggcccagatgcaagctcccgaaatgattctgagtgagagatggcattctctctactagattggggccactggagatggaggaaaaattgactcaaaacagattaggggttcaaggggccgggcatggtggctcacgcctgtaatcccagcactttgggaggccgaggtgggatcacctgaggtcaaaagtttgagagaagcctggtgaacatggtgaaaccccgtctgtactaaaaatacaaaaattagctgggcgtggtggcgggtgtctgtaatcccagcactttgggaggccgagttgggcggatcacaaggtcaggagattgaggccatcctggctaacatggcgaaaccccacctctaccaaaaaaaaaaaaaaaaaattagccaggtatggtagcatgcacctgtagtcccagatacttgggaggctgaggcaggagaattgcttgaacctgggaggtagaggttacagtgagccaagatcacagcattacactccagcctggacaactagagcaaaactctgtctcaaaaaaaaaaaaaaaaaaaagagagagattaggaaacagaaggggggctgaggggtgggggtagggatgtcccccttggatgagggccaatccaagaaaggtggcaagtaagtgttaatgagtggggctgattgcctcttgctggcttcccttgaccctcttgctagcttgtgcacctgccatgggtgaacacgttgcctgggctggggtctttgtaccctggggcctcaggcatttacaggagttccaccaggcaggctcatggaggcagcaaggccaggcctctccagcacgatgcctgaagcctgtgcctgcctgttctgcagcatctcagctctgctccatggggatgggcctcagtgagtgtatgtgccaggcttgaagtggcttcagggtaggggttgcaggagcaccatgaggttcatctaatctttcccttcctctgccagcatgtgtgccatctgcaaggttcactgagcactgagtggggcctgctatgtgggcagtatccctgccatcttcatatcattggtcatacttgtgaccactgtgtgcctggaaagcaggctttgggcctctggctgcagtgatgagccttcagggcctgtaggcatgaggttgggggccagctgtctcctgtccttgcatggcttgattgctttgtcattctccacagagtgccactgatatgctgaaggtaccaccagtgccatctataaccctgtgtatgggcagtgcatgttccaggaaggacttgctggttgctgccgtgactactgcctccctggctactgaagcttttggcagtgccagccctgtgcctgcaatgggcatgctgagttgtgccacccccttatatgtatctgccaggcctgccaggctggcactgtaaaaggtgagcactgtcattggatgggttgaacaggccccataccatgtgctactgcccccaggtgcttggatggctactatggagaccccactctaggcttgggccagcggtgctggctctgcctttgtcctgggcaccccaattccagcctctatcatgggagttcctgccatgtggacagcatgagtgggcatatcctagtcttctgtttacctggctatgcaggtgaggcatggttggcagtgacaaagccacagccctggtcaattgttcacaatcccatcaggtccacatgacaaatcttcccaatgccacctgtatgctgagctgggcaccatcttcaaggagttcctgttctgaggaaggagggctgaatggggggaattataggtatagaccttgaaagccaggaagatgggctataatatacctattgtgtccctcctggccagacctcagactttctggctgcatatctgagacccacaggcccccagggtacaggaagacacatataccccagtcctctccaggcctcagctgtgaccactgcttctgtggctattttgggcacctggccaggaggataccccagaagagtccataccggtctgccagtgtggcaatatcaatctccatgatcctgctgcctgtgacccccacagtgggcactgccagcattctgtgcaccacagccatgtccctgcctatgcccacggcaagcctggcttccgcagcagtgacctgtgttgcgggaagtcagggaccccaaatggagggaccggctgaagccatggcagaagaacgtggattgtgaagatttcatggacatttattagttccccaaattaatacttttataatttcttatgcctgtctttactgcaatctgtaaacataaattgtgaagatttcatggacacttatcactttcccaatcaatacccttgtgatttcctatgcctgtctttactttaatatcttaatcctgtcatctcgtaaactgaggaggatgtatgtcgcctcaggaccctgtgatgattgcattaactgcacaaattgtagagcatgtgtgtttgaacaatatgaaatctgggcaccttgaaaaaagaacaggataacagcaatgttcagggaacaagagagataaccttaaactctgaccgctggtgagccaggcggaacagagctgtatttctcttctttcaaaagcaaatgggagaaatatcgctgaattctttttctcagcaaggaacatccctgagaaagagaatgcgcctctgagagtaggcctctaaaatggcccccttgggtgtggccatcttctgtggtcgaaactgtagagatgaaataagccccagtctcccatagcgctcccaggcttattaggatgaggaaattcccgcctaataaattttggtcagacaggttgctctcaaaccctgtctcctgataagatgttatcagtgacaatggtgcccgaaacttcattagcaattttaattttgccccagtcctgtggtcctgtgatctcgccctgcctccatttgccttgtgatattctatcaccttgtgaagcatgtgatctctgtgacccacaccctattcatacactccctccccttttgaaaatcactaataaaaacttgctggtttcacggctcagagggcatcatggaacctaccgacatgtgatgtctcccccagacgcccagttttaaaatttatctcttttgtactctgtccctttatttctcaacctggccgatgcttagggaaaacagaaaagaacctgtgtgactattgggggcaggttcccctatagacctgggctcagagggctgccagcatgagtttgtgggtggggacatcccagggtgaccgggtaggattttcactccccagattggccaagccttcctctccccaggctacagttgtgacccttgagacaatgtcctcatgtggtgcccatctgaggctgaagcctgtgctgcccccgcactctggggcaagactgcagccactgtgcccccctcttctggaacctgggagacccctggggctgtgaactctgtggctttcatgctcaatacactttgcaatcaatgtgccacccagtgagtaagcccatattgtacatagcatgtggtcatagccaggtgtgagtgaacttgcacttgcctatgacacaatgtgacttatggctgctgtgagtgaatgtgaccaccagcaccagtactggtacatggggctgcaaacagctgtgtgagtctctgctctcatgtggcgttaactataaggtggtgtcagggtgtgggggagtatggacacgaggctgcatgtccccagtcccacatgcagccatgcactaatttgtgagtgaaccactgtgagtaggtcatggcaagcagagtgagcgtgatgaggggtggagacaagagtggggctggaaggagaaggagactgaggaggtacaggtggagggttaggattgagatctggtgcaggcagagagagatggccatgggaagcaagcgtttctgggaggaaagtggtcagagactgaatgagatgaagcttgaagtgtgttcctgtgtccttggcaaggagaggggtgggagtcagactcagggagtgagtgaggcataggaggaggggcatggaaacagtgggtatgcaactcaggacatggggaaactaagggcaacagatcaggagatgagaactagtgggtccatgggaagcaagggctggcaatgtgggaaggtgcagattggccaaggcagcaggccagagtatcaagggaaccaacccccaatatttcaacatagattctttctattttccctaagtgtcagcaggtctaagaaataaagagaaagagtacaaagaaaaattttacagctgggcctccgggagtatcatcacacattggtaggaccgtgatggtgaccccaagccacaaaaccagcaagtttttattagggattttaaaaggggagggggtgtacaaacagggagtaggtcacaaggatcacatacttcaaagaacaataaagatcacaaggcaaaggcaaaattagaattactgatgagggtctatgtcccattgtacacagattgtcttgataaacatcttaacaggaaacaaggtttgagagcagacaaccggtctgactagaatttaccaggctggaatttcccaatcctagtaagcctgagggtactgcaggagaccagggcatatttcagtccttatctcaaccacataagacacaaactcccagagtggccgtctatagaccttcccccaggaatgcattccttccctagggtatcaattattaatattccttgctgggaaaataattcagcgatatttctcctactcgcacatccatttataggctccctgaaagaagaaaaatatggctctattctgcccgaccctgcaggcagtcagaccttatggttatcttcccttgttccctgaaaattgctgatattctgttctttttcagggtgcactgatttcatattgttcgaacacacatattttacaatcagatttcatattgttcaaacacacaagttctacaatcaatttgtacaatagtggtcctgaggtgatgtatattctcggcttatgaagataacaggattaagagattaaagacaggcataagaaattataagagtattattggggaaataataaatgtccatgaaatcttcacaatttatgttcagagattgcaataaagacaggcataagaaattataaaagtattaatttggggaactgataaatgtccatgaaatcttcacaatttatgttcttctgcctcggctccagccggtccctccagtcagggtccctgacttctcacaacaccagagaaagcaggaagggagaggctctcagccaaatgcaagtgtgggtgctgccttgggcaggaacacagctgggaggaaatacaagtatgtgtgtgccatgcatgtctaagcactcaagtccttttccctctcccagagaagggtctttggccctgctgaccaggctatgctttcttccttcaggtcacaggtcagtgcccctgctgggcagcgtctgggagctgcaaatgctcccagttgcagaatgggtattggggtgaccctgagcaggagtgcagaggtgagaggggcacttgcacattccacagccaggggtgaggctgccctgcaggggctgctcaatatggagtagcaagggagtgtttggggttttcctgagggagaacacagcacgtttattgctgtttccccaaagaacttaaagaaatacttgtgaaaacagctgaagggaaacagcaaggctaggcgagggatgcctatagagaggacacatcaggtggctctttcctcaccctgcctgccagcccttgactctggttgacccctgacagggctgtagagcccctggaaccctgtgctgttttcctgcccaaatactgccatgcagtatggcctctctgtccagggtaaatgccagtgcccatggcagttctgagcagtggcttaggcaagggttggtgtgcaccctcacacctacacagggccattctcatccttcagtatttttttttttttttgagacggagtctcgctctgtcgcccaggttggagtgcagtggtgagatctcagctcactgcaagctccgcctcccaggttcatgccattctcctgcctcagcctcctgagtagctgggactacaggtgcccgccaccacgcccggctaattttgtttttgtatttttaatagagacgggatttcaccatgttagccaggatggtctcaatctcctaacctcgtgatctgcccgcctcagcctcccaaagtgctgggattacaggcgtgagccaccgtgctcagccccttcagacatttttttttgagacgggctctcactctgtcacccaagctggagtgcagtggcacaatcttggctcattgcagtctcaaccttccaggctcaagggatcctcccgccttatctcctgaggagctgggaccacaggtgtgccccaccatgtccagctaatttttgtattttttgtagagatggggtttttccatgttgcccaggctggtcttgaactcctgagctcaagtgatccacccaccttagcctcccacagacctattattttttcagaaatagggtctcatgggtcaggcacagtggctcacgcctgtaatcccaacactttgggaggccgaggcgggtagatcatgaggtcaggagtttaagaccagcctagccaatatggtgaaaccccgtctctactaaaaatacaaaaaaaaaaaaattagccaggcatgttggcggttgcctgtagtcacagctgctcaggaggctgaggcaggagaattgcttgaacctgggaggtgaaggttgcagtgagacgagatcgcaccactacacttacagagcgagactctgtctcacaaaaaaaaaaaaaggaaaagaaatagggtctcactctgtcacctgggctggagtacagtggcatgatcttagctcactacagcctcaacctcccaggttcaagtgatcctcccacctcatcctgctgagtagctgagactacagcacacgccgccacacctggctaatttttaaatttttttgtagagacaggatctccctatgttgctcaggctggtctcaaactcctgagctcaagtgatcctcctgcctcagcctcccaaagtggtggggttacaggtgtgagtcactgcacctggcccatccttcaggtctctcgaaggtaaggctagagctagtgtcatctgctctctaccctgaccctatctctcctctgcagcctgtgcctgtgacccacagggctccatcttgcccagctgtgattcacacatgggcacctgcttcttcagagagggcatcttagggctgaggtgccaggcatgtgctcatggctccagaggtgccttcccacactgcacctcctgtcccacctgcttcaccttctgagaccaactcctggctctgctcccactgcagctggaagctgtggcccaagaggtggccaccctatgctaggggatgcctggtgggggtgttaggggccagggtggacacctgcaggtcctagattgggtactgtagcaggcacaggctgctccctccaacctgggaccctgcccactgttcagtgggctcttgttgccttccacaactcctcccatagcctggacatagagtcacagccttggagcagcatcaacaacaggtacacagccagggggactgtgggtgggagccatgggggagtcacaggaaaccatggcttggacatggtgttgtaggcaacatattccacatctgacccacgcccaccagctgcagcaaatccaggccatagcaagctccacaggaatccaggcacaggagacatggtattgggaaaggggaccttggggcatgactgccatgacccacatgcaagcagccgtgcagatcatccagcgcttcctcatgggtacatatctgcttgttgcatgtctgttcacagccaagggcagggttaatagggtatgcaggacactatcatgatactccttccagaatgaggaatattcatcagggctgaccaggggtcaagtgggaacactagtgtgtgcgtaaattttttttttttttttgagagggagtcttgctctgtcacccaggctggagtgcagtggtgcaatctcggctcactgcaacctgcgccccccgggttcaagcgattctcccacctcagcctcccaagtagctgggattacaggcacactgtaatttttttttgtatttttagtagagacggggtttcaccatcttggccaggctggtcttgaactcctgacctcatgatccacccgccttcgcctcccaaagtgctgggattacaggcgtgagccaccgcatctggccatgtgtgtagataaatttttaacaactggctgtgagtcaggggaaactgatttttagcatttgtcaatatccatgatgtaagtaatgctatcatgattgatttcagtccataccatttgacaacttatttgcaaaattcctgaaaatttaacaattggctctttttattttagtattattattattatttttgagagggagagtctcgctctgtcacccaggctggagtgcagtggcgtgatctcggctcaccacaaccgccacctcctgggttcaagcgattctcctgcctcagccttctgagtagctgggattacaggcacccgccaccacatccagctaatttttgttatttttagtagagatgagttttcactacattggccaggctggtctcaaactcctgaccttgtaatctgcctgccttggcctcccaaagtgctgggattaccctttttttattatcattttattttttattttttttagagacagagtctcgctctgtcacccaggctagagtgcagtggtgtgatcttggctcactgcaagctccgcctcccgggttcaagcaattctcctgcctcagcctcctgagtagctgggagtacaggcacatgccaccatgcctggctaattttttgtattttagtagagatgggttttcaccgtgttgctcaggctggtctcgaactcctgagctcaggcaatctgcctgcttcggcctcccaaagtgctgggattacaggcgtgagccactgcgcccggccaacaattgcctcttgtaagcctccagcacaccactggatagttgtgtctaaggcaggatcagtgagaggctagggtcagggtttgttggctcagagttcagggttcaggcctaagatccctaccctcttccccacagacaaaggtgtggacaccacaagtgtggagctggctgtcagtgccccttccccaaggtgggggcagtaggcattgctcttctgctgggtcagatccagggtgctctccctgtaccggatgccatgggccagaagctgcccaaagctgaaggcatcctccatcaggcagagtgaaccaggtgaagggccaggaggctggaggtggaagtcagagggtggccagaaaagggatgcctaactgaacacctgtgttcttcaaggagggtacaacctgggcccagcaccaagcactggatgttcagggggtgctggctgaggggggaatggaactcatgcaggggccgcagagcaagggctacaggaagtgaagctggcacttgaaggcctggagggcactgtacaggaggtgataccctacttgtaccctcagctcctttacatcccttgttcaatgactgctgtgatttccattctccctgagatccttgactcactatgataccacagtgctaccaagtaccttgaccgtgataacactcagcctagttgctactgtgctgtgtcctctctgtgaccccctaacctttgccccaggtagtagggcgcctggcccagatggcactggcagttgaggtgaccccagtcccagggcgtctgtccagtgtagctaaggtgctcagggcatgttttgtcctgagtcagcagcaggcccaggaggcagaagaatgggcagcatgagtcgtaggcagggctgagggcctgggcaagatgaaatggggaagagtgggcactggggtctcagggacccctctggaacagtggaaagtggggtttgggctggggctgggctatactggactgaggcgggatctcagttctaaattctccttttctccaggaaccttaggcagtaatatatttgaggcaatatattctgggtggggtggggattcaggtccagccctgccctaggagttgtaggtggcccctttggctgtggccgagctgcaggaggacacatatggcctggtagccactgtgcaggatgcaaaagaatgggtgcagcaggcttgagctgaggcccaggagctcctgaagaaggcataaagcagcttcagctgcctgcatggtgcatggctggcctgcaatagggcaggcacagggaacggcttagggtcagatggaaaggtcagggccagaatagggatgttgtggaagggttaaggctgggtccagatcagatcttgactcatgtagggatcagggctagggtcaaggtttagaccagggatcaagtgttgattaggttcagggtttatttaaggttagggctgggtcagggtcagggttgtgatagagactgggaccaggatcagaggttagagccaggggtcagagcctggctcagatgacctgaccccagggttggagtgccgcctgacacagaatgcacaggcactgggcaagaaggcagccaccctgcaggccctggagcagcaggcagctgagctgcttgggcacatgatgtgctttgccaccaataagtatgccacctgctaattactgtctatggaagccattaagaaggactgtgggatcacctgggtaactcaaagtggccctagagtgatccaggaatctcctggccttgggagaccaaagatcctactgagtgcccactgaccctgagtgacccccccatgtggccccacgatgtcccccagtggccctctgaccttgagaaagcagacagatcatgtaactccctgaggccatctagtgtcccagaccttgatacacctttatctctgagtgatctaaaactgtgagactacagtgctggcattctccactcaaaataaatagatggggcctggcactatttactggctcatgcctgtaatcccagcgctttcggaggcagaggcgggaggatcacctgagatcaggagttcaagaccagccaagccaacatggtgaaaccccatgtctactaaaaatagaaacattagctgggcgtggtggtgggcgcctgtaatcctagctacttgggaagctgaggcaggagaatcgcttgaacctgggaggcagaggttgcagtaagcggagatctcgccactgcactccagcctgggtgacagagcgacactctgtctcaaaaaaaaaaaaaaaattaaaattctcagtaatttctagtatccctgatcccccaggttgactacatgatcctcagggtgactggagacctctactccggatatccagaataactcccagcgatgcctaaagtccaacggattgactgacccccacccaaccctcacccaacccccacccccgccgcccccatgctcctttgtgaagtggggtgattcccctgaggaactatcatcagctttcttccctggatggcagctcagggcactccctgccgggactgtggaggcggcaggccagacccagccctaaagaccggaggaccccatgtttcccccagcttcccgttcccagggccctgggtggggcgcgccccatatcccccacccactttcctccttctctccccctccacgccgccgcgcacattccaaccccaggctcctgcgatcccggcaggccaaaaagtctggagcggataaatagccacaagatccggagtcgctcgccgtagctctggtccaccacccagagcctatttccatacagggaaacccgcagcacttctcgtgcctacttaccgtagtgactagtgggggaggcagtgacccccctggagctgtgcttcgggctgggtgtgcactttccccatctctcccccagccccattctgtccagtccctaggactacccgagagccccccacagccctgaataggggcatgtgttgctcctgcttgtgccctccagcctctctgttgatgctggagccctgggatcaaacggctgagttgatggtaatttccacggcgcccatgacgctgaggggaaaaggctacggtctccttggtccagagttggagatcccgaagatctctcatttgctcctgccatgcccccaacttcgtgagccctcttccaaggatagtttaaagcaccaaaccccttaccttcccctggccctcgtataggtgtgggcttgggggcacaataaagatttgtgggtgaagtggtctgtctctggttcctggggcgaaggcagtttccggagggaaggggtagggttggggtgggggcgctctccgcccggtgttgcgctccttcccagaatccgctccggcctttccttcctgccgcgattcccaactttgctcaaagtcgctggactctaagctgtcggagggaccgctggacagacctgggaactgacagagggcctggagggaaacaggccaaagacccacaggcagagttgacacggaaccccaaagcaaggaggagggctcgggcccgagaccgttcacctccccttatccctgttcccctcttcaggatggagctgacctcaagggaaagagggaggggacagcctctgccctgggaacttcgactgggcctactgctaagcggtgagagggcctggtgggggctgggggttgtggaatgtgatggtaggtcctggtagttgcccttggggcacatgaggtggagccactggataggaactcagcggaactgactgagctactgtccccagtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggtgtggctggggacagggtgtgacgccgagtcagggtggggctggcactgcctgaggcactgattctaatccccatccaacccaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtgaggccatgggtggggcaaaagtgagcagggctgcccaccagtagctttgagtccttgacttccgattcctgtcccaggtatccctgcggtcaccatccagctggacctggaggctgagtttcatttcacacacctcattatgaccttcaaggtgcctgcatatctgggagcctgcccgaatcaccctgcttggctctccattgcccctggacagagcctcagctccttaacacagcctccttgagcatggatgcaggaggctccttcatcccttcacaccttccatttgcctccaggcctttgcacatgctcttctgcctttccaatcccaggctgggtcaggcgctgtctccctgagccccatgaaccctgagtctccccattagaggtggctacctttgctggtcattatctggcttccaccagtcacccccactctctgtgagctatttgagggcagtcttgggctgagcagggctcttgatggctctgggttgggcttgggtcctggtgcctgctgatcagctatgcccccctacccagacatttcgccctgctgccatgctggtggaacgctcagcagactttggccgcacctggcatgtgtaccgatatttctcctatgactgtggggctgacttcccaggagtcccactagcacccccacggcactgggatgatgtagtctgtgagtcccgctactcagagattgagccatccactgaaggcgaggtgagggctggcatctgggctgggggctggaagctggggatgatgggcctgaggcaaggtccagtgtgactatgaactccctgcttctccaggtcatctatcgtgtgctggaccctgccatccctatcccagacccctacagctcacggattcagagtgagtgctccaccctttgagtctggcacagtccgtgtccggctagggactatttggggcctcagtaactattttgggtgcttcctagggcaggtgccaagcccagtttagctcgggtggcagtgtataggaggtctttcaaggtgaccttggcagctgagcccctgggtggacatggggcagcaagggcctgcctggtcagttggccccccttcccccgcctcagacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtaaggggcttcagacggttgggatagggctaggggcaggggcggacatggctgagcagtgctgacaacctacctgccaacctctataggtgcacggagcttgcatctgcaaacacaacacacgtggcctcaactgcgagcagtgtcaggatttctatcgtgacctgccctggcgtccggctgaggacggccatagtcatgcctgtaggagtgagtgagatcttggcctccatagctccagcactctgcagcctggctgtgccctgggtagaacctagagctagttggtcaagcccctaaaacccaggctgtatccaaagagtatgcagaccttgatgccccttgggaccccctcaatcctcctctgcagtctgctctgggtagggaaccagtatgatgctgaggccttgaagtccctgagcccctacccacaaattctggcctgtgatagggatctaaggtggcctacttcttacccttgtgacctggttcctcatgtggcctttgccctgcccttcctcccctgccagagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctgtgaggctgggattgggcacggggagagaaagctgagcctggggcaggaactagagagctggactgctgtctaaattgcaggaaattggggttaggggcttgggatagaacttgaccagggatccagggtgggatcccttaggcttaggagaggactggcagtgagctagttgagatagggtgagtgaccctgtatctctttttgccgtcagcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgtatgtgtctcctgccctaacttctatgctgacctttaacccctgtcctcttactcctgactcagctgaacatgagcactgccacagtttcccaaagtgctgatggttctccttccctgcaggatgtcaatgtaatgcacggggcacagtgcctgggagcactccttgtgaccccaacagtggatcctgttactgcaaacgtctagtgactggacgtggatgtgaccgctgcctggtgcgactggaaggggctggagttctaggggcatgatttgtccttagagcacagggctggggtgtcacatctatgccagtgggtgggtgctgagagcttaggatccagtcctggctgagaagcctcaggtctgggaggccaaggatgtgggccagtggtctggggggcatgttttcactgaggggtgattgaggctaagacgtgtggttgggatttcctgctgggtggtgatggggtctggaggtctgtttctggcccccagcaactcctttcgtgcagcctggccactggggcctgagccacgacctgctcggctgccgcccctgtgactgcgacgtgggtggtgctttggatccccagtaagtgttgtaaagggggcctgggaagggatggggaaagatcctgagcagaagagaaggttcttcttgagtaaccacagagttccctccaggtgtgatgagggcacaggtcaatgccactgccgccagcacatggttgggcgacgctgtgagcaggtgcaacctggctacttccggcccttcctggaccacctaatttgggaggctgaggacacccgagggcaggtgtggggcctccccctaagcagagggctggatgtgggtggacacgtctatgactggagaggtggggttatgggcagtaccttgttgaggggataggggtgatatctagctttggcaggagaaatggggtttggggctggctgtggcagaagaggcaaagcctcacctgagcctccatccctggctgcattatctcccaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggttagaccctgttatctaatctggggctgaacctctgggtgtgggagcatctcctccatcatcccgttttcccaggtccctgagcaatgggcagagttggaactgattgtgcagcgtccagggcctgtgcctgcccacagcctgtgtgggcatttggtgcccaaggatgatcgcatccaagggactctgcaaccacatgccaggtgagggcactggtggtagcactcacaatggcagggggttgtggggccagccctaagctccctgcagggcacctggaagaccccacagctcattcatctgttccttctttcaaatacctccagaatgctggttgccaggccctgttgggcatggctctgttcacagaaaggaagtagacagatcaaggcctgctctctcaggggtctaaggcccagaggccaaggcaggaattaatgggaaatcacctggtgtcactatcaggagggtccacagtggtggtggtagagggtggtagtggtggggttgtggcatcagagcactctgagcagggatgtgcctggtctgattaatgttttattacattttgggtagtatttgtttcatgtttcatgtttcttttttttttcttttcttttctttttttttttttttttttttgagacggagtctcgctctgtcaccaggctggagtgcagtggtgcgatctcggctcactgtaatctccacctcccgggttcaagcaattctcatgtgtcagcatcccgagtagctgggactacaggtgcacgccaccacgcccagctagttttttgtatttttagtagagatggggtttcaccatgttggccaggatggcctcgatcttctgaccttgtgatctgcccgccttggcctcccaaagtgttgggattacaggtgtgagccaccgtgcccagccctgtttcattgtttcatgttttgtttgtttgtttgtttgtttttgagatggagtcttgctctgtcgcccaggctggagtgcactggcgcgatctcggctcactgcaagctccacctcccaggttcacgccattctcctgcctcagcctcccaagtagctgggaccacaggcacccgccaccatgccttgctaattttttgtatttttagtagagacggggtttcaccatgttagccaggatggtctcgatctcctgaccttgtgatccacctttctcggcctcccaaagtgctgggattacaggcgtgaaccactgcacttgacctattgcttttagtttttgaccatgtaaatattcaaacagaaggaaagagaataacatattgaacctggctgtgcccattatagacattttgccaactgtgacttgtgtttagaaaaaaaattcctctagaccaggcatggtggctcatgcctgtaatcccagcactttgggacactgaggcaggaggatcacttgagcccaggaattcaagaccagcctaggcaacatggcgagaccctgtctctacaaaaaataaaataattagctaagcatggtggtgtgtgcttgtggttccagctgcttgggaggctgaggtgggaggatatcttgaacccaggaggtcaaggctgcagtgagccaaggtcacgcactgtactccatccatcctgggcaacagagaccgcatctcaaataaacaaataaataaataaatcagaaaataaaaagaaaaaagatgagggattgaagaacaatttttgggatgggataaaagaacccaagtatgagtttgcagcacaatgggaaaggaaagccttggagacaaagagagagggggcgacatagtgttgatgaagaggagcagccattgtaggttgtaggtcggggtcagaggaagcgtgaggtggttgttgaggagaattggcaagttcttgggatttccaggctttatgagtatttccagtgagtctgcacaggtggatgtatgattctagagggccacctttatgagactattctgtgcagattctttgttgggctgcccagctgtttgttggcctagcgcagcccaacgcaacccagccatagtctctgctttggccaatggcctggttgctgggagaaggatgggggaggcccagatgatttgtacagggcccctagatgacccactgcacctgtccccactcgcccccaggtacttgatatttcctaatcctgtctgccttgagcctggtatctcctacaagctgcatctgaagctggtacggacagggggaagtgcccagcctgagactccctactctggacctggcctgctcattgactcggtgaataatctcctcttgcccacaccaaccaagatggcagggcccgtggtgtgggacttgagggatagcaggggtctgtggcagaagaggcaggcccatggtggtgccagggtgggcaggcttgtggcagtgctaaggcaagtgctctggcaatgcctacgtggtcccaggtctgaactgcgatcttccttgctcactccttcagctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgcgtgagtgtctgtgatgtgggttgatggggcagaggtggggacccagcctgacttggcccaaccctcctccccacagcatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaaggtactcttctgccccttgttccctcctatgcttctctctccttcccattactgttctctctcctccttctggacctgctgctggtttcctcaaactaagtcttggaccctctactctcaacctgggtcagttgtagttctcttccatttcctgaccttcccacctagactcccactactcacactcccctgagaccctcccccacccacactcccctcagaccccctcccctggctctggctcagctctgccttgctcctagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgagactggagcagctatgagtgggttggttggtgggcaggcttcccagggatgacacatttcttcttcctcctccctgcaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacgggtgagtggatgggggcaggcgtgggatcagggtgagttggctgggctgagcactcacagcttcctcttaaccgtgggcagggctgcgatgtgaagcttgtgcccctgggcactttggggacccatcaaggccaggtggccggtgccaactgtgtgagtgcagtgggaacattgacccaatggatcctgatgcctgtgacccccacacggggcaatgcctgcgctgtttacaccacacagagggtccacactgtgcccactgcaagcctggcttccatgggcaggctgcccgacagagctgtcaccgtgagtatgagtgtgggagggcatggctgaattggggttctgcttcttggcctcctcttgactactgtgctcatcttggttggcacaggctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgaggtatgggaccctcctgcagatccctggttagatggggccaggtgtctgtcttatctccagggcttagcctcttatagaggctctgaccctgccttgttcccaccccagttcacagggcagtgccactgccgtgccggctttggagggcggacttgttctgagtgccaagagctccactggggagaccctgggttgcagtgccatggtgagggagccagcggggccagggtagatggaggacttcccagaatgccccacagtgaccctaactctgtgctctgctctttcttgcagcctgtgattgtgactctcgtggaatagatacacctcagtgtcaccgcttcacaggtcactgcagctgccgcccaggggtgtctggtgtgcgctgtgaccagtgtgcccgtggcttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggtgcggaagggcctaagaatacatggtgggatggggcagaggcccagtggaccagggctgaagcctctctaaacacccccctctccatcattgcaggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgagttgttagccaactaggcaggtggaccagggtcagtcttcagctgactgtctgcctctgcccaatttaggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgaggttgaagtgttgggtggggcaggtgggtgtagatgttcctctcacagggccctgacttgttctgtgcctggcaggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccgtgagcctcccacgtgtcccaggccatgtggttgtcccctttggcaactcccggtgtctgtatctcccttggttcatacttgagcctcagggactacactggattagtgtttatgatcccttgactggctcctgagttattgcccatatgtggtcccaggtccatgttcttgagtctgagccccttgtatagtccctgtccttgtgattatatccttatgcctggtaacaaacccctatcccatgtacatgtcctgagtccataccccaaaactgtatcctcatgcccatgctggagaatctatgttcttaagttcttgctgtgtccctatagaggagggggctgatcctgatagcattgaaatggtggccacacgggtgctagagctctccatcccagcttcagctgagcagatccagcacctggcgggtgcgattgcagagcgagtccggagcctggcagatgtggatgcgatcctggcacgtactgtaggagatgtgcgtcgtgccgagcagctactgcaggatgcacggcgggcaaggtctgaccccatccctggcccctatccctgacacctggttttgatacctccaggttctgattcccccttctccccaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtgaggtcttcctaggacatcagtgggacaaggttatgggcatgaaccgtagatctgtgtaacctttggctcacccatggcaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcaggtgggttgaggcagagccagctggagaaggtaggggtggaagatgggcctccactgagctaccacgctaacctaaccctctacatctgcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacagggtaagaaatggggcaccagagacacaagactgcgggaaaccccccctaaactgacacctgcccttcctagaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaacccccactgtgttgtctggactctgatttggggcgggcgggggagtctccaggggaacctcgaggttgcccccagcagaacccatgcaccgctaagccacccgagcaccgcctccttccgctcgggcccgccccggagctgcgggtcgctccgagcccattcccgccggaagtgcgtcaccagcttggcgctccgcctccctcggccttagctagaagtcgaaacaaaacaagccgctaaggcggtggcggcggcgccgggacgggggaggggcgcgccggaaccggaaccgacctgcgccggaaccggaacggagagcgggttgccagggcccgaagagggctggctgcggcggtctcgctcggtgagtggagcaggctgcaactcgctggcttggccgcagcggggaggccgcaacgcgcggccgcggcggcctgttcaaggtcacgggccgtgccagtccctacccctagtgccccgcagcgtgccagcccactgatgccggcagggccgttacgctatgcctgtggccagcctcccacctgggagaggactggcggccagcgagggcaacttcgtgggagaggtggtggcgggctcggggttcagaggctgaagctgggtcgcagctcgaccggggcgctgatctgtggtcagtaaccccgcgctgccatttcaggccggctcgggtctctaaacagccccttacccgcctcgacgtccctggggcatgggggagggacgcgaccttcggctggggcctgggtgcaagaaggaggcgccggtggcaggtgtcattaaagatccagcccaccagtaccacatctgacctgtagaagggtatcctgccatccctccttcctcctttacacacttaggggaacacagactagtcattatctgtcctgctactggttcaggccaggcttgaggctgccaggagtcctggatctgtggtcctccccagcctcatctcagtatctagtttcaagaccttcattttggaggaggaaacagtccagaatccactggtgggtctgtgggaaactgtagtggtccttgtggctcagagctcatgagtgaaggcatctgggaaggaaggtgataatttctgttccagtctcaaactggatgcccatcctgccttagtactggagcagggttgctgctgaagaggtagcgtgacatctagatacacttttcagtccctttctgcttgggacagcagctggggagaggactttctcttgaaatgaagaaggaccaagcagtacataggagcaggttcttgccaagggtgggagctggcaggaggcaggtggagtgccttagccccaggactttttctgggcaatggtagaacctgggttgagcctgtttacagccacagagcctggttctcctgcggcttgtctcctgtcctgccttcctcctccaccttctatttctccagtggtgactaagcagccagtgagagtgaaggaaaagtgagcaccctgctcggagtgccagccctgtgggctggagccgtggctcctctccagattggtggagtagcctggtcccaggccatgacttccttgacctggtgccccctcagtgaggctttcacctgtgtgggactgttatggtgggtatctatgaggcttggccagaagtggttgctgctacttgcattatttattacctcttcagaatatcctgagagtgtccaggggtacttaagagatgagaagatacagctctgtagcattagtgtcctgtgttgctgagccctgggtgtagctaaagagcaagttgttgggtcttggcagtgatcactggcttctttccattaggctgtccgttccttgctggagaatttggccacaaagagttgccaagatagctgggccaggaagaaagcgccgcagccctgacccagacgctgttgccgaccccggggcactctggctgtcgaccaagcggctcaagatgtctggcggggccagtgccacaggcccaaggagagggcccccaggactggaggacaccactagtaagaagaagcagaaggatcgagcaaaccaggagagcaaggatggagatcctaggaaaggtgggagtggcattcccagagtaattgtggccttctctgcctcccatcttattggtatacagattggggtttgggagatgactttcttgttcttctctctgtcctggtttgatgatgagagaagaaggacccatgataacctcagtagagcctcagctttgaagcctgagtacttggctaagatccagaagatggtgctgttggggggcttgccttctttcctttttaaacttttttcttttttttgaacctgttctttttttccttttttttttgagatggagtctcattctgtagcccaggctggagtgcagtggtgcaatattggctcactgcaacgtccacctcctggttcaggtgattgtcctgcctcagcctcccaagtagctgggattacaggtgcatgccaccacgcaaggctaattttttttttttttttgagacaatgtctcactctgtcatccaggctagagtgtagtggcgtcttggctcactgcgggctctgcctcccgggttcaagtgattctgctgcctcagcctcccaagtagcctcagcctcccaagtagctgggattacaggtatgcaccaccacactcagctaatttttgtatttttagtagagacggggtttcaccatgttggccagactggtcacaaactcctgacctcaggtgatccacccacctcggcctctcaaagtgctgggattgcaggcgtgaaccaccgtgcctgtcccttttttttttttttttttaaaggcagggtctcactcttgcacagattggagtgcagtgcaggtgtgatcgtagcttactgcatcctcaaagtcctgggctcaagcagtcctcctacctcagcctcctcaccatgcttgactaatttttcttattttttttttagagacagggtctcgatatgttgcccaggctggtcttgaacctctggcctcaggtgatccttctgcctcagcctcccatgcagctgggatcacaggctcacgccaccgtacccggctgttctttccttcatcgtcagggtcagcatccactcctcaagaggagcagaccaaagagggtcagtaacgaatgggctttttgttgctagggaaggggagggggcacttgcaatttggctcccatctgaagcagtttcattaggctgggtctctgttacctgcttatcaccatcaggagcttgtgaagaccctcatgatctcttggctactcccactccagagttgttgctcgattggaggcagagtgcagaagaggtgattgtcaagcttcgtgtgggagtaggtcccctgcagctggaggatgtagatgctgctttcacagatacagactgtgtggtgcggtttgcaggtgtgtccatctgccctgagcacagtagtatgtttgaatcttctgatatctcctatcctacctcatggaccctgctctgtccccaggtggtcagcagtggggtggtgtcttctatgctgagataaaaagctcttgtgctaaagtgcaaacccgcaagggcagtctcctgcacctgacactgcccaaaaaggtgcctatgctcacgtggccctccctcctggtgagttctagtagtacagggttgggtagggataccagtgtagtcgacagggcctgactgctgtatctttggcagaagaaacctctagggacccaggagctggtgccggggctgcggtgccaggagaatgggcaggaactgtctcccattgccctggagccaggccctgagccccaccgggctaagcaggaggcccggaaccagaagcgggcccagggccgtggtgaggtaggcgcaggggctggccccggggcccaggcagggcccagcgccaagagggctgtgcatctctgcagagggccagagggggacgggtccagggatgaccctggaccccggggtgatgccccacccttcgtggctgacccagccacccaggtgagagctgggcacctgtttgggtgttaggagatggggggaaagggtgtgcactggagtgggagccacctggcagacccagggctgattctttccacaatcttgccattaataggttgaggctgatgaacagctttgcataccaccgctgaactcccaaacctgcctcctgggctcagaggagaatttagcccctttggcaggagagaaagcagtgcctcccgggaatgacccagtctctccagccatggtccggagcagaaaccctgggaaagatgactgtgccaaggaggagatggcagtggcagcagatgctgcaaccttggtggatggtaaaggtgggggtgggcaggcagagccctaggttgggttgcaaagtttgtaggtggatagagagtagcaataggctggaacctgtcctggttggggctgagccatggtctcaatatagagcccgagtcgatggtgaacctggcgtttgtcaagaatgactcgtatgagaagggcccggattcagtggtggtgcacgtgtacgtgaaggagatctgcagggacacctcaagagtacttttccgtgagcaggacttcacgctcatcttccagaccaggtgggtgggtagatgatggggcaaacaatgcctcaggtgggacagtatgtctcatgctcttcctcttgtccttcctcctatcctgctgtgcctctgcagggatggaaacttcctgaggctgcacccgggctgtgggccccacaccaccttccgttggcaggtgaagctcaggtgggtggtgcccggccccaccactgtgcctgtcctaccccgtgggctccatctccctggctcatctatcctgatgctcattcctcctaagtccctgagttcagccttttcccacaggaatctgattgagccagagcagtgcaccttctgtttcacggcttctcgcatcgacatctgccttcgtaagaggcagagtcagcgctgggggggcctggaggccccggctgcacgaggtctgcacacgagctcccttcattgcccagttccacgtgaccaggacccaaacccctgtcacatgctgctaaccaccagccctctcattccccctttttaaggtgcagtgggtggtgcaaaggttgccgtgccgacaggtccaacccctctggattcaaccccaccaggaggtgctccccaccccctgacaggccaggaggaggcccgggctgtggagaaggataaatccaaggcacgatctgaggacacagggctagacagtgtggcaacccgcacacccatggagcatgtaaccccaaagccagagacacacctggcctcggtgagaattctggggtgggaaggacgaagaatggaggctggagagtcttggggctgttctctcatgtcgtctttgctcctgcagcccaagcctacatgcatggtgcctcccatgccccacagcccagttagtggagacagcgtggaggaggaggaagaggaagagaagaaggtgtgtctgccaggcttcactggccttgtcaatttaggcaacacctgcttcatgaacagcgtcattcagtctctgtccaacactcgggaactccgggacttcttccatggtgagggcagggcctggagcctgggttatgggcagagagagtgcctttgttcctcacacctttgctcggctactattcctagaccgctcctttgaggctgagatcaactacaacaacccactagggactggtgggcgtctggccattggctttgccgtgctgcttcgggcgctgtggaagggcacccaccatgccttccagccttccaagttgaaggtgatctgtgaccactgtcacccttggctggagggggcggggagggccagccagctgggtgtgcagtgggtgctagggcttcatgttcacaccttggctcctgtatccaggccattgtggcgagtaaggccagccagttcacaggctatgcacagcatgatgcccaggagttcatggctttcctgctggatgggctgcacgaggacctgaatcgcattcagaacaagccctacacagagaccgtggattcagatgggcggcccgatgaggtcagggttagggacagagggtgggcatgtctcatgagcatcccagcccctggtactctttggttctcaccactctgcctctcaggtggtagctgaggaagcatggcagcggcacaagatgaggaatgactctttcatcgtggacctatttcaggggcagtacaagtcgaagctggtgtgccctgtgtgtgccaaggtgtgatgggctcccctggaaagagaccccctagttcagctcagctattctggtcacattaggttcagaggcatgtgcatcttaaggtgctacagggcaaggtttgggcaaagaagctggcagggaggccttaggattctatttgggctgaagagcccactcagggtaggcttcctgactgagggaaaagtgatgttagagctcaaaggtgttgtagcagggttgtgggcacatggggtgcaagtgtgaggccaattcgtaaagtggctaagctgagtagggctttgagtgccagaaagaaggattgttatttcctggtggtcctcctgccctgtctagtgtcctgaagcctgagagtttgctggttggctgtgggggccctgagagccatcagaagccccggaatgggctctctgagcatgagcatcttatctcccactctgtgtgcagctacccagtgccacctctacatccacaggtctccatcacttttgacccgtttctttatctgccggtgcccttgccacaaaagcaaaaggttctccctgtcttttattttgcccgagagccccacagcaagcccatcaaggtgaggagtaagcccctaccctctgggctgttctagagaacgtggcccacctccctcactgactgccctttttgccacagttcctggtgagcgtcagcaaggagaactccactgcgagcgaagtattggactccctctctcagagtgttcatgtgaagcctgagaacctgcgtttggcggaggtatctttgtccttccttgggctatcacatgtgtggatgtgtgtgtgtactcaccacagacgtgtgtacagtcattggcatctacagacatacacatgggctgggcacagtggctcatgcctgtagtcccagcactttgtgaggccgaggtgggcagatcacttgagcccaggagtttgggaccagcctgggcaacttggtgaaacactgtctctacaagaaataaaattagctgggcatggtggtacgtgttatagtcccagctacttgggaggctgaggcaagaggctcacttgagcccgggatgtggaggttgcagtgagcagagattgcaccacagcactccagcctgggtgacagagtgagactctgtctcaaaaataaataaataaatagataaaaaaataaaaatagggccaggcgtggtggctcatgcctgtaatcccagctctttgggaggccaaggctgatggatcacaaggtcaggagatccagaccaccctggcttacatggtgaaaccccacctctactaaaaatacaggaaaagttagccgggcgtggtggcacatgtctgtagtcccagctgctcaggaggctgaggcaggagaatcgcttgaacctgggaggcagaggttgcagtgagccgagatcgcgccactgcactccagcctgggtgacagagtgagactctgtctcaaaaataaaataaaataaaataaaaatagacatacacatgagtatgcctgtgactgtacaaaaacaggcgatgtgctgttattttttctgtgcaacagaagtgccctcagttcctagccattatcagggtttattcccctttgtggtggtggatcccaactgcatttccctttttagacaaggagcttgagctgcaggactatccctatgttcgctctgcctctccctctatcctgctgctctctccttttatcccagttgtgtgtgctagctctccccaggggttcctagcctttagcctgacagtgttggttttcttaggggtaagagtggggaggaggctctttgaatgtggaccctccatgataatatgttacagtcttataaggctatgctagttatagcagggcagagtccctcagtgtggagagctggtgtggttgatatctgcctcacacctggtctttcaggccctctgatgcaccaggctccttatggcattgggcactgagacaggtgccagcagaggcataagcctatttgggcctacagacctcaccactgcccacatagacccaaggcagggccaagccttcttaaactctggggcagggctagggaaagggcttatcctcacgtgggatctgtgtgttctctgtccccaggtaattaagaatcgttttcatcgtgtgttcctaccctcccactcactggacactgtgtccccatctgatacgctcctctgctttgagctgctatcctcagagttggctaaggagcgggtagtggtgctagaggtgcaacaggtgagtgggggccaacctgatggcacagcgccctggtgggtggggcacttcttcctggtcttgctgagccagacgacccaccctagcgcccccaggtgcccagcgtccccatctccaagtgtgcagcctgccagcggaagcaacagtcggaggatgaaaagctgaagcgctgtacccggtgctaccgtgtgggctactgcaaccagtgaggacccccatggtctcccctaccctttctttccaccttccatgtgccaccctgctccttcccttcacaccaaggcacatatgcttaagctttctacttgccaccctactttaccaggctctgggggaggcagggctggcgtacccagttcccagggactatgactagcccccagtatggagtcataggagatggggctaagggcctatccttgtcttcctcttcccgtcaggctctgccagaaaacccactggcctgaccacaagggcctctgccgacctgagaacattggctaccccttcctggtcagtgtacctgcctcacgcctcacttatgcccgcctcgctcagttgctagagggctatgcccggtaagtgcccagtggttggactagagtggtgtaggtgggggcagaggtgctagatgggctggtcaggagtcttacttgcgttgttctctgttgccaggtactctgtgagtgtattccagccaccctttcagccaggccgcatggccttggagtctcagagccctggctgcaccacactgctctccacaggttccctggaggctggggacagcgagagagaccccattcagccacctgagctccagctggtgacccctatggctgagggggacacagggcttccccgggtgtgggcagcccctgaccggggtcctgtgcccagcaccagtggaatttcttctgagatgctggccagtgggcccattgaggttggctccttgccagctggcgagagggtgtcccgacccgaaggtaagatccagtgaaaggctctagaagctggggaggaggataagggaggatggagggggctgttgtttagggcctggtgggcctggtgaggccctgatgggcagggaagctttgattatcatgttctcacacagctgctgtgcctgggtaccagcatccaagtgaagctatgaatgcccacacaccccagttcttcatctataaaattgattcatccaaccgagagcagcggctagaggacaaaggtgtctgaggctgtgggtgggagccatggggtgggttgagctggctgttctccacagctgcatgacctctctccctgcgaatctccaggagacaccccactggagctgggtgacgactgtagcctggctctcgtctggcggaacaatgagcgcttgcaggagtttgtgttggtagcctccaaggagctggaatgtgctgaggatccaggctctgccggtgaggctgcccgggccggccacttcaccctggaccagtgcctcaacctcttcacacggcctgaggtgctggcacccgaggaggcctggtgagaacagagcagcaagtagataagggggcaggatggagaagagagagacttgctggtcctgacccaatctctgtccccaccaggtactgcccacagtgcaaacagcaccgtgaggcctccaagcagctgttgctatggcgcctgccaaatgttctcatcgtgcagctcaagcgcttctcctttcgtagttttatctggcgtgacaagatcaatgacttggtggagttccctgttaggtaagcagtggaccttggtaactgtgggtggggtgtgaggaccaggatgggcatcctgagcgcctgttgcctgtctcacccctccctgactggacctgacctgcaggaacctggacctgagcaagttctgcattggtcagaaagaggagcagctgcccagctacgatctatatgctgtcatcaaccactatggaggcatgattggtggccactacactgcctgtgcacgcctgcccaatgatcgtagcagtcagcgcagtgacgtgggtgagggcacacacagccagcaggataggtggtaggggtggtggtgcagactttgttcacactcttcccaccctgctgtaggctggcgcttgtttgatgacagcacagtgacaacggtagacgagagccaggttgtgacgcgttatgcctatgtactcttctaccgccggcggaactctcctgtggagaggccccccagggcaggtcactctgagcaccacccagacctaggccctgcagctgaggctgctgccagccaggtgaggcatgtgggaggctttacagaatactgggggacagttcacagactggggccgggttgggggatatagcttcctctcctccagccacaggcccattgagccttgggattcatgagaattgcagagttctcttaacatcaaagctttagccagaggcatccccatgccttggggacactaacaaacatacaagtacactaacatgctgccactggcaagcacattggcacctacttggcacaggtcaggcaactgctctgaacctcactgggcactatgctgtgaatgaactatacctgacactctcctagatttcctctgcacattccccacatgctggcccacacaccctcacttgtgatgtccctgagttctagtgtgcactcaagacaaggcctatttgggctggccatggcctctggtggctgttatactctttgaggtaagcatctgtctttgctgagccttcaggatcttctctttagtgacatggtgtgccataggcccagttagtgggcgtaggcacatctcttttctggactggccgtctcctttctggctccatcctctcttgagccttctctgtcaagcttagagaaatccttgcagaagactggtcaggatctgggtatgggtgggaaggagcaaggagattgctctgggattggcagtcctgttctctatgaatcggtgtcctttggggaggcctggactgaaatactaaccagataactcccctcccacctccatgcggagctgcatgtggattgagagctgtttagggtaggccaaaatgctgtcaagattctcttacccttgtgctcttactctggacagccctgaggttggctgcctgccttcctccttgctgtttgatctagaatgcagggtgttagccccagtcaccccaggtgggactgtcatggctaagggtctcagggacactgggtcctccccacccccggggtgctgatggccgtttccacataccctaggcttcccggatttggcaggagctggaggctgaggaggagccggtgcctgaggggtctgggcccctgggtccctgggggccccaagactgggtgggccccctaccacgtggccctaccacaccagatgagggctgcctccggtactttgtcctgggcaccgtggcggctttggtggccctcgtgctcaacgtgttctatcctctggtatcccagagtcgctggagatgagctcgcctgcaggcagctgctgtgagctggcctacctgcctgccccaggccatgcctgcctttgttgtggggaacacctctgggctttgggcctcagcttatgcatctggtgggagagggtggggaggttgtggcccctgcaggggcagagtatcctagggtgtgtatccatctggctgtctgtccattcatcctgctgctctgacccttggcctcaggcttggccctgcccaagctacttcctgtacttaaaagtgttaataaaaccagactattcaggcccaatctcgtctctctgtctcaacgccgctgctgtctgcgcctgccttgggaccctcccttgggtgccagggctccaagccagcacccccgggatgccaggcggcatgctgggcagcccccaacccctgtcctcgtattctgttgcagggactaggccctggccaggcccccgaggtggcccccacgcggacagcccctgaacgcttcgccccccctgtggatcggccagcccccacctacagcaacatggaggaggtggattagcaggtccctggctgatgggggggactgggtttgggacacccacacagagggccagctccttgccgcttctccttctctaacccagaggacactggctctgtcaatgggaagctgaggggtatgatttgggtgtggagacctctcaggttgggacttcttgtcagcttggacccctgaccagtgggctttggcttctccagccgcctccagtgctgcgtgatttgattctgttgtaccttcaattcttctgacccgcattataaacattataattttattctaaaaattgtaattttttttgcattttggaagtgactgctgctgtttaaatatattttaaaaataaataataagtaagtagacttagtgactgtgatccaccacatgctggggccacctcccctccccatcatttgcggtgtgtatgtgtgtgtatgtgtgtttatatatgagagaccctgaaagtgccctagtctgaagggagatgatggggtcccagctcatgtcctatgggtcatgaagcccccagtgctatcagctttttggagcctacctgctgctctttcatcccactggttctggatcctacataagaggcagcttggtaggcatcgtcaggatctcaatatagccaagggacagaggagtatatgaagcactggagctgacagcgtggagtaaaaggtgcattcaccagagcagcctggggctgacaagtcagggaggacttgggggacagaagtactgggagatcttcctcctcctctcctgtcctcagctttttctttgctgtaacttgaacactaactgcatccctgcaggtaacagagcaggaggaaaactgctgtggggcagatcttgctgccctgaaaagaggacaagcagagaggaccagagtgaatcttgtctgacttctattggagggagggtgctggggcctgccagcctgaagagtcttcccttaagagttcctgaagccttccttctttggccaggcatggtggctcacacttgtaatccccgcactttgagaggccgaggcgagtgggtcatgaggtcaggagttcgagaccagcctggccaagatggtgaaaccccgtctctactaaaaatacaaaaattaggtgcagtggcgggcacctgtaatcccagctacttgggaggctgaggcaggagaatcgcttgaacctgggaggcggaggttgcagggagccgagatcgcgccactgcactctagcctgggcgacagagcaagactccgtctcaaaaaaaaaaaaaaaaaaaaaagttgctgaaactggccaagtgtggtggcttatgcctgtaatcccagcactttggggcgaggtgggaggatagcttgagcctaggagttcaggaccagcctgggcaacatagtgagaccctgtctttaccaaaaatataaaaattagctggctcttatggtatgcacttgtagtcccaaatatttcagaggctgagatgggaggatcgtttgagcccaggaggttgctggaccctacctctgtccattccacgactgggccttgctggctgctgcctggtttttccacttggtcatctttgtcttgacttttcctggaagcagtgccaggggcttatgcaggcaagctaacctccagactgggcccatacaatttaacatttctgctttgtgcaagtcgtagacatctagggcactagctggatatcgactggtatgctaccacttgtggcattcttggtgacactggtggggctactgcctcattctatgacttgtagccatggcgtccacagtgtaccatgaagtaaccagggaagggagtgcagatcttgatctcattgagggagccatcactagacctgtaggacttggtgatggtgctacagtgaatctattggcagcatcaggtactgaggaaatagtggcagtggcaggcactctgcatggctttgctcaccatgggcacctttatggtgggctgggtacttgcagcttcaaatttggtgcacggctggtgtggctatggctctgcttcttggtacctgtccttagcaccactggtctgcatcccctgcttaattcctgcacctggcctttctcatgcagtacactgcagggctaggcatctggctggggccacggggccatggagatgtgggaagccccaggacagcattggacctggatagcgatacagcatgtggccctggtctgcacctggcatgtgatcattaggtggtatccagatgtaggcccagacttggaggttggtcattaataatgggatgtgggcacaaaagacacagaatatagataaagactagtcaggatcctgcctattccttgaaggtccagaagtatgagcatcaccaattcctgcaagagctccaatctcaaatgtggggatttccaccatcccaccaccagctgctcattctctgcaaccccctacctcagtcccttactaccttagtcccttttctcacacacacacaaagtctctgttctgtttcagccagcaggtcctggaagtccagtgagactgtggaaagatccccaagcacaacagctataatcatgaagctataaccatctcatttgtcccaccctctcacaagctcaataaaatatcctctcaaaggcctgcagagggatttcaaggtctaatttgcttgtggttttcctgataatgctttggcaagagggtaagtgtgggatgagatttttttttcttttctttttttttttttgagacagtcttactctgttgaccaggctggagtgcagtggcacaatctcggctcactgcaacttccgcctcccaggttcaagcgattctccagcctcagcctcctgagtagctgggattacaggcgtgcgccatcacgcccggctaatttttgtatttttagtagagacagggtttcaccatgttggcgaggctgatctcgaactcctggcctcaagtgatccgcccgcctcggcctcccaaagtgctgggattaaaggcctgagccactgcgcccggccaagattttaaaccaaatcatcatagaacttatgtgaggtccctcctggcccagacccgtcccttccctttcctggccagctgtgtccaagtgggcacctgaaaaccggcggacttatggggcccctggatcggtcattccacacattctctacgatggagtctggatgagggatttcctgggcttcatttgttcaactgtttccatgacaactccaaagctgtggcgtcaaaagcgtgacagggactcgcatttgcccccgaggacaattactatattgagatggagttaccagggctgaagtagaaaagtcagagcaaaaccacgcctgtgtcttcctcctgcctcagggacgaacaccttccttccaggtccgtggcaaatatctccaaaagccctgccgcctgccaacaccccttcaagttcccagttccacggaggcggaagcaaagcccccggaaaggccggtttgtccgccctgtgttgtttaaaggggatagacgaccttggagcgccccgccccctcccgccaaggaaggaccccattggctctccccggaggcttcactctcattggtcagcgagtgaatgccgacctgcagactggggcctaagtttcttttagtttccggtgtctctgcaatggcggctctagactccctgtcgctcttcactagcctcggcctgagcgagcagaaggcccgcgagacgctcaagaactcggctctgagcgcgcagctgcgcgaggccgctactcaggtgcgagcccctctgcccccggcctggtttgcagaccatgctgcaacgcagcgcggggcggggtccagatcccgacctgccccgtttgtcccgccctttcctctcactgagcgcggggcttctctcttgacccctctgacctcaggctcagcagaccctgggttccaccattgacaaagctaccgggatcctgttatatggcttggcctcccgactcagggatacccggcgtctctccttccttgtaagctacatagccagtaagaagatccacactgagccccagctaagcggtgagacccctacctgtcctgccagttcgcaccaatgcctcccttcagccaagacccctgtcttccctttttgccaagtcctccagtttctttctagacacctagttctgcacaggcactgaggcatggaaggggtggcctatggtgagactgacacgggaactgtcagggtctgaggggggatccactctcgacacgtgcttctttcttccctgtgttctctagggtggtggtgccagggcttaacttttcaggaggccagactatccttggagtttcatgagattaggaccctgtctgtccacttcttggagcagagatgccacaaactcacgggctctttcttctcagctgcccttgagtatgtgcggagtcaccccttggaccccatcgacactgtggacttcgagcgggaatgtggcgtgggtgtcattgtgaccccagagcagattgaggaggctgtgagtctttccccaggcatcgtctgcctccccagtcctggccatggaaaggagtggctcagtttccctcctcaggaagacccagagtgagggtgtgggttcccagaatatctctaaaggtggctttcctgaaccacatggtttggctttctgcaggtggaggctgctattaacaggcaccggccccagctcctggtggaacgttaccatttcaacatggggctgctgatgggtgagcagggcctggaacggggctatattgttctctctggtcatgccttttcttctgggcacgagtgagaaggaggtgggggaaggaacaggagtgacttaaagtggtctggctgggctcaggctctggttctggtggtcagccaggacctttccttgggaaagaggtggggggagtactcttttttgcctttctgcagctccttgtgcctatgcttctaggagaggctcgggctgtgctgaagtgggcagatggcaaaatgatcaagaatgaagtggacatgcaggtgagcgtgcttcactaagctgaagctggcaaagactctggcatgaacagagcctggaatccactaagggataaaaggcaggaagagggctgggcatggtggctcacgcttctgatcccagcactttgggaggctgaggcaggaggattacttgagcccaggagttcaagaccagcctgagcaacatattgagaactcctctctacagaaaatttaaaaattagccagacatggtggtgtatacctgtagtcccagcaatttgtggggctgtggtgggaagattgcttgaatctaagagatcaaggctgcagtaagctctgattgcaccactgcactccatcctggagtacagaatgagaccctgtctcaaaatcaacaacaataaaaaaaggtgggagggggctgggcatggtggctcacacctgtaatcccaacactattgggaggctgaggtgggcagatcacctgaggtcaggagtttgagaacagcctggccaacatggtgaaaccccatctctacaaaaagtacaaaaattagctgggtgtggtggcgggcacatgcagtcccaggtactcagaagggctgaggtaggaaaatcgcttgaatccaggaggcggaggttgcagtgagcggagactgtgccattgcattccagcctgggcaacatgagcaagactccagtctgggcaacaagagcaagagcattttaagctagcagacccacatgagaagagatgggatgggctaggtaggttttttcagtcagtgctggtagataggccaggaagccttgggttggtgggtaggatcagtcaggggctccttgaaagaggatactcctgcctctgcctgattctggtctctgctcaggtcctccaccttctgggccccaagttggaggctgatctggagaagaagttcaaggtagggatgggcatggccctgagtccctgagggtgaggtgaggtatggtgagacttcaggctggggaaggaagtgtctgaccacagggatcccaagaccctatccaagagaaaatttgatgccattttctgaagcacctggggcttctttcaggtggcaaaagctcggctagaagaaacagaccggaggacggcaaaggatgtggtggagaatggtgagaagcttgagactcctgtcacagcattcagctccctgacttctgaacctcctcagaagagtccttacaggctcctcaggcccttggcttactcagtaccctgacttctgtctcaagactgggattcctggtgtttcttttgttccctttgcccagagactggcatgagaggcctcagatgtctggctctagatatcttgtctctggaattgagggaataggggtctactcagttctgttctggctgtaggatatggtaaatgtatctagaggacaagttttccttgttttgttccccacaggcgagactgctgaccagaccctgtctctgatggagcagctccggggggaggcccttaagttccacaagcctggttagtgggcatgtcaaaaccctggggagggctggatcttggcagcagctcctatagtcaggcccctggggtcagaggctttggctgcagcctggtccttaggcttattctggtcctggcaggtgagaactacaagaccccaggctatgtggtcactccacacaccatgaatctactaaagcagcacctggagattactggtgggcaggtgtgtggggatgtggccatgtgagcttgtgccatcaaacacctgcctgagtgcctgggctgcgtccatactgccccatctcacccatcaccatggccttcctgggagggaacatctgtttctttaaggtcatctgagctcagactttatttctcttttcccatcccccttattttaggtacgtacccggttcccgccagaacccaatggaatcctgcatattggacatgccaaagccatcaatttcaactttggctatgccaaggtaagcatgtgtctagggacctggcaagcaagatgaccacttgctgttcccatgagtggataccatatccctgccttgctgtctgctcccaataatgtacccaggtgggcagaggccatggaaaggaaccacatgtgtgacagatacctaggaatctattgagcttattggaataaatagctccctccctctgaggagtcagtgagttcaaatttgggggagttgccagtgcagtccctaggcttagaaagatgctaggttagatacaggaaggtgagagaagctcttgaagacatttttaattctgacatgagtccgggttgggtggctcacgcctgtaatctcaacacttcgggaggctaaagtgggtggatcacttgaggtcaggagttcgaaaccaatctggccaacatggtgaaaccccatctctactaaaaatacaaaagttagctggccatggtggcacacgcttgtagtttcagctactgggaagctgaggcaggagaaacccaggaggtggaggctgcagtgagccaagatggtgcaagataatcaagactccatctcaaaaaaaaagaaaattctgacatgagagtgctctgtgaatatcctagtttgataaacaggattgtggggctgatggatgatgtgggagttcacagatggtgcaactttcctaggccaacaatggcatctgttttctgcgttttgatgacaccaaccctgagaaggaggaagcaaagttcttcacggccatctgtgacatggtagcctggctaggtatggactaggcaaagcctagaagggctggtggttagtgggcctctccttgggccatggcctgcccactgggtgtttgtggctggctgctcatactttgtttcattttgccccaggctacacaccttacaaagtcacatatgcgtctgactattttgaccagctatatgcgtgggctgtggagctcatccgcaggtaaggccagggccatgacgtagagccaggcagactgactaggtcacagccatgctgggcactcacaccgcttccccacaggggtctggcttatgtgtgccaccagcgaggagaggagctcaaaggccataatactctgccttcaccctggagagaccgtcccatggaggagtcactgctgctctttgaggtggggtcctagaggagcatctgggtttgggtgggccaaggtgctgagaatgagatgctcctgtgcttagagacagcctgagtccttgttcccctcaggcaatgcgcaagggcaagttttcagagggcgaggccacactacggatgaagctggtgatggaggatggcaagatggaccctgtagcctatcgagtcaagtatacaccacaccaccgcacaggggacaaatggtgggtgtagaatggggtggggtggtggggctgccgagcagggcgatgggccatggggtagggcagagtagggctggatggtagggcccactgcctatgccccacaggtgcatctatcccacctacgactacacacactgcctctgtgactccatcgagcacatcactcactcactctgcaccaaggaattccaggcccggtgagggagctgggtccatggggtggtagggccagtggaattccagcagcccttcctgtggtctctgcctggttccagagctggccagtgctaaccctactctcccaccccagacgctcttcctacttctggctttgcaatgcactggacgtctattgccctgtgcagtgggagtatggccgcctcaacctgcactatgctgttgtctctaagaggaagatcctccagcttgtagcaactggtgctgtgcggtaggtgcggctgtttggcttatgaaaggttaatggcatatgctcccaaaggccttctcaccaccttcttatccacagggactgggatgacccacggctctttacactcacggccctgcgacggcggggcttcccacctgaggccatcaacaacttctgtgcccgggtatagcccagcaggttgggtagatacattgggggttgagtgtggcagtttgtgattgtagctgtgactgatgctgaactttcctgccaggtgggagtgactgtggcacaaaccacaatggagccacatcttctagaagcctgtgtgcgtgatgtgctgaatgacacagccccacgagccatggctgtgctggagtcactacgggtcatcatcaccaactttcctgctgccaaggtgggcctgcctcaacatgtgtgtcacatgtgtgtgtgtagctgggggtacacttggctctgggcatgggggtcctaatgctgagtatgactcatacctgtctcctgtctcctgctatagtccttggacatccaggtgcccaacttcccagctgatgagaccaaaggcttccatcaggttccctttgcacccattgtcttcattgagaggactgacttcaaggaggtaaattgtgggggtggagggtcccgtttgctgctgagtctggtactgggaacctttcatctcctcatctctgtcagtccatctacttcctgcttcagatgaaccaatctttgccagacacgggggtagggaagcttccccacttgtttgacccttgcagcctcatgtgtctaccccacttcctatctctaggagccagagccaggatttaagcgcctggcttggggccagcctgtgggcctgaggcatacaggctacgtcattgagctgcagcatgttgtcaaggtgagagccagctgcagccttcctactgcagtgcctgctggggccaagatgtgagtatagcctgcagtcctggttgtggttcccgggtctaattgctgctcccctccccccacttccagggccccagtggttgtgtagagagtctggaggtgacctgcagacgggcagatgctggagagaagccaaaggcctttattcactgggtgtcacagcctttgatgtgtgaggttcgcctctatgagcgactgtgagtgaacagagctggggtgggggcaggtacaagatgcacattgcctgctatggctgcccagctgggggtatgaccttcactttggctgcagattccagcacaagaaccctgaagatcctactgaggtgcctggtggatttttaagtgacctgaacctggtaggttcatgaggtttggggtgagggaggtaggcctccctggttggatggttgcctgagttccctgcctgcaggcatcactacacgtggtggatgcagcattagtggactgctctgtggccctggcaaaacccttcgacaagttccagtttgagcgtcttggatatttctccgtggatccagacagccatcagggaaaggtgcttgactttactcacctgccctcatctgcagcagtgacagtggctgccgttcattgtgccaagtgctctgcatacattcccttagttaatcctcaccacctgagggagttggtattcatattctactagtgaggaaactggcactgaggataactccaggcacaaaattttgtatgaaggctgcctttttttttgagacagtcttgcactgtcgcccggggctggagtgcaatggcaccatctcggctcactgcaacctctgcctcccaggttcaagtgattctcctgcctcagcctcccgagtagctgggattacaggcgcctgccaccacacccggctaattttttgtatttttagtagagatggggtttcaccatgttggccaggatggtctcgaattcctgacttcatgatctgcccgcctcggcctcccaaagtgctgggatcacagtcatgagccactgcacccgacctcttttttttttttaattattattttttgaggcagggcatggtggctcacacttgtaatcccagcactttgggaggccaaggcaggctgatcaccagaggtcagggcttaccaccagaggtcaggagttcgagaccaccctggccaacatggtgaaacacccgaaagatattatttttaatatctttcgttaaggcagctaataacctttctttttatttattttagagacggggtcttactcttgcccagggtggtgtgaagtggtgcaatcatagctcactgtggcctcaaactactgggctcaagctattctcctgccttagctgagactacatgtgcacactaccatgcctggctaattttaaaactttttgtagaggcaagttctcactatgttgcccaggttggtcttgaattactggcttcaagcagtcctcctgtctcagcctcctagagtgctgggattataggcatgagccactgtgcccagccaccctgccatccttttttttttttttttctttttttgaaacagtatctcgccctgttgcccaggctggagtacagtggcacgatctcggcccactgcaacctccgcctcccaggctcaagccattctcctgcctcagccttccaagtagctgggattacaggcacatgctaccacgcccggcaaatttttttttttttttttttttttttttttttttttttgagacggagtctcacatgtcgcccaggctggagtgcagtggcacaatctcggctcactgcaagctctgcctcccgggttcacgccattctcccgcctcagcctcccaaatagctgggactacaggcgcccgccaccactcccagctaattttttctattttttagtagagacggggtttcaccgtgttagccaggatggtctcgatctcctgatctcatgatccgcctgcctcggcctcccagagtgctgggattacaggcgtgagccactgcgcctggcctaatttttgtatttttagtagagacggggttttgccatgttggccaggctggtcttgaactcctgacctcagattatctgcctgtctcagcctcccaaagtgctgagattacaggcgtgagccactgcaccagcccaccctgtctttcttactccttaaagtagggggcaaacatggtggttgttataatccatataaaactataccctggacccccacggtggttgttatggtccatataatactatagcctagagccccattcagtcccttacccaaagtcacaaagttattgaggacccgggcctcctgacccttagtccctcggcttctttggcttaagaaggatgttagggggaggtgtctgtggtgaaacctgcccaggcctccctggccttgttctgggttggtggtcatccttttccctctgccctccagcttgtctttaaccgaactgtcacactgaaggaagacccaggaaaggtgtgagctggaagcactgaacctacctcatcctcctggagggtgtggctaccctcgccaccccaaattccatgtcaataaagaacagctaaattctcctagagtctgtgtgttatctctgcacttctagcatctgaaggccctgaagacatgctggtggtggtggtatgattgggggatggagatgtgccttttgcacattttgtctgtgagaatggactttcccagaacagagtggtactgacagctttgaaagcaccggtgcactttttggtgcttaaaggcaggggcctgggtaggattcataccctccgcacctggtctgagagaatggagggccctggggtgtttgtccatggttaggacccctgtgccagagggatctaaaaggtttgtttctgctggtgtggagaggcctagctcccagtctgatcattcagcatataattttttttttttttttttgatacggagttccactctagcccaggctggagtgcagtggctcaatcttggctcactgcaacctctgcctcccgggttcaagcgattctcgtgcctcagcctcccaagtagctgggattacaggcgggcgccaccactcctgaataatttttgtaatttcagtagagacggggttttgccaaattggccagactggtctggaactcctgaccccaggtgatctgcccgcctcggcctcccaaagtgctgggattgcaggcgtgagccactgcgcccaatcagcctataattcttttttatttttgagacggagtctcactcttgtcccccaagctgcagtgcaatggtgtgatctcagctcactgcaacctctgcctcccaggttcaagcagttttcctgcctcagcctcttaagtagctgggatcacaggcatgcaccaccacactcggctaattttgtatttttagtagagacggggttcaccatgttggccaggctggtctcaaactcctgacctcaggtgattcacccgcctcggtctcccaaagtgttgggattacagacttcagccaccgtgcccggcccattcggcatataatttttgagtgcctactacgtgccaggcaaagtgagatggggcatacgtgctgtggtggccttccaagttcacgggaggggaaatgggtgaccaagcactgtatgggagcggtctccctggggcctgtgcaagactggaagaggttcctgacccagcctgggcctcagaaaacattactctaacgaagtgacttctgaagggaatcacgaaagactacggggagtttgccaggataagaggaacaagggcaaaagctccgaggcaaaaagagtctacagcaggctggaagccctctgggggcagtgtaggctgctgctgaggcccgagtgtgcctgcagctttaacgccttccacattttccctgtatacaaacactaggctacccgggggcccgctttaaggtggacccaactgcggaaggctgaactcagatggcagcagacagcgggagtaccagatgctgactcctccaggaggtgagcaacctagaggcttcccaggcagggcacggctggggacgccaggcccaggacagaagtttgtggggtccaccttaagcgagaggccgagcctggccaggccccgccccgcgtgggcgtgctcgaccaaaggaggctctggcgggcgacggaaggtgggtccaaagagctagcttggagccctagccttccgagactccactactaggccaagccacggccctagctccgccccacatggagaggcgtccatgggcggagcgagccgctccataccctaggatccactatccgctctagcggccagaagcgcggccaccttcccctgctgaagcgttcactttaattttggccggtaggcagtcccagatctcgcgggatccgacgccccgattatcgcgagaggagcaatcggctcctattggctgtgagggttgaatgtaagatggcgcccagggagctgtgaggagaaaaccctgtcggtcttggagcgacgacggcagaaccagggtccctggcggtgcggcggggccggcgggtgcagcggaggcggcggcggcggcggcagtgacgtcgccgggtgagggctccagtgcgggtggggatgcggcgaagctgtaggcctgagacggggggcccaccccacacaacggcgggcgggggcgggcgggccactaccgctgggccctggagagttcggggcggctccggagccgaaaacgttcctgggctagcgcaccccgccctgtggatgggggaggggtggcccggggatttgggtgggcgcggcgcgagatggcgcgccggtgcgggcgcgcggctgagcctgtttttacgcgcgcgcgctgtgcggctctcggtgcgcgtggccgccgacgtgcgcgttcccggcccggatatctctgctctaggagctgtggcccgtgggcaaccgcggctttctggagcgcgcgcccgtgacgacccccagttttggggcgcgcgctctgatatcgggtggcggtgctgcctcgagagcgcgcaggaggcttctgctgagcagagggccggccgcggctcgttgcgctgggaaggttgaggattgggtcctttctggtctggtgacgttcccgggcatccgtggcctcggcctggagagaaaccaaccagctttgctgtctggcttgcggttccgctcctctgtgaggggggcgagattgcccgttctcctcgaagaatgccgttacttgaggcccaagtacggtgcgggtgcttgggtagggtgtttctctgcttcggaaaccaagccctcttggtttgagagggcagtgagccccttcggatttcctcaccttgtactgggctttctgccgggcagggaaggttaatattagaaggcccttgagtggtacctgcttatctttcattagaaactaatacgtccataagcgtaattcatacacgtcacctctgtgcgctccggaagggaattcgcttatgtggcccatgtgaactccgagctctaaaatgccagtttaaatccttaaacgcagcttttcttttgcgtaagtgggaggggcttactttattatattaaaggcccacctttgcctcagccaaaaagttggccttaaacaaaatggaacaacctgagaatcagtgctttaccttttttgaaattgcagaaatcccagcagaaattactaaaatctgatagtgtatcactgtaaaagtcacttttggtgtaggatttcagtccttttcagctctttttttgaccctgccgctgtgttttggtgtcaaggaagttctaggtttgttctagagaaataggcacctcttttttctaatacaaaacatctgctagtttgatttacagtcttgctcaattaagcttaaggaataggaagctaagaggaagtaaaattagccatcaaatttgataatggtggggtagttctttctaatgtactgtattgtttttaagaacaaagttaaaattattaataaaaagaggctgaggatggaaggaacttttttgttctatcttcttcagaatattagaagtcttaagaactcaggacaagcagcagaaatacatgcaacatggtgactggtgagttaaaattgttcatatcctggaagtatctgtgcacagttttttttctggtaatactgaagcattacaaatcctgtcaattctgggtgctgtcttccagaaactattaggtgctgtaaaatgaagatgtgggagaacggcatctttgaattcagccacagttcgctacttgctcagttttctcctcttaggatataagtcagtggaacccgcagatttaagcgtttgcaggctcagcttttaaacggacctaaatggttcaaagaaaagctgtaaagtttttctaggatacacttaaaattttgactttttttttttttttgagacggagtctcactctgtcacccaggctggagtgcaggggtgtgatctcggctcactgcaacctccgcctccctggttgaagcgattctcctgcctcagtttcccaagtaactgggattacaggcatgcagcaccacacctggctaattttttgtatttgtagtatagacggggtttcaccatgttgatcagactggtctcgaactcctgacctcgtgatccacccgccctcggcctcccaaagtgctgggattacaggcgtgagccaccgcgcccgaccaaattttgattaattttttaggcttgcttgttctgggttatctttatttttaactattaagcttgagatcttccttttaaattggtgtttataaatactttttctccaagtttgtcaactaagatttacttattagatgtcttccttcgggtcctctctgatgaatttttcctataactcttcgagaacctctgcagttccacatcctctctccagcttatgttgccatttcaaactaaagatcaaatagtggtttaattttcttgtaaatttgaattgctctaggaaagtaaccaaagtcaggggctctggatgtggctgcctttctttaaggcagcttcagaatcagggatgtctttccttactttggatatgcttttttttttggatatgctttcttttagtttaattagttgtggtttatacttcatgtgccatatttctttcttgtctgctttttaaatggccactcttgatctgtaagggtctctgatttctgaattagccttagaattaggtgttacatgaatacctgttcttttctttttatttttattattattttttgagacggagtctcgctctgttgcccgggctggagtgctgtggtgcaatcttggctcactgcaacctctgcctcctgggttcacgccattctcctgcctcagcctccggagtagctgggactgcaggctcccgccaccatgcctgtctcattttttgtattttttagtagaaacggggttttactctgttagccaggatggtctcaatctcctgacctcgggatcctcccaccttggcctcccaaagtgctgggattacaggcgtgagccaccgcgcctggcctattacctgttcttttctgttattctgttgtactgcattttgttccagatgttttaagtcctcttcagacttcacttaaatgcttcctttgtattttttcctagttattacattagattgtgatttctgttattaaattgatgtggctgcatgaagaaatggtagattaatttcttcctttgctgaaagagggaaggagtgctcctttggtctcactcttcaggccagggcaaaactgtaggtagaaatggtggctgtgtcagaaggctaatatttttctctttttctcttttctcttttttttttttttttgagatggagtttcactcttgtcgcccaggctggagtgcagtagcacgatttcggctcactgcaacctccaccttccgggttcaagcaattctcctgcctcagcctctggagtagctggaattacaggtgcccgccaccacgctgggctaattttttttttttttttttttgagacgtagtctcgctctgctgcccaggctggagtgcagtggcacgatctcggctcactgcaagctccaccttctgggttcacgccattctcctgcctcagcctcccgagtagctgggactgcaggtgcctgccaccatgcccggctaattttttgtagttttagtagagacggggtttcaccgtgttagccagcatggtcttgatctcctgacctcgtgatccgcccgcctcggcctcccacagtgctgggattacaggcgtgagccactgtgcccggctgatgtctggctaattttttgtatttgtagtagagacggagtttcactatgttggtcaggctggtcttgaactcctgacctcgtggtctgcctaccttggcctcccaaagtgctgagattacaggcgtgagccactgcgcccgcccatgtttttctttgttttaaaatttgtgaaatatttatccatccatgtaaatttaggcgatctctgtacaatttaatgacaaattataaagtaaatgctggcgaaagtactactttttcaagaaataaaacgatgccagtatctctgaacccttcgtgggtcccttcctgatcacagcttctcaagccgtacagacagctgttattctgtgataacattcttcttctttttacatttaccatctccgtagcccttaacctagtttagatttgtttccttatgagttttgtataaatggagtcatgctgtattatgttgtcttagcataatgtttctgaaatttgttcacattgtgtgcagctgttcatttccattttttatgtagtattctgttgtatgaatacaccataaggtatttatctattccactattgatagatatctgggttgcttccagcttttggctcttaacaatgctgctgtgaacattcttgtattaagtacccttgtttaaaaaaaagttccttcatatatactgatgggtaaaattgctcaggttcgtggaatggatattttcagcttcactagataatgcaagtggttgtgccagtttacaatccgtcaatatttgggaaaaatacaaattttagtttcctgattgaaaatagaaccatggccgggtgcagtggctcatgcctgtaatcccattactttaggaggccaatgcgggcggatcacctaaggtcaggagttccagaccagcctggccaacatggtgaaatcccgtctctactaaaaatacaaaaattagcagggcatggtgatgggcgcctgtaatcccaactactcgggaagatgaggcaggagaatcgcttgaacctgtaggcggaggttgcagtgaactgagagggcaccattgcactccaagctgggggacagagcgagactccatttaaaaaaaaaaaaagaaaagaaaaaaagaaaatagaaccgtgatgaaaatgcccctaaaccagggactcctctggcatggggcatataaatggcctaatgggataacttctatcacaaaccctgcagttggctagtatccttaaaaatcgaaatatgggtggaacacagtgcctcatgcctgtaatcccagcagtttgggaggccaaggtgggaggattgcttgagccccggagttggagaccagcctgggcaagatggcaagaccccatttctacagaaaaataaaaatagctggatgtggtagcatggacctgtagtcccagctactcgggaggcagaggcaggaggattgtttgagcccaggagtgtgaggctgcagggatctatgaatgcaccactgcattttatcctgggtagtggagcaagaccttgtctcattaaaaaaaaaaaaaaaaaaaaaacagacaaaagcctggtgcagtggctcaggcatgtaatcccagcactttgggaggtcgaggggggccgtggaaatgaactcctcacctgaggtcaggagttcgagaacagcctggccaatatggtgaaaccccgattctactaaaaatacaaaaaaattagctgggctgggtggcgtgcgcctgtagttcaagctactagggaggcttgaggcaggagaaccacttgaacctgggaaacggaggttgcattgagccgagatgatgccattgcactccatcctgggtgagaaaacgagacttcgtctcaaaaaaataaaaatacaaagaaacaaaacccaggcaaaagaatagaaatacgtcaattctggtcgggcacggtggctcacgcctgtaatcccaccactttgggaggccgaggcgggcagatcatgaggtcaggagatcgagagcatcctggctagcacggtgaaactttctctctactaaaaaatacaaaaaaattagctggatgtggtggcgggcgcctgtggtcccagctacttgggaggctgaggcaggagactggcgtgaacccgggagacagagcttgcagtgagccgagattgtgccactgcattccagcctgggtgacagagtgagactctgtctcaaaaaaaaaaaaataaatgaaataaaatgaatatattcacatggaaaaaaaatcaatttccattttaaggagtcatgtctgtcttataaacatatggagttatttcaaagaagcatagaagacattgttctttttttttttttttttttttgagatgaacctccgcctcctgagttcaagcaattcttctgcctcagcctcccgagtagctgggactacaggcgcatggtaccccgcctggctaatttttgtatttttagtagagatggggtttcaccatgttggccaggctggtcttgaactcctgacctcgtgatatgcccgactcggccttccagcgtgctaggattacaggcatgagccactgcacctggcctatttttttatttttattttttttaaatttatttttcttattattttttgagatggagtcttgctctgttgcccaggctggagtgcagtggtgcgatcgtggctcactgcaaccttcgcctcccgggttcaagtaattctcctgcctcagcttccctagtagctgggactacaggcaccacacctggctaatttttgtatttttagtagagacagggtttcaccatattagctaggctggtctcaaactccttgtgatctgcctgcctcagcctcccaaactgctgggattataggcgtgagccactgtgcctggcctattttattttatttttttgagacagagttttgctcttgttgcccgggctggagtgcagtggcgcgatctcggctcactgcaacctccggctgctgggtgcaagtgattctcctgcctcagcctcccgagtagctgaggttacaggtgcccaccaccacgcctggctaatttttgtgtttttggtagagatgggatttcaccacgttggccagactggtcttgaactcccaacctcaggtgatccgcccacctcagcctcccaaagtgctggggattacaggcgtgagccactgcaccgggccccatatgaatgtattcaaactggactaagctatgaagagccattgttggagtagatgtgaaccttgaggggcctcaaagcccaaggaagaggtaaggttctgaggcagttcagacttcttttagtccatcacggattgaagactcactctgcagagccatacagggggcccaaaagaggtatcagggataagaaacccaagaaacagtgattgcaataagatcttcccttggtacctaaacggaaaaaagaaaaaaattagcaaacagacctatagaaatgtaatagattgttgttttggagtaacctttgtccatggtaccatcttatgttctaataataaaataataaaaataataactcatgtagtgaagaattgctgtgcatcaggcactatgctaagctccagtaggaggaaatacagaggagccaggcgcagtggctcacacctgtaatcccagttttgggaggctgaggatcacgaggtcaggagatcgagaccatcctggctaacacggcgaaaccccgtctctactaaaaatacaaaaaaattagccgggcgtggtggtgggtgcctgtagtcccagctacttgggaggctgaggcaggagaatggtgtgaatccaggaggtggagcttacagtgagccgagatcgcaccattgcactccagcctgggcgacagagtgagactccatctcaaaaaaaaaaaaagaaaaagaaaaagagggagatacagaggagataccagtgaacaatttgattttataccagcaaaaatgtccagggtctgtttaagggagggctggctttcctttattgttacttatttttttttttttacaatgcagctatatttaaaagcgtttagaagtaaatgcttgtttacagacctcatacaccccaagagcattagagtattttcttttttcattattagtctcatcagagtcccagaaattgggaacactcagatatcctcatggctgcatgtttttcagaaatactttaattaatttctttattgcttcttactaagtcttttacttggagctaattaagaatcttttgtctcttttagaagtttctccatttctctttattacgaaggctcaacttttgtgtcttatgtgcagcatcttgaagttaagtcttcattattttgtacaagtttttggtattttatggtttagtttctttttcttttttttttttttgagatggagttttgcccttgttgcccaggccggagtgcagtggcatggtcttggctcactgcaacctccacctcccaggttcaagcgattctcctgtctcagccttccgagtagctgggattacaggcacgtgtcaccacacctggctaattttttttgtatttttagtagaggcggggtttcatcatgttggtcaggctggtctcaaactactgacctcaggtgatccacccacctcggcctcccaaagtgctgggattacaggtatgagccacctcgttcggcaggtttagtttctttcagattttgaaagaaaatcgtactatgatcaaccagaattacgtgtctgttaccattactacactataaccacttgtatttttagtagagatggggtttcaccgtgatagccaggatggtctcgatctcctgacctggtgatccgcctgcctcggcctcccaaaatgctgggattacaggcatgagccacctctttcggccggtttagtttctttcagattttgaaagaaaatcatactatgatcagccagaattatgtgtcttaccattactacactatagccactgtgtagaaaaagatgatttttttttttttgagacggagtcttgctctgtcgcccaggctggagtgcagtggcacgatcttggctcactgcaagctccacctcccagattcacaccattctcctgcctcagcctcccgagtagctgggactacaggcgcccaacaccacacccggctaatttttttgtatttttagtagagacggggtttcaccgtgatagccaggatggtctcgatctcctgatctggtgatctgcctgcctcggaaagtgctgggattacaggcgtgagccttagattaataccacttgtggaaaattcagaagagtgtttaacagaagaaacttaattactctgtggttccatcatctaggcataactactgttagcattcctttttatcattttttgaggtggagtctcactctttccccaggctgaagtgcagtggcgcagtctcagctcactacaacctccgcctcccggattcaagcaattctcctgcctcagcctctagagtagctgggattacgggtggctgccaccatgccctgttagtttttgtatttttagtggagatggggtttcaccatgttggccaggctggtctcacaatcttggctggatgtgatggctcacgcctgtaatcctagcactttgggagaccgatgctgtggatcgcttgaggtcaggagtttgagtacatcctgaccaacatggcgaaatcccgtctctactaaaatacaaaaattagctgggcatggtggcgggtgcccgtaatcccagccactttggaggctgaggcaggagaattgcttgaacctaggaggcggaggtttcagtgagccaggatcgtgccactacgctccagcctgggcgacagagcaacactgtgtctcaataaaaataaaaataaaaaagaatttaggctgggtgtggttgctcatgcctgtaatcccagcactttggaaggtggaagcgagtggattacctgaggttaagagttcgagaccagcctggccaacatggcaaaacctcatctctactaaaaatataaaaattagccggatgtgggccgggtgcggtggctcatacctgtaatcccagcactttgggaggctgaggcgggtggatcatgagtttaggagttcaagaccagcttggccaagatggtgaaaccctgcctctactaaaaatacaaaaattagccaggcacggtggcaggtgcctgtaatcctagctactcgggaggctgaggcaggagaatcgcttgaacctggggggcacggaggttgcagtgagccaagattgtgcctcctgggttcaagcgattctcctgcctcagcctcccaagtagctgggactacaggtatgcagcaccacacctggctaattttttttttttgagatggagtctcactctgtcacccaagctggagtgcagtggcatgatcatagctcattgcaggctcaaactgctgggatcaagccatcctatcctcctgcctcggcctcccaagtagctgggactacaggcgagaaccaccatgccaagcttagtattgatattttctaatggttttatggaatttttcctacctcaagcttgtttgtcttttaaattattactattatttctaagagatgggatctcactgtggtgcccaggttggagtgctgtggctatccacagacaggattctactactgcagtatggaagttttgacctgccccatttccaacctggggtggttcacccctctttaggcaacctggtgattccctgctcccttgaagtcaccatattgatgctgaacttagtgtggacacccgattggcatagagcactatagcccagaactcctggactactcaagcaatcctcctgtttcagtctcttgagtagctgggactgcaggcatgcaccatcatcccaggctcccccccccccttttttttttttttttgagacagagtctcactttgtcgccaggctggagtgcaatggtgcgatcttggctcactgcaacctccgcctcccaggttcaagcgatcctcctgcctcagcctcccaagtagctgggattacaggcatgctctaccatgcccaactcattttgtatttttagtagagacgggggttctccatgttagtcaggctggtctcgaactcccgacctcaggttatccaccttccttggccccccaaagtccatagtgctaggattacaggcgtgagtcaccacacctggcctttttttctttttttttttttttgagacgcagtcttgctctgtcgcccaggctggagtgcagtggtgtggtctcggctcactgcaagctctgcctcccaggtttacgccagtctcctgcctcagcctcccgagtagctgggactacaggcgcctgccaccacgccagggtaattttttgtatttttagtagagacagggtttcaccgtgttagccagggtggtctcgatctcccgacctcgtgatccacccacctcagcctcccaaagtgctgggattacaggcgtgagccaccgtgcccggctttttttttctttttttttaaatggaaggcttaaagaatggattttgatggtttatagcaagtaactttttgaagcttttattttttctgacagctgaatatctagcttatttgcctttttgctcaggaaataaatgtatatttggactagagtttcttatagtaactttttaaaggtactattctagaaatactggctggtaggatttatttggagatgacataggcagcagaattgttttaatcatatctttggaaccttgattgacaaaaaatatgttctggactttggtatgaaatgtattctaaaactaaaatattgattaaatagaagttatattcacttagctaaatgtttgtcaaaaatagaggacaccttgctgggcgcagtggctcatgcctgtaatcctagcactttgggaggttgggcagatcgcttgaggtgaggagtttgagaccaggctggccaacatagcaaaactccatctccactgaaaatacaaaaattagccgggtatgggggcaggtgccttgtaattccagcactttgggaggccaaggccagcagattacaaggtcaggagttcgagaccagcttagccaacacggtgataccctgtctctactaaaaatacaaaaattagctgggcatggtggcgtatgcctgtaatcccagctactttggagactgaggcaggagaatggctgggacccgggagacagaggttgcagtgagtagagatgacgccactgcactccaacctgggctacagagcaagactctgtctcaaaaaaaaaaaaaatagaaggcttcggccaggcatggtggctcacgcctgtaatcccagcagtttgggaggccgaggtgggcagatctcttgagcccaggagtttgagaacagcgtgggcaacatggcaaaaccctgtctctctaacaaatactgtaattagctgggcgtgatggtacacgcctgtagtcccagccgcttgggcggctcaggtgagaggaacaattgatcccaggaggttgaggttgcagtgaaccaagatcttaccactgcactccatcctgggtgatagaataagaccttgtctaaagaaaccaacaacaaaaaatcaggggtgtggaactttaatttcctgatcttacatagtgagaactccatagatactctgaaatttttttttttttttttttaagatggagtctcactctgttgcctaggctggagggcagtggtgcagtctcggctcactacaacctccatctcctgggttcaagtgattctcctgtctcagcctcctgagtagctgggattacaggaatgtgccatcatgcccggctaatttttatatttttagtaaaggcagggtttcaccatgttggccaggctggtctcgatctcctgccctcaggcgatccacccagctcagcctcccaaagtgctgggattagaggcctgagccaccgcacctggccaatactctaaaattaatgagtctgcaagtagaggcttaaaggtatgaaagtaatcataacaaaactaagaataaaaatgtgattggcagggtttggtgagaggagggtgatttttagttttttatttataatttttttaggcttttttttttttttttttttttttttgagatggagtttcgttcttgttgcccagcctggagtgcaatggcatgatgaagaactagaggtcaaagcatacttagctgtttttactttttattttatatctttttatactattataatggtttttcttagttgagtttcatatccctgtccccaaccccccaagaaacctccaaaaacaaaacaaaaactaggtggaattctatactgaatactgaagaaagcttgtttctaggaagaaaagaagaaaagtcggtgaaattatcctttacacttaatatcagagttgaggtgaggcttaagctgccccttctgagtttctgaaacttgaaatacaagagtgaggagaaatagggttactaggaggatcatagagactggctttactgggcaatagtcacgaaggtttttcagttctgtaaactttgtttgaggtgtttcttttttcttgtttttttttaaattattttttgttgttgtttttgttttgtttgatattgaattcccatctactccgttgggaagcagtgtttctttgtattggtgtttagtcatttgttttttcccagacttcagacaaaacaggtttttgctgcatgtaaaaacgctttacttttgtaccttaaaaaaaaaattgctttttatagtagctttgaaaatttaatcagtctcagtatattatgtgaatgcaactgacagttgaagaaaatacatttcaggaaatgtaaattccagctgacctctgctgctcttttataatggagatgaaaaactgaaattatgtaccagcatggtagaggacctgttaatggctgctcatataatctctcctttgtccccttttgagcagaagggtatatgtgattagatattagagtttcataactttctaatgttaccggatctctattatgaaagatgcctttttttttttttttgagatagagtctcagtctggcgcccaggctggagcgcagtggcacgatctcggctcaccgcaacctctgcctcctgggctcaagcaattctcctgcctcggcctcccgagtagctggtattacaggtgcctgacaccatgcctggctaatttttgtatttttagtagagacagggtttcgccttgttggccaggctggtctcaaactcctgacctcaggtgatctgcctgcctttgcctcccaaagtgctgggattacaggcgtgagccaccgcactgggctgaaagatgccttcttaaggaaatcgctactgtgctattaacaaaggggaactttgatacattctgtgcaagtgtggcaaatgagtgctctcggatcacctaagccaagtagccttctctgaatctgtagttaggcaaagtgtgcttggcctgatgctctctttatgtgtgatgtggacatcgttgaccacttaattattattattttattatagtattttattataattgttataatatttaattattataattataatatttttatatttatgtaaaaattatatttatattacataattgtaattattataatattttattataattatttattttattttatttatttatttcttttaacagatgaaagtctctctaggtttcccagcccaaagacctggtctcaagcaatcctccacctcagcctcctgagtagctgagactacatgtgtgcaccactgtgaccagctgataacttaatttttttgtttgtttgtttgtttgttttttttagacagagttacgctctgtcgcctaggctggagtgcattcgagtgatctcgggtcactgcagcctcgatctctgggctcaagcaatccttctaccttagcctccgtagtagctgggactacaggtgcataccaccatacccagttaatttttatatattttttgtagagatggggtttctccatgttgcctgggctgaggtggaaggattgcttgagtccgtggagctatggatattacagaaaccaattgggtggctcacgtctataatcccagcactttgggaggccgaggcgggagggtcacctgaagtcaggagtttgagaccagccaggccaacatggcaaaacccagtctctactaaaaatacataaattagctgggcatggtggtgggcacctgtagtcccagctactcgggaggctgaggcaggaaaatcacttgaacctgggaggctgcagtgagccgagatcgtgccactgcactccagcctgggcgacagagggagactccaactcaaaaaaaaaaaaaaaaaaaaaggacaggtgtggtggctcacgcctgtaatctcagcactttgggaggctgaggcaggcggatcacgaggtcaggagatcgagaccatcctggctaagatggggaaacctcgtctctactaaaaatacaaaaaaattagctgggcgtggtggtgggcgcctgtagtcccagctactcgggaggctgaggcaggagaatggtgtgaacccaggaggtggagcttgcagtgagccaagatcaagccactgcactccagcctgggcaacagaatgagactccatctcaaaaaaaaaaaaaaaaaaaaaaaaaaggaaccataattcttcgttttccacattgaatttcaaatgcagcaggtatatatgaagcaactaccatgggtgagctattcggagagaaccaggacatagtcttgtctaccaagaacttagagcctaggtagaagaaaggagacgtttacccacatattttatatctgtaacataaggtagagcatctggtcagtctagtgtatctatcctgattgctcaagggaacaaatcacctttccagacattcagaattgtctgataatcctttttggcaaaaacgttcgcttgttttctgttactctttcatcctgctgctacttttgttctggaggtcgggctgttgaagggaggatggtacaaaggtagcagcgacaggggtcagcagtccacagattgcacacttttccctcagatgatgagagttaactgtacgtctgcaggttaattcttaaggtaattaaatacctgatgaaaacttgtagaatttatttctgaattttagtagtgacctggatatttaaagcactatttaccttttttccagaattattttaatagtattagttacatttctgtagtgctatctatgtgctagatgattttctaaatgccttatttaatccttatgtcaactgtgaggtaagtactattgtgtccccatttactcacaagaaaactaaggttaattgacttttctagagttacataataaaggagacataaagttgggatttgaacccaggcagcctggctccagagtccatgcttttaaccagtagtaagctgtgttgcaaaagaatgtgagcaccacatggcaaaataggatttttggtttttctgatgggagatgaagaacatatcctctgcctcttgtgtcttgccacaactaggtggcatacctatctctgctgtaggaaatacttggaaataaaacatatccataggaatccctgcccctagcttcctccttgcttggtgtcctctctgtgatggtcacagagcagttttgcatgtgacatttactgtccagtgcttggctctgcagagaagatgggattgacctagtgctgggtaggaagtgtgttttcagcctgtttcatccagtattgtgaagcatgtgtttgtttttttgttttcagtgtgatagttttatttaagaaatgttaatagaaataattttcaaacatccattaattgaaaaaataaggtggtataataaaactttattttttgattctatatgtatacagctgccctgaatatattccactcttgtgcaagggtaattgcttctgggcatttcctgctaaaaacagtaacataattttgacttctgtttatttctaggaaccctaaggactctgcaatatgaataattccctagagaacaccatctcctttgaagagtacatccgagtaaaggcacggtctgtcccgcaacacaggatgaaggaatttctggactcactggcctctaaggggccagaagcccttcaggagttccagcagacagccaccactaccatggtgtaccaacagggtgggaactgcatatacacagacagcactgaagtggctgggtctttgcttgaacttgcctgtccagtcaccaccagtgttcagccacaaacccagcaagaacagcagatccaggttcagcagccgcagcaggttcaggtatatgggaaatgctgaggtgcagcctgtttaatgtactttatttgttgtcagtgttttagttagtgggctcatcacatctatgtggatgttataggttatttaacactaagattttcaaagttaatgtggactaaaagttttttctttcttctcctttttctttaagcttttttttttttttaaacaaaccccagtgtcaaggactgactttgaatagattgcagccagggatctgcttagctacctaggaaaccccaacccagaagcgggtcatctatgattggtttagcatcaggttcaacgtgacttgcgtgatgagtgagggggcgccacctttctggcagcaccttttcccaggatgaggggctctccacaccggaacccggtcccggcacgtgaccccgccggcggcgatgtcagtgatggtgggggactggctttccgaggctgaccaacactgtggtgctgccatgtcattgtacttgggttgttttctttgtttgtttcttctttttttgagatggagtcttgcactgtggtccaggatggattctcctgccccagcctcctgagtagctgggattccaggtgcctgccaacacactcggctaattttttatacttttaatagagacggggtttcactatgttggccaggctggtcttgaactcctgacctcatgatccacctgcctccttatccaaaagtgctgggattacaggcatgagccaccgcacccggccacacctgggttgtttttttcttttcttttttgagacagagtctcattctgtcacccaggctggagtgcagtggtgcattcttgcctctgtcccccgggttcaagctattctcatgcctcagactcctgagtagctgggactacaggtgtgcactaccaccctcagcaatttttgttgtatttttaatacagactgggtttccccatgttgggcttgaactccagacctcaagagatctgcgtgccttggcctcccaaagtgccaaagtgctgggattactggtgtgagccaccatgcccagccttttttttgtttgtttgttttttctttgagttggagtttcgctcttgttgtccaggctagaatgcaatggagccatctcggctcactgcaacctgcacctcttgggttcaagcgattctcctacctcagcttcctgagtagctgggattgcaagcatgtgctaccacgcccggctaatttttgtatttttagtagagactgggtttcaccttgttggccaggctggtctcgaacttctgacctcaggtaatctgcccttctcgggctcccaaagtgctaggattacaggcatgagccacggcgcctgactttttttttttttttttttgagggacagggtcttgctctgtcacctaggctggagtgcagtggcacgatcactcctcactgcagctttgacctccaaggcttaagcgatcatccagcctcaacctccaagtagctgggaccacaggcatgtaccaccacgtgcagctaattaattaattttttttttttttgtagagatatagtctccctatgttgcccaggctggtcttgaactcttggcctcaagatattctcctgccttggcctcccaaagagctgagattacaaatatgagctgccatgcctggccttaaaaatattttcgagtactgtaaactaaaaacaccacagatatttggtcttttttatttaagatggagtctcgctctgttgcccaggctggactgcagtggtgcaatctcagctcactgcaagctctgcctcccaggttcacgccattctcctgcctcagcctcccaggtagctgggactacaggcagctgccaccacgcccagctaatttttttgtgtttttagtagagacggggtttcaccatgttagccaggatggtctcgatctcctgacctcgtgatccacctgcctcggcctcccaaagtgctgggattacaggcatgagccactgcgcctggcccaaatatttgatctttgctgtggagagctgaatagttttgaaattagagatcttttggtactgggtttaggtgtgatagcttcatatgactgaggcttcctttcttttcttttgtattttttcctgagatggagtctcgctctgtcccccaggctggagtgcagtggtgtgaccttggctctctgcaagctccgcctcccgggttcacgccattctcctgcctcagcctcccgagtagctgggactacaggcgccagccaccatgcctggctaattttttgtattttaagtagagacggggtttcaccatgttagccagcatggtctcgatctcctgacctcatgatccgcccacctcggcctcccaaaatgctgggattacaggtgtgagccaccacgtccatctgaggcttcctttctatttgtgtcatcctgaatagagacagaacacaggagggctggtcttggctgattactgatagtgtaacatttgaaattaatttaaaaatggaaaggctgatgtatttcagtgatcttcattaacttgtgtgattccataactcagattacgtatggatttctgggtctgtgtttgttgtttctaaaccacaaaacggctaagtgcatttgtgaatgcctgtaatcccagcactttgggatgccaaggtggacggatcattgagtccagaagtttgaggccagcctgggcaacatggcaaaaccccgtctctacaaaaaataaaaaaaaattacccagggatggtatgtacttgtagtcccagctatttgggaagctgaggtgggaggattgcttgagcccaggaggttaaaaccagcctgggcaacatggtgaaaccctgtttctaccaaaaataagaaaaaattagctgggtgtggtgatgcacgcctatggtcttagctactagggaggccgagatgggagaatcgcttgagcctgggaggtggaggttacagtgagctgagatcgtgccactgcactccagcctgggtgacagagtgagatcccatctcaaaaaaaataaaaataaaaattgtaaggcacaaaaaaataatgctaattgatgataaactttctgaaagacgagaaactagtacatttgttgagaaggtaaaatgttttcctttttttttttttcgagatggagtcccactgtgtcacccaggctggagagcagtggcgtgatctcagctcactgcaacctctgcctcctgggttcaaacgattctcctgcctcaacctcctgagtaggtgggattccaggcacctgccactgtgccggctaatttttgtatttttagtagagacagggtttcaccatgttggtcaggctggtcttgaacttctgatctcaggtgatccaccggccttggcctccaaagtacaggtgtgatccaccgtgcctggccaaagttttcctctttagaggtctttatgtgagataacaggctcctctagttgcaaatgcagttttcttgccattgtctattatggtttaatttcattgtattctggaagtctttttatactaagaggataggaaagggactgaaacatgctggagaggcaggagtatggagaggtgtgcctggtgagatagaaggtttccctttccttcattttttctgttttttttttaagagacaggatttcacttgcccaggctggagtgctgtgacatgatcatggctcactgcagcctctacctcctgggctcaggtgatgctctcacctcagcctcccgagtagctaggactacaggtgcgtgccaccatgcccagctaattttttcatttttggtagagatggactctcgccatgttgctcaggctggtgttgaactcctggcctccagcagtcctcatggctcagcctcccaaagtgctgggattataggcatgagccactgttcccagctgaagtaggtttcactgtagctcctcaaaaatgcagacgagtatattggaaggacatagcctctgaagcttcagtactgggtttaaatttgacttgaccactcaattgttggcatgagcttattaatctttacctccagtttgttcatcagttaaataaggataataccatttaatgagactgaataagataataaagtatctggcatatggagagtttttttttttttgtaatggagacagggtctcattctgtcacctaggttggagtgcagcggtatgatcttggctcactgcaaccccagcctcccaggctcaagcaatcctcccacctcagcctcccgagtacatgggaccacaggcgcacaccaccaacacctgcctaattttttgtatttttgatagagccagaatttcaccatgttgcccaggctgagatttactcattttttatctttatatttatttacttactttttgagacagagcctcactctgttgcccagactagagtgcagtggcattattttggctcactgcaacctccatctctggggttcaagctagcacgcccgactaatttttatatttttagtagagatggggtttcaccatgttggctagggtggtcttgaactcctgactttaagtgatctgccaacctcggcctcccaaagtgctgggattgtaggcatgagccaccacgcccagccttgttttgtctttgtaaggaagaaaaggtacaggaaaggttaagtaaaagaaggctggcccaggcatggtggctcacacctgtaatcccagcactttgggaggctgaggtgagtggattccttgagcctaggagtttgagaccagcctgggcaacatggcgaaatcctgtctgtacaaaagtacaaaaattaactgggtatggtggcttgcttgtgtgatcccaggtactggggaggctgaagtgggaggatcacctgaacctgggaggtcatggttgcagcgagctgtgattgtgccactgcactctagccttttacactaaggacaggaaaggtgtctcaaaaaaagagaaaagaagtctgattttctggctcaaattattctgctgttttttacagctttgacctcctcttccttaccacgcctggccaatttttgtacttttttcagtagaggtggggtttcattcaccatgttggacagactggtcttgaactcctgaccttaaacgattcacttgcctcagcctcccaaagtgcaggcatgagccattgcacctggcccctaggctggtcttgggactcctgagttcagctgagccacccactttgtgggtgtttggattacaaatacaaagtgtttggattacaggcacaagccattacacctggccccgctttctcataagattaaagagtttggggctgggtgcggtggttcatgcctgtaatcccagcactttgggaggccgatcaggagattgagaccatcctggctaacacagtgaaactccgtctctactaaaaatacaaaaaattagccaggcctggtggcgggtgcctgtagtcccagctactcgggaggctgaggcaggagaatgacgtgaacccgggaggtggagcttgcagagagccagggtcacaccactgcactccagcctgggcgatagagcaagagtctgtctcaaaaaaaaaaaaaagtttggggatttaagtttggagtgttttttgagactttatgttcaagataaactgatgaatgcttgaacttggaaggtagaggttgcagtgaatcaagatcacaccactgcaccacagcctgggtgacagagcagactctgtctcagaagaaagaaaagccactgaccgagatcactattaacgttcgtctttctccctaaactctatgtaaatgaaagaagaaacaaatataatgacatccatgagatagattcagtgtgatagaatcataagaatgtatgttttccctaagtgactaaaaagatacttttaaaaaataaagaattctggccaggccaggcatggtggctcacacttgtaatcccagctgtttgggaagctgaagtatgtagatgacttgagcccaggagtttgagaccaggctgggaaacatggtaaaacctcatctctacagaaaaacacaaaaattagtttggcatggtggtgtgcacttgtagtcccagctactcagaaggctgaggaactccttgggcccaggagttcgaagttgcagtgagctgtgatcacgccactgcactccatcctgggcaaaagtgcaagaccctgtctctataaaaaacagaacaacaaagcatttttaagagtgttggaaaaaatgaataccatttaaaaaccactaaatctaagaaattgataaaagagaataagtagacagaattaggtgatgaaaggccaggcgtggtggctcatgcttgtaatcccagcaccttgggaggctgaggcaggcggatcacctgaggtcaggagtttgagaccagcctggccaacatggtgaaacctcatctctgctaaaaaatacaaaaatcagccgggcatgttggcaggtgcctatagtcccagctattcggaggctaaggcaggagaattgcttgaacctgggaagccaaggttgcagtgagctgagatcgtaccattgcactccagactgggcaatgtgagcgaaactctgtctccaaaaaaaaaaaaaaatttggtgacaaatgcgtgtaggaaagaacttttggggaaagtggggcagttcttagagtgccctaagctgagaagtagaggatacacagagtagaggtccactggggtagctttagaactaaaggttgggaattgactagagacttcaaaacacacacatacacatatgtatacttacagctcacattaccttgatgagcaagttagagatacattagtttgatgataattgttactgctcttttgagtaagaatcataggctgggtgcagtggctcatacctgtaatctcagtactttgggaggctgaggcaggaggatcctttgagttcaggaattcaagaccagcctgggcaacatagtgagactttgtctgtactaaaaataaaattagccagatgtagtggtacacacctgtaatcccagctactgaagaggctgaggtggaaggatcgcttgagaatactttatctcaaaaaaaaaaaaaaaaaaaaaattcccccccatggatctgtattttcgccagccttttagagtgctctttgtggtcccctcgcccacacagattatcaactattaatgcaagttataagtgtaattggaggaaacgtcctttttttctgtaaaaaataattttcagctgtgtgtggtggctcatgcctctaatcccagcactttgggaggacaaggcgggtggatcacgaggtcaggagttcaagatcagcctggccaagatggtgaaaccccgtctctactaaaaatacaaaaaagtagccaggtgtggtggtgggcacctgtaatcccagctactcgggaggctgaggcagagaattgcttgaacccgggaggcggaggttgctgtgagccaagattgcgccactgcactccagcctgggcgacagaacaagactatctcaaaaaaaaaaaaaaaataataataataataataataataaattttctacttgaggcttttttgccttattcaagtagttctaaaagtcttatcacaaatttctaacctacaggatgctagagagatggtttgtgctatatgatacctgcaagagtagttttattcctttctactttaaattttagccaagtttggccgggtgtggttgctcatgcctgtaatcccagcattttgggaggccaaggtgagtggattgcttgagctcaggagttctagaccagcctaggcaacatggcaaaactcccatctctaccaaaaatacaaaaaattggccaggcatggtggtgcatgactgtgatcccagctactcaggaggctgaggctggaggatcacttgagcccaggaagcggaggttgcagtgagccgagatcgtgccactgcactctagcctgggcaatagagcacagaccccatcacaaaaaaaaaaagaaagaaattttagccaagcttggctctgtcatccatgctggagtgcagtggcatgatcacggctcgctgcagtctggacttcctgggctcaagtgatcctcctgcttcagtctcctgagtagcttggactacagctactacgcccaactaattttttttttttttttaatttttttgagacggagtcctgctctgtcacccaggctggaatgcagtggtgtgatcagaggctcactgcaacttcaacctcccatgcttaagggatcctcccacctcagcctcctgagtagctgggactataggctacagagtagagtggcacaatcatagctcagtgcagccttgaactcctgggcgcaattgatcctgccatttcagcctctggagtggctgggactacaggcatgcaccaccacgcctggctaatatttttactttttgtggagagaggggtgttgctatgttgcctaggctggcctcaaactcctggcctcaagtgatcctcctgccatagcctcctgatttaggattacaggcatgagcacagcacttagcacctcatttcattttaatttcaagtaaaatgtaatacttttttttaaaaaaggtgttgagagttgttatatctgaatgaaagaattgtgggttgttttttttgtttgtttccaaatttttttttttttgagacggagtctcgctctatcgcctgggctggagtgcagtggcatgatttaggctcactgcaacctctgcctcctgggttcaagtggttctcctgcctccgccttctgagctaattttttttgtatttttaggagagacagggttttaccatgttggttggccaggatggtctcaatctcttgacctcgtgatccgcctgccttggcctcccaaagtgctgggattataggcctgagccaccgcgcctggccttttgccagattcttaatatgattatttagtaattttctacccagtgaaaaagcttggctcttatataaattaaaaaaattgaagggaagtaatataaataacatttaatttcttttttgttttttttttcgagacagagttttgctctttcacctaggctggagtgcagtggtgctatctcggctcactgcaagctccgcctcctggaatcacaccattctcctgcctcagcctcccaaggagctgggactacaggtgcccaccaccacacccagctaatttttttgtatttttagtagagacggggtttcaccatgttagccaggatggtcttgatctcctgaccttgtgatctgcctaccttggcctcccaaagtgctgggattacaggcgtgagccaccgcacccagccgttaaatttactcttaactcttattcccctaattttaaattcttactattttggatataaagtgacatcagattatttgtaattttgtttatttctggagtgacggacaggtgccaccacttaggaggtggattgggaggttctaactccctagtatttctgctaacaatagccattagccacattagccatttaattgtttattttggaagcttgagcattgataagtaatttctctctctctttttttttgagacagagtctctgtcgatgaggctggagtgcagtgccatgttctcggctcactgcaacctccgccccccaggttcaagctattgtcctacctcagcctcctgagtcgctgggattacaggtgcacaccaccacgtctgggtaatttttgtatttttattagagacggggtttaaccatgttggccaggctggtctcgaactccttacctcaggtgatccacctgccttggcctcccaaaatgctaggattacaggcatgacccacctcacttggccttttaaatgatttctaagaaaaatcaattgatcagataataactcattttaaaagaagaaaaatcatctgggtgcagtggctcatgcctttgtgaaaccttgtctcaactaaaaataagaaaattagccaggcacgggtggcaggtgccagtaatcccagctactcaggaggctgaggcaggagaattgcttgaacccgggaggaggaggttgcagtgagccaagattgcgccactgcattccagcctaggcgacagagtgagactcttgcctcaacaaaaaaaaaaaaagaaaagtaaagtaaattaagaaatacagtaaagcatgaagcatatgagctatgattcagtgatagtaaccagatttttgacattttgttttaagcaagccgtattataatttaaaaacatactatgtgtttaacccaatagtagtggttctttttttttccttacccttatttttttctgagatggaggtctcactgtcactcatgccagagtacagtgacatgatcttgtgtcactgcaacctctgcctcttgagttcaagtagttctcccacctcagcctcctgagtcgctgggaccacagttggctcacaaccacgtctggctaatttttttgtattcttggtagagacggggtttcaccacattgcccaggctggtctcgaactcctgagctcaagcagtccaccagctttagcctcccaaagtgctgaggttacaggcatgagctaccattcctggccagaagtgattcacaaatggtagttcaagagactcgtaggggcctgtaatcccagcactttgggaggccaaggcaggcagatcatgagttcaggagatcgagaccatcctggctaacacggtgaaaccccatctctaataaaaatacaaaacaaaaattagcgggcgtggtggcgggtgcctgtagtcccagctacttgagaggctgaggcaggagaatggcgtgaacccgggaagtggagcttgcagtgagctgagatcacaccactgcactccagcctggacgacagagggagactccgtctcaaaaaaaaaaaaaagagagagactcctggtagcctccaagcaccttttagggttcctcaaggtcaaagctgtttttattacaatgccaatgtattaatttgcctttttcactttcattctctcctgaccatgtactggagttttgcagaggccatgtgtgatgtataatagcacaacagattgagtgcggaagcagataggagaattcagctaccttatattaagtcagccattaaataggtttgcaaaaatgggtcaggcgcagtggcttacgcctgtaatcctaacactttgggatgccgaggtgggcagatcactttgaggtcaggcgttcgagaacagcctggccaacatggcaaaaacctgtctctactaaaaatacaaaaattagccggacatggtggcatgcccctgttatcccagctacttgggaggctgaggcaggagaattgcttgaacccaggaggcaaaggttgcattgagctgagtgagccaagattgcctcactgtactccagcctgggcaacagagtgagactccatctccaaaaaaaaaaaaaagaggtttccaaaaatgtaaaacaatgcaattcttattataattattttggcaaatagttatttttcatgagaatatgttatttatgttaacatataatggctttatttttgtttgtttttttctagaacaactcttgctctgtcccccaggctggcatgagtgacacgatctccgctcactgcaacctctgcctcctgggttcaggctgttctcctgtctcagcctcctgattagctgggattacaggcatgcaccaccacacctggctagtttttgtatttttaggacagacagggtttcaccatcttgtccaggcgggtctcgaactcctgaccttatgtgaccctgcctgccttggcctcccaaagtgctgagattatacgcatgagccactgcatctggctttatctgatttttaattaattttttttgttttagtatagacggggtttcaccgtgttagccaggatggtctcgatctcctgaccttgtgatccacccaccttggcctcccaaagtgctgggattacaggtgtgagccactgcgcccagcatggtttacaattttttaaattcctagttttgggccaggcgtggtggctcatgcctgtaatctcagcactttgggaggatgcggtaggtggattgcttgaggatatgagttcaagaccaggttggccaacatggggcaaccccatctctactaaaaatacaaaaacaaacaaaaaaacagccaggcatggtggtgggcacctataatcccagctactcgggaggcagaggttaagagaatcgcttgaacccgggaagacaaagttgtacttccaagatcacaccactgcactccagcctgggcgatagactgagactcttgtctccaaaaaaaaaaaaaaaaaaaaaaaattagggccagccatggtggctcacgcctataatcccagcactttgggaggccgaggcaggcggatcacctgaggttgggagtttgagaccagcctgaccaacatggagaaactccatctctactaaaaatataaaaaacaaaaaacaacaacaaaagaaaaccagccaggcatggtggcgcatgcctgtaatcccagccactcaggaggctgaggcaagagaatcgcttgaacccgggaggcagaggttgcggtgagctgagatggcaccattgcactccagccagggcaacagagtgaaactccatctcaaataaaaaaagaattaaaaaattaaattcctagttttaatttagagtacaagtaaatattactagatataacctatgtaaacaagttcttttgggtcttcaatattttttggccaaattcaagttttttggtgttagagtttcactttgttgtccaagctggagtacagtggcacgtgccgttcatagttcactgcagcctcaatctcctgggctcaagtagtcttccttcctcagcctcccaggtagctgagactacaggtgtgtgtccacgcccaggtaatttttaaaattttttgtagagataggggtgtcactatgttgcccaggttgatctcgaactcctgggctcaagcagttttcctgccttggcctcccaaagtgctgggattacaggcatgaccacgatgcccagccccaaattcaggctttgactaagaaatcttgaaaactgctgttctgcagtaattggctacatagtttcctcttatgtctttggcatatagccctagttcttaaatttgaccatgtaattacactggaggacttgataaaaccacttcttagaatttcagagttagtaggtctggagtggtacctgacaatttgtatttctgagtgcctggatgctgctgctgctgttggcatggaaactacattttgagaaccactggtgcaaggaaataatattttacttcatggagagaaataataaacctacttatttgaacacctattatctgtaactaaatattattttatgtttaaaacactgtagggaagtagacattctccccttttatacttactgtacctaaagaaactgtttagaggttaaatttccccatggattcacaggcagaaaagtgcagcatcaattcacattgaagtctgtgatctcaaaacctgagccttttttttttttgagacggagtctcgttctgtcacccaggctggagtgcagtggcgcgatcttggctcactgcaaactccgcctcccaggttcacgccattctcctgtctcagcctcccgagtagctgggactacaggcacccgtcaccacgcctggctaattattttaatagaaatggggtttcaccatgttagccaggatggtcttgatctcctgacctcatgatccgcctgcctcggcctcccaaagtgctgggattacaggtgtgagccacagcgcccggcctttttttaaaaaatatacttagtaacagctttattgagatataagttacccatttgaaatgtataattcaggcacactggctcacacatgtaatcccagcactttgggaggccaaggcaggtggatcacttgaggttaagagtttgagaccagcctggctaacatggtgaaaccctgtctgtgctaaaaatgcaaaatttagctgggcatggtgatgcgtgcctgtaatcctagctactcaggaggctgaggcaggagaattgtttgaaccagggaggcggaggttgcagtaagctgagattccaccactgggcaacagggcaagactttacctcccaaaaaaaaaaaaaaaagcgactacaccaattttttcttgtttttttttttttctgagatggagtctcactctgtccttgactgggctgggtatagtggcgccatctcggctcactagcttccacctcccaggttcaggcaattttgctgcgtcagccttccgagtagctgggattacaagcatgtgtaaccacgcccagctaatttttgtatttttagtagagacagggtttcaccatgttggccaggctggtctggaactcctgaccttgtgtccactggcctcagcctcccaaagtgctgggattacaggtgtgagccaccgcatctggccaactacaccaatttaacatgcccaccagcagtttcaagttgtctatatccttacctatacttgttatctgtcttttttagatataacttattagatataaagtggtttctcattgtggctttgattggaatttccttcacagctagtatgatatggagcaactttttatgtggttcttggccatttgcatatattcttttttttgggagatagtttcactcttgttgcccatgctgtggtgcagtggtgcaatctcggctcactgcaacccccacctcctgggtttagtagttcacctgcctcaacctcccaagtagctgggattacaggcatgcaccaccatgcctggctagttttgtatttttagtagagacggggtttcaccatgtcggtcaggctggtctcaaactcctgacctcaggtgatccacccaccttggcctcccacagagctgggattacaggcatgagcaactgtgcctggcctcattttctgccttcttgttttctacctttctaattcctacttgtggttagggtaatttatctatgtgtctgatggtaaaagctgttttttaaaagttgcatactatgtatttttttcttttcatgctcttttgcatgctgacataataataagacagtaactgtattgttatcagaaacatgtcatccaggttatggtaatattgctcagattaaattattgggattctgtttatttaaatgcctttcccattaaacatatgttaagtaagcactctaaagcagtggtccccaacgttttttgcaccagggactcgttttgtggaagacagttttccacagacattgatgggggtggtgctttgggatgaaactgtttcacctcacatcattaggtgttagatttttttttttttttttttttttttttttttttaagatggaggctcactctgtcacccaggctgtgatgcagtggtgctctctctgctcacttcaacttccgcctcctgggttcaagctattctgcctcagcctctcaggtaattgggattacaggcatgcaccaccatgcctggataattttttatatttttagtagaagtagaggtggggtttcaccatgttggccaggctggtcttgaactcctggcctcaagtgatctgccctcctcagcctcccaaagtactgggattacaggtgtgagccaatgcacctggccaggcattagattctaataaggagcatgcagcctagatacctcacatttgcagttcacgatagggtttgtgctcctacaagagtctaatgccaccattgatctgacaggaggtggagctcaggtggtaatgctcacctctgtgctgtgtcgttcgcctacggaccagtactagtccttggccccagggttggggacttctgcccaaaaaatcaggctgggggctgggtatggtggctcacgcctataatcccagcactttgggaggccaaggctggtggatcacctgaggtcaggagttttggaccagcctggccaacatggtgaaaccccgtctctactaaaaatacaaaaattagggctgggtgtggtggctcacacctgtaatcccagcactttgggaggccaaggcaggcagatcacgaggtcaggagatcaagaccatcctggctaacacggtgaaaccctgtctctaataacaatacaaaaaattagccagtcgtggtggcgggtgcctgtggtcccagctacttgggaggctgaggcaggagaatggcatgaacctgggaggcggagcttgcagtgagctgagatcacaccactgcactccagcctgggcgacagagcgagacttggtctcaaaaacatatatatgtatatataaattaggtctgggcgtggtggctcacgcctgtaatcccagcactttgggaggccgaggtgggcggatcatgaggtcaggagatcaagaccatcctggctaacacggtgaaaccctgtctctactaaaaataaaaaaatcagccgggcgtggtggcacgcacctgtagtcccagctactcgggaggctgacacaggagaatcgcttgaaccggggaagtggaggttgtagtgagccgagatcgcaccactgcactctagcctgggcgatagagcgagactccgtctcaaaaaaaaaaaaaaaaagttagctggatgtgatggcaggcacatgtaatcccagctacttgggaggctaaggcaggagaatagcttgaatccgggatgcagaggttacggtgagccgtgactaccatatcactccagcctggggaacgagcgaaactccatctcagaaaataaataaataaggctaggcatggtggctcaagcctgtaatcccagcactttgggaggccaaggtgagcggatcacaaggtcaagagatcgagaccatcctggccaaccaacatggtgaaacctcgtctctactaaaaatacagaaattagctgggggtggtggcatgcgtctgtagtcccagctactcaggaggctgaggcaggagaatagcttgaacccaggaggcggaggttgcagtgagctgagatcatactactgcactccagcctggtaacagcgagactctgtctaaaaaaaaaaaaaaaaaattagctgggtgtggtggtggtgttcctgtagttctagctatttagcaggctgaggtgggaggatcacttgaggagtttgaagtttaaagtgccctatcatcttatcacggtactctaacctgggcaacagagcaagaccctatctttagagaaaaaaacggtcccttgtgatggctcacgcctgtaatcccagcactttgggaggccaaggcgggcggatcacgaggtcaggagatggagaccatcctggctaacatggtgaaattccatctctactaaaaatacaaaaaaaaaattagccgggtgtggtggcaggcacctgtagtcccagctacccgggaggctgaggcaggagaatggcgtgaacccgggaggcggagcttgcagtgagctgagatggcaccactgcactccagcctgggcgacaaagcgagactccgtctcaaaaaaaaaaaaaaaaaagagtgaaactccatttcaaaaacaatttttaaaatgctggccgtggtggctcacgcctgtaatctcaacagttttggaggccaaggtgggcggatcacttgaggtcgggagttcgagaccagcctgaccaacatggagaaatcctgtctctactaaaaatgcaaaatcagctgggcatggtgatgcattcctgtaatcctagctactcaggaggctgaggcaagagaattgcttgaacccaggaggttgaggttgcagtgagccaagatcatgccactgcactccagcctgggcaacaagagcaaaactccgcctcaaagaaaatggaaataaaaatgccggccgtttcggctcacacctgtaatcccagcactttgggaggccgaggtgggtggaccagttgaggtcaggagttcaagattagcttggccaacatggtgaaacctcgtctctactaaaaatacaaaaattagctgggtatggtggcacatgtctataatcccagatactcgggaggctggcttcaagaattgcttgagcctgagaggtggagattgcagtgagctgagatggcaccactgcattccagcctgggcgacacaatgagaatttggggaaaaaaaaaaagaaccaaagttttgatatttccttgttagactccagcatgtctgtaatcccagctactctaggaagctgaggcaggagaatcgcttgatcccagcaggcggaggttgcagtgagctgagattgcgccactgcattccagcctgggcgacagagcgagtccatcttaaaaaaaaaaaatttttttttttggtatttcctttttaggccccagttaattgtcttgcttgctctctggggtggatatatgtccctgttattgtaatgtgctgctggacaatcctggatctagtcttacgtattgtgtccttctcagaagccttgagtatgccagtgttttctcacattttgcaggtcccctgtctgggatctcttttctttctttccttgggtactggattttcagtgctgcctggttcactcactgatgaatcttgttgcttacaggtccaggtgcaggtacagcagtctccgcaacaggtctcggctcagctctccccacaactcaccgttcaccagcctactgagcaacccatccaggtccaggtgcagatccaaggccaggcaccacagtcagcagccccctccattcagaccccgtctctgcagagtcccagtccctcgcagctgcaagcagctcagatccaggtgcagcacgtgcaagcagcccagcagatccaggctgcagaaatcccggaggagcacatcccacatcagcaaatccaggctcagctggtggctggccagtctcttgctggtggtcagcagatccaaatccagaccgtgggtgccctttccccaccaccatcccagcagggctcaccccgggaaggggagcggcgggttggcacggccagtgtcctccaaccagtgaagaagcgcaaagtggacatgcccatcactgtgtcctacgccatctcagggcagccggtggccaccgtgctggccattccacagggccagcagcagagttatgtgtctttgaggccagacttactgacagtagacagtgcccacctgtacagtgccactgggaccattactagccctacaggagaaacctggaccatccctgtttattctgcccagccccggggggaccctcagcagcagagcattacccacattgccattccccaggaagcctacaacgcagttcacgtcagtggctcacccacagccctggcagctgttaagctggaggatgacaaggagaagatggtgggcaccacatctgtagtgaaaaactcccatgaagaggtagtgcagacccttgcaaactctctctttccagcacagttcatgaatggcaacatccacattccagtggctgtgcaggctgtggcaggcacgtaccagaatacggctcaaactgtccatatatgggacccccaacagcagccgcagcagcaaactccccaggaacagacaccaccaccacagcagcagcagcagcaactccaagttacttgttcagtaagtgaagacttatcagtagggcaggcagcctggtccctcagggcccagtgcagcacagagcttgcctcgcaacctctggcttatttactgctgttactcttacagtgatgcagtatttagtatttgggagaagagggggagaaacatcacgtgaggctatgcaacagaaaaaagagtttatcctggtacctggaggtaaatgagatggccaggaattgctttggagttttggagacattttgggtttaagtaccatggacacttctttgtaatctcttctcaggaagagtaaagttacaggtgtagatgaatgggacacctcaagtgtgtcccagtgctgtttccttgtatcataagtaaatggttttagcaaaacacttgtagtttatcacatagattacaaactcatcactggagaggctgtgagattgttcattctgtttttcatctttgggcacacagtgtgggtgaattagaaaagctaaaataactcataaggagcctgttaaaagtgatcaccattgggaggcttgaatatgccgtctatgtggtgggacctcccaagagtttttgtgttacgggggcggccgggcgaggtggtgcacttctgtaatcccagcactttgggaggccgaggcaggcggatcacaaggtcaggagtttgagaccagcctggccaatatgatgaaaccacgtctctactaaaaatacaaaaattagctgggcatggtggcaggtacctgtaatcccagctactcgggaggctgaggcaggagaatcacttgaacccaggaggcagaggttgcagtgagctgagattgcgccattgcattccagcctggacaacaggagcaaaactctgtcaaaagaaaaaagtaggggccaggcacggtggctcatgcatgttaccccagtactttgggaggccaaggcgggtgagtcaccagaggtcaggagtttgagatcagcttggccaacatggtgaaaccccgtctctactaaaaatacaaaaattagccgggtgtggtggcacacacctataatcccaggtaatcctactcaggaggctgaagcaggagaattgcttgaacctgggaagcagaggttgcagtgagctgagatcgtgccactgcactccaacctggggcaacatagcaagactttgtctcaaaacaaacaaacaaaaaaactattagtgctgggtgcagtggcagttgcctgtaatcccagcagtctgggaggctgaggtgggaggaatgcttgagcccaggagtttgagatcagcctgggcaatataggaagaccctatctctacaaaaatttaaaaaatatagtctagtgtgatggcacatacctgtggtcccagcgtagatgcgagggttgcatgagcctgggaggttgaggctactatgatcatgccattgcatttcagcctagagaacagagtgagaccctgtctaaaagaactgattggtaaaatatctggtcccgttagagtgggatatagggcctctggtcttatgggactgatgaaggtgctatgcctcggtgggcataggctcctgagcatgcatatgtttgtgggagctggtacaaacaagttagataagggactgcacttggaaacatgggctgtaagtgattaattaagcaaaggttgaccaggtggtttcatagaggcagtatcatattatcctaggtgacattgttaaggacctgctaaatatctagctgttgggcctagaaatagaataagagaaggttttttgcttcatatagcttagagtctagttgtgaaaagtaagaactcaggatttcttttccttcgaattatttataaggcagaataattatgacatatacacaaagacaaactgggaatttagaaattctaggttaagaagtcaacagaggtctttgtggacaaaatgacgtttgaactgtagtttatttatttttgagacaggttgttgctttgtttcccaggtaggagtatggtagtgatcataattcactgtagcctctaactcctgggctcataaaatcctcccgcctcagcctcccaagtagctgggactataggcacagactaccacactcggcatatatatatatttgtagagacagggtctcactgtgttgcccaggctgctcttgaactcctggcctcaagtgatcctcccaccttggcctcccagaatgttgggattacaggcatgagccactgcaccctgccttgaactgttgaactgtagtttatagtttagataaacaaaagaatggaacagcataaatacagagccaaggatggacagaagggacatgccctaatgcaacttgagaagggaactgtgagaatggagttagtattgaggggtgggggtggggttgttgccttcccaaagtagaactgagtttgatctaatctgtggtaggaaatcaggaatttcctagatttgtggtaacaggaggaatcaagtagatgtgtgtagaattgactgcatataggagaaactagccagtagatttgtaacaggtctctatgctcagcttttgttcacagagatggagcccattaggcctcccctagctctcctgggcctgatggtccaattgcaggtcagtgcctcatttggtacttagtggtctctgtttataatttccatgtctgggtcttcagcaggagaagatcctttctggagttcattttagtgggccagtgttcttcagaggctgtatctgatttgggaaagtcttagagtgatttacatgaagttattattaccagaaatagaaaaattgtgaagaatcccgattttccatcccaagggaaagatgccaagggaaagatgagtttgtctatatataccacaaacatccctctcccctcttatgcaggctctgtgctaggagctggggaatagagatgaataagacagtcttttctacccttggaccactttacagcacatgcagaagacagtcaagttgaaccctaaggggagctagtgacaaaatgtgttccttcatctgccacaggttggagagggccataccttttatgaaagctatcatatcttctgtctttaaaaccagatttatggtgaaatctcacttcctcacaccaaccgccatctgtggccccatttttctgttctactttattgccagaactctaaagaaacattatctacacaagctgggctctagatgctgtaaaaatttcccttcaactcatgactaaatctgttcttgtcaaggtcagcagtgacccccctatagccagttcagaccagcaagtatgtttttatcctacagcaacatacaacacagcagcccattgttgagacttgtttttttttttttttttttgagacagggggtctcattctgtcacccaggctggagtgcagtggtgcgatctcggctcactgcaacctccgcctcccgagttcacaccattttgcctcagcctcccgagtagctgggactacaggcgcccgccaccacacccggctaattttttgtatttttagtagagacaaggtttcaccatgttagtcaggatggtctcgatctcctgacctcgtgatccacctgcctcggcctcccaaagtgctgggattacaggcgtgagccaccgcgcctggccgagactttctttagacttgcatgttattacacattcctgattttcctcctacccatctgaatcttctttattcccaggaggcttaccggtgccttctcctcctctctctgaatcatacatgttgatgttcctgagggttcagtatttggccctcttctccctaagggatttctttccattgccatggttttcagcatcctccagatgattcttgctgctgctgaagatgataatcactgatactatctgccagtactactgttcttgatgtttaacatattcttctaattttcacattaaccttatgaagtatgtactgatacttctgttttacagatgaggaaactcaggcacagagagattaagtgacaaggccaaagccatgcttaaaaagtggcagaattggccaggcgtggtggctcacacctataatcccagcacttttggaggccgaggtgggtggatcacgaggtcaggagttaaagaccagcctggccaagatggtgaaaccccgtctctactaaaaaataaaaaaataaaaaaattagctgggcatggtggtgggcgccagctacctgggaggctgaggcacagaattgcctgaacctgggaggtggaggttgcagtgagccgagatcgcgccactgcactccagcctgggtgacagagcgaaactccatctcaaacaaacaaacaaaaaaggggcagaattgagattcaaccctgcatgggctggccctggagcctgtgtcttaatccctgtgctgcactgacacataagtctctcggccatgccttcctctgtttggaaccttttccacatattcagctgcctacttagcatttacttggacttattgacaatacctcagatcttcattggcaccatttctaaaactgtcaaacttccttgtctcagaaagtagtgctgctctccgcctagttgttcaaaccagaaacccaggagtcatctttgtgtctgctttcccttactccccacaaccagttcatcaacaagccatgttggttctaccatcacacctctcaaaatctcttatatcatctccactgccaccactatagtctaggccaccagtacttgcttccattcttgttcttcaatttattcttcatagaataatcataaaatacaagattatgtcacttcctagcttaaaactctccaaggcttccattatatgtaggaacaaatttacaccacaatgtacaatactctgtatgagtagctttcaacctgggttgcattattgcctcctccacccactgatagacatttggacacgtttggaagaatttttggaagatgcttgggaatgttaactgacatttagtgtttggaagcacacagtgaagggggcctgctacagaagcactgcctcccatgctctagccactgcctacttgttcagccagactcctggatttccagtttgggtaaatgatgttgccattgaacgaaggagagaggtaactcaggagaatagatctgggcagggaagctaatgaatactctttgtagatgttagtttgaggtggctatgagttgttcagttggagatgtatagtacccactaggtatattaagcggaggggggggggggcgcagggggggttctagcttggaggtacatagtggtcactttgacaaatatggatatccaaactggaaaagtgggtgagactcaccagggagaacatgtagttgaaatgagaagtgggtctatagaggagctctatggttgacaaacacgtaagggcctggcagagaaaaacccaaagcatacagagaaatagctgctagatagctgagggaggtccgggaggatgatatatcaggaagccgagcagagtgcaaaggacaatgttgtgagtgacattgttggatgtgccagaaaggtccagtaggttaaggccaaagcatccattgcatttgaccctttcatttcaggtgtatgtgactggggagtacaaggagggtggtattgctggtagtggtggcagcagctactacaggccaccaagaagagattgctcatttctggggtagacagaatagtgattggagctctgaatgcagcatctggatcaaaggtctatggaaatcagagaatgagtcctcagattaaaagtagaagaaagggcaagaatgtctgggcccagctagagacttggctttgagcaagacggtaattggtgacaaactttttaataaaacagtgggggaaagatgggttgctccctgagctaagaaagtacttattgactaggtaaagggaggcttgggcctgtgggtggtggggaggaggggatgtctgcatgggtcactcagcggcttctgttgctattgggtcctctggccctgagctcagctgccctcctggtctgtgctagatgtcttagaggggcatgatggttggcagttcatggaactgtttcaaagaaattgtttgagtaataggtttttgttgttgttgttgttgttgttgttgttttttgtgatccttggattagtcagtgcagttaaggagaaaaactgatgccaaagattttcttcacaacgctgcagattgaatcagctctttgccctggactgtaatttaatatatcgcagtattctgggcctgatgcaaaactttgcacatgttttttgaatttagtgagtgagcgaaactagggctttgggtgatttgaattcattttttgccattttatagcacctttgagaatccaagcacattcttttttttttttttttttttttttgagacagagtctggctctgtcgcccaggttggagtgcagtggcaccatcttggctcactgcaacctctgcctcccaggttcaagcgattctcctgcctcagcctcccaagtagctgggattacaggcgtgtgctaccacacccggctaatttttttttttttttttttttttttgagacggagtcccgctctttagcccaggccggattgcagtggcacaatcttggctcactgcaagctccgcctcccaggttcacgccattctcctgcctcagcctcccaagtagctcgatctcctgaccttgtgatccgcccgcctcggcctcccaaagtgctgggattacaggcgtgagccaccgcgcccagcctaattttttatatttctggtagagacagggtttcagcatgttggccaggctggtctccaactcctgacctgaagtgatctgcctgcctcggcctccagagtgctgggattatgtgtgagccaccgcgcccagctcaagcacattctttgaacatgtggtgactcagttcttgcctttcaaaatcagagtccaaactaaaaaaatggaaaatcttggaattttaatatttttagggtataaagatctcttcagaatctggccgggtatggtggctcacgcctgtaatcccagcactttgggaggccaaggcagacggatcacctgaggtcgggagtttgagaccagcctggccaacatggtgaaaccccgtctctactaaaaatacaaaaattagccgggcatgatggcagacacctgtaatcccagctactcgggaggctgaggcaggagaatgccttgaacctgggaggcggaggttgtggtgagccaagatcatgccactgctctccagcctgggtggtagagcaagactttgctcaaaaaaagaattttaaaaagttggaaatattttaacattattcaaacattcacttttttatttttattttttgagccagaatctttctgtgtcacccaggctggagtgcagtggcactgtctcagctcactgtaacctccgtctcctgggttcaagtgattcttatgctgcagcctcccaagtagctgagattacaggcatgagccactatgcctggctaatttttctatttttagtagagatggggtttcaccactttttttttctttaaatgatggctcaactgtggctggacattaaaatcacctgggaaggccaggcacagtggctcatgcctgtaatcccagcactttgggaggccaaggcgggcagatcagtcgaggtcaggagttcgataccagccagcaagatggttcaataacagccgtctctacgaaaactacaaaaattagttgggcatggtggtgcatatctgtaatcctagctactcgggaggctgagaaaggagaatcgtttgaacctgggaggtgaaggttgcagtgagccgagatcgtgccactgcactccagcctaggcgaaagagcaagactccatctcagagggaaaaaaaaaaaatcacatgggaagcttttaaaaatactgacaatgtgcctctaccttacaatggctggagataaggcccaagtgtgaggtttctttctttttttttttttttggtttttttttttgtgaacagagtctcactctgttacccaggctggagtacagtggtgcgatctcggctcactgcaagctccgcctcctggattcatgccattctcctgcctcagcctcctgagtagctgggactacaggcgcccgccaccacacccggctgatttttttgtattttagtagagatggggtttcaccgtgttagccaggatggtctcagtctcttgacctcgtgatccacccacctcggcctcccaaagtgctgggactacaggtgtgagccactgcacccggccagggtgggtttttttttttttttttttttaaagcaatccagatgatttcaaggtgagacccagtttaagaatcagtgctctcggccgatggcccaagcctgtagtcccagcactttgggaggctgaggagggcggatcacctgaagatgggagtcaagaccagcctgaccaacatggagaaaccccatctctactaaaaatacaaaattagccgggcgtggtggcacatgcctgtaatcctagctacttgggaggctgaggcaggagaatagcttgaacccgggagacagaggttgaggtgagccgagatcctgccattgcactccagcatccaagaacaagagcgaaactctttccccgccaaaaaaaaaaaaaagaaagaaagaaatgttgtctcagttcctacccttttcaatcagaatatgcattttgataaaatccccaagtgatttgtttgcacattaaagactgtgggagcagtgctttgagccagtagttctcagtggtgaccaaacattagaattacttttttacttgaggagtttttttgttttgttttgttttttcttttttcttttttcgagacagagtctcgctctatcaccaggctggagtgcagtggtgcaatcttactcaaggagtttttaaacaattgataccttggctccccctcagagagattctggggtaagtctggctattagtgtttttaaataaaagatttgaccgggcacagtggttcacgcctgtaatcccagcactttgggagactgaggcgggcagattacctgaggttgggagttcaagaccagcctgaccaacatggcgaaactccgtctcgactaaaattataaaattagctggccgtgttggtgcatgcctgtaaacccaggtactcgggaggctgagacaggagactcacttgaacccgggaggcggagggtgcagtgagctgagattgcgccattgcactccagcctgagcaacaagaggaaaactccgtctcaaaaaaaaaaaaaaaaaaaaacatttaaaagtgcagccaaggctgagaagcactgcactagcccagttgcagtgctgcttttgctgtccctggggcaagaggtagaactccaaagcttcttaaaagtaggacagcaatgagtagagaaatattttcttaaataaatgaactatacataacatttttctggcaattttgcagaaggatctaatataaaacaatattgacacattttcatggtttctctcctataggctcaaactgtccaggttgctgaagttgaaccacagtcacagccacagccttccccagaacttctgcttccaaattctttgaagccagaagaagggcttgaagtatggaaaaactgggcccagaccaagaatgctgaactagagaaggatgctcagaacagattggcacccattgggagtgagtgtcttggaagaagagtgggctgtgtctaaaatgcaatggtactaaagtaacaggaggacaaaatgccagaaaagtggtgtctcctgtcttggggacaagagagcaacatctgtaatagtatgttgaattcaagcctagtaacaagcagtactgaccttgtgtacataataagcaggatatgtggggtttgcccaaaaccaggcatttttagacatacgggtttcaggagttgaccctaccagacctaagcagagtggcttctgggaggaaatgggaaccagggataggcactcaagcccttctttcttggcattaggctcatatactcatgttataggccagttctgacattacaggcatgaaacattctagtagatacaagtgagcatttctatcccagcaccctgatgggcagtatctgttctgagccttccagatatggacccccaggaccttcattcatttttgaggcttccgttgcagggcgccaactgctgcgattccaggaagatctcatctcctctgctgtggcagagttgaattatgggctctgtctaatgacacgggaagctcgaaatggagaaggtgaaccctatgacccagatgtgctctactatattttcctgtgtattcaaaaggtaggaaacagatcttcacaagaacatgtttgagctgtgttcctattggatgtttgctagtttagttaataaattgataagcaagaagttaaaataaggaagttctctttcaggtatacagtgagttttaaaatacacatttgttgttttttttttttttttaagttttaaaaacctacacgttcactttagaaaataacagccggggccgggcgctggtggctcacgcctgtaatcccagcgctttgggaggccgaggcaggtggatcacttgaggtcaggagttgaagacgaccagcccagccaacatggtgaaaccccatccactaaaaatagaaaaatttgccaggtgtggtggtgcactgcctataatccctgctatttgggaggctgaggcatgagaatcgcttgaacccgggaggtagaggttgcaatgagctgagatcacagcattttactccagtctgggtgacagagcgagactctgtctcaaaaattaaaaaaaaaagaaaagaaaagaaaaaaaataagagccaggcaagatgtctcacacctgtaatcccagcactttgggaggctcaaggcaggaggatcgcttgagccccaggagtttgagaccagcctaggcaacatagtgaaaccccatctctacaaaaaattagctgggtatggtaatgcatgcctgtagtcccagctacttgggaggctgaggtgggaggattgcttgagccccagaggttggggctgtagtgagtcatgattatgtcactacactccagcctgggtgacagagtgagaccctgtctgaaaaacgaaaagaaaaaaaattagctgggtgtggtggcacacacctgtagtcccagctatttgggaggctgaggcaggaggatcccttgagctcaggagtgcgaggctgcattcagctatgattgtgccatcacacttcaatctggtctacaaagcaagaccttgcctcttaaaaaataaatacataaaataaataataaaataggaaaacaaacattattcatcctactacctaaacttctattacattattggtaattaccttgactttttttttttttttttttttttgtaattcacaaagcatttatgtaacacttttctttttgttaaacctgattttcatgaaggtaatttattcaaaacagagtcttgtgccagcatagaggttttcttctcattgttccctgcactaactacttatttgaaggagtctagctagaataatataccaatgtagttaggttttcaggacatctgtggtgaagcataacagaaatttgcagactggcagttcaagggagcagaggtggatttcttagtgtttgaaggctcttgaggagaaacccacagtataatagaatagggcttactggttgggacttattctgttgcctagtcttgagaaatgtctgcctcctagttttttcctctcttggtggtcctaacctaagtactatgtgaattgctttacatgctttcattctttgctctcccagtcctggaaggcagataccatcatctccatttacaggcaaggaaactgagtctcagaaattaaaagacttgcacatgttgtttaacttatacaatatctaatggaaggctgaccccagagcctattcatgatttttgctaacacaaaataatgcctttcttgggtgaaatagcattcacaacatctgccttatttacccaactctcaagaatgtcatgagaatcagtcacatgagcttaggcatactatggaagtgtcacatgctggtgccttggtttgttgaggtgtgaatgggtagggaaggatagtagtactggtagaaaaatatatttatttcccctgaaatccttgttcaggagactaccaataacttctattaattgtttttcttttagtatctttttgaaaatggaagggtagatgacattttctccgatctttattatgttcggttcacggagtggctacatgaagttctgaaggatgttcagccccgggtcactccacttggtaagagtctcccttgtccttggatatctttcctacctggatttaagaaagatcaatagcttctgtggttggctatgaaaagcatgtgagtgaggggggatataaatcccagactgcagcagcattggccactgtgctacttgccctgatagggaagaggcactgctcaccagagaagcctgctggttccagtgtgggaaggacacaggaacaagcagaactagtggggtagttactatcttttttttcctattaaaatgtattgattaaaattagaatcataacaattaaggattatggacagttttatctgtagagcataatttttgctttactcacaggcagccttctggacagcatgttctattggaacaaaagcataggttattcagtgtttttctttgtttgttcttaaaaaaacatggtcttggtatgttgctgagatgggcctcaaactcctgaactcaagcgatcctcctacctcagcctcctgagtagctggagctataggcatgcgctactgtgctcagctatttttgttttgttttgttttgtttgaaacggagtctcactctatagcccagggtggagtgcagtggcacgatcttggctcactgcagcctccgcctcccaggtcccaattcaggcaattctcctacctcagcctcctgagcagctgggattacaggcatgtgccatcatgccctgctaatttttgtatttttagtagagacaggcttttgccacattggccaggctggtctcaaactcctgactttgtgatctgcccacctcggcctcccaaagtgctgggattacaggcgtgagccaccaccgtgcctggcctatttttgtttttaatagactttttttttttttttttttttttttttgagacagagttttgctcttgttgcccaggctggagtgcaatggtgtgatcttggctcactgcagcatccacctcccagattcaagtgattctcctatcccagcctcccaagtagctgggattacaggagcatgccaccacgcctggctaatttttgtatttttactagagacagggtttcatcatattggtcatggtggtctcgaactcctgacctcaggtgatccgcccacctcggcctcccaaatgctgggattacaggcatgagccaccacggccagccaatagactttatgttttagagtacttttaggtttccagaaaaatttagcagtaagtacagagaatttccatataactccttaagtatataccctcacacacagtttctcctatcaataacatgttgcgttagtatggtacatttgttataattgataaaccaatattgatacattattgttaactatagttcatagtgctatgaactatattattgtgttgtacgttctggtttacattctgtatctgttgtacattctgagttttgatgaatgtatgatgacatgtgtcaccatcatggtgtcatatagaatgtttactgccctaaaaaatacctcttctgggccaggcatggtggctcacacctgtaatcccagcactttgggaggcagagatgggctgatcactgaatattgggagttcaagaccagcctggctaacatggtgaaaccccatctctactaaaaatacaaaaattagccaggtgtgttggcaggtacctgtaatcccagctacacgggaggctgaggtaggagaatcgcttgaaccagggagtcggaggttgtggtgagccaagattgcgccactgcattccagcctggtgacagagcgcgactccgtctcaaaaaaaaaaacaaaccttttcacctgtttatccctccctcccccagataccctgaaaaccactgatgtttttactatcttcacagttttgccttttccagaatgtcatatagttggaataattcggcatgtggccttttcagatttgttcctttcatttagcaatatgcctttaagattcctgtgtgtctttggctgggtgcagtggttcatgcctataattccagcactttgggaggccgaggcatgtggatcacaaggtcgggagatcgagaccatcctggctaacacggtgaaaccccgtctctactaaaaaatacaaaaaaattagccggttgtggtggtgggtgcctgcagtcccagctactcgggaggctgaggcaggagaatggcatgaacctgggaggcagagcttgcagtgagctgagatcgtgccactgcactccagcctgggcgacaagagcaagagtctgccccgtgccacccccgcccccccgcccaaaaaaaaaaaaaaacacagtctgggcgcggtggctcacgcctgtaatcccagcactttgggagaccaaggcaggtggatcacttgagaccaggagtccgacaccagcctggccaacacataaaacgttgtctctactaaaaatacaaaaaattggctgggagctgtggttcacacctgtaatcccagataatcccagagctttgggaggctgaggcaggtagatcatgatatcaggagatcgagaccatcctggctaacactgtgaaaccccgtctctactaaatacaaaaaattagctggacgtggtggcatgtgcctgtagtcccagctactcgggaagctgaggcaggagaattgcttgaaccagggaggcagaggttgcagtgagctgagaccacgccactccactccagcctgagtgacagagtgagactccgtctcagaaaaaaaaaaaggagtagcagctggttgcagtggctcacacccataatcctagcactttgggagaccgaggtgggaagatcagttgagcccaggagtttgggaccagcctggtcaacaaagtgagacccccatctcattcataataaatatctaggctgggcctggtagctcacacctgtaataccagtatttcgggaggccatggtgagaggattgcttgagcccaggagttcaagaccagtctgggcaacatggtgagatcctatctccaccaaaaaataaaacacacacacacacacacacacatattaaatatctgaccagatacctcaccaaagaaaatgcattgatggcacatgagtatatgaaaagatgggctgggtgcggtggctcacgtctgtaatcctagcactttaggaggccaaatgtgggtgcatcacttgaggtcgggagttcaagaccagcctggccaatatggggaaacccatatctactaaaaaaaatacaaaaattagctgcgtgtggtggcacgtgcctgtaatcccagctacttgggaggctgaggcaataaaatcacttgaacccaggaggtggaggttgcattgagttaagatcacttgccactgcactccagcctgggcaacagaatgagattctgtctccaaaaaaagatgctctcatcaggtgtcatcagagagttgcaaattgaagtaatgaaatactactgtacatttattagaatggcagaaattcaaaacaccgacagcaccaaatgctgacacagatagggagtaacatgtcatttatcacttgtggaaatgcaaaaagacacaaccactttggaagacaatttggcagtttcttacaaaagtaaacattgttgccttatgatgcagcagttgcattccttgacattcagagaagtttaaaacttgtgttcacgcaaatatccgagttttaatccctgtttaatttaataaaatacatttattaaaatgtatgctgctttacccttaaaaaagaaacttactggttagacaaattttttgagtgcctactatgtgcccagcagtctgctaggtgccggagaatataatatagcagtgaagaaaatggagcttgcactatagtaaggcaagacagtgtataaataagtaagttaactctagtactttgtctttttttttcccctccttttttgtggagagcaaggtcttgctgtattgcccaggcaggtctccaactcctgggctccagctatcctcccacctctgcctccctaagagctgggattacaggtgtgagctgctgcgcctagcaatttaagtactttgaagaacagaacacaaaggaatggaaagtgttaagagtattacaagggagggctattgttggaacagagacatgagtgactacatcactctacataatttggaagttttcaagccaagtatggatatgcagacttcacttttcagtctgttattatggaagtttcaaacataaataaacaatagattaatgaattcccccatgtacccattttccatggcaaatctttttttgttgctgttttttggcttttgagacggagtctcactctatcgcccaggctggagtgcagtggtatgatctcggctgacttcaacctccgcctctggggttcaagtgattctcgtgcctcagcctcccaagtagctgggaatacaggcatgtgccccacgcccagctaatttttttgtatttttagtagagacagggtttcaccatgttggccaggctggtctcaaactcctgacctaaagtgatccgcctgcctcagcctcccaaagtgctgggattacaggcatgagccaccgagcctggcctgttgctgtttaattcctttttgtttgtttttgtttgtttttaagtttattttttccattttaaaccttatgtataccaccacctgtttcccctctcctgtattggaagtaaattccagatactttatccatactttttttttttttttttttttttttgagatggagtctctgtgttgcctaggctggagtgcagtggtgcaatctcagcacactgccaccacctcctgggttcaagaaattattgtgcctcagcctccgagtagctgggattacaggcacctgtccaggctggtctcaaacttctggcctcaagtgatcggcccgcctcggcctcccgaagtgctgggatttcaggcatgagccaccgggcccagcctatcatacttacttacttatttatttatttacttatttatttgagacagatcctcactctgtcgcccaggctggagcgcaatgacacgatctcggttcactgcaacctctgtctgccaggttccagcaattctcctgcctcagcctccctagtagctgggattacaggcatgtgccacaacacccagataatttttatatttttagtagagatggagtttcaccatgttggccaggctggtcttgaactcctgacctcaggtgatccacccgcctcagcctcctaaagtgctgggattataggcgtgagccactgcgcctggcccggttatgtcttttaatatttactttttatttatttatttatttttttgagatggagtctcactttgtcttccaggctggagtgcagtggcacgatcttggctcactgcaacctctggctcctggattcaagcagttcttctgcctcagcctcccaagtagctgggactacaggtgcatgctgccacacccggataattttttgtattttagtagagacgaggtttcactgtgttgcctaggcttgtcttgaacctctaacctcaggtgatccacctgcctcaacctcccaaagtgctaggattacaggcgtgaactacggagcccggctcatactttaaaaaataatttaaaaaaatggctgggcacagtggctcacgcctgaattcccagcactttgtgaggctgaggtgggccgaccacgaggtcaggagttcaagaccagcctggccaattatggtgaaaccccatctctactaaaaaaattacaaaaattagctgggtgtggtggtgggagcctgtaatcccagctactcgggaggctgaggcaggagaatcacttgaacccaggagaggcggggtttgcagtgagccgagatcacaccattgcactccagcccaggcaacagtgcaagactcagtctcaaaaaaataataataattaaatcaacaaaaaaggtaaatccataatgtaattaaaatctaccctttattaggctgggcgcagtggctcatgcttgtaatcccagcactttgggaggccgaagcgggtggatcatgagttcaggagatcgagaccatcctggctaacacggtgaagccctgtctctactaaaaatacaaaaaaattagctgggcgtggtggtgagtgcctgtagtcccagctattatggaggctgaggcaggagaatggtgtgaacccgggagctgagcttgcagtgagccgagatcgcgccactgccctctagcctgggcaacagaccgagactctgttttaaaaaaaaaaaatctaccctttattaaaatttttaatagtcttataaatttcattattttgatttatctgaatcaaggtcaaaattaagtctacatattgaaattggctgttgtgtttttgtttttgttttttcttgagacggaggcttgatctcggctcactgcaacttccgcctcccaagttcaagcaattctgcctcagcctcctgagtagctgggattacaggcgcgcaccatcacacccagctaatttttatatgtctggtagagatgggatttcaccaggtcaggctggtgtggaactcctgaccttgtgatctgcccgtcccctgcccttttttttttttggatacagagtctctctctcttgcccacgttggagttcagtggtgcaatctcggctcactgtaacctccacctcctgggttcaagtgattctcctgcctcagcctcccgagtagctgggactacaggcgcctgccaccacacccagctaatttttgtattttcagttgatacggggtttcaccatgttggccgcgctggtcgcgaactcttgagctcaggcaatccacctgcctcagcctcccaaagtgctaggttacaggtgtgagccaccttgcctggccttaatatttactgttcatcttaattgcccccctcccttttgtcttacagtatattcatggaagaaactagcctttgaaattgtcacacagtctaatttttgctgattgcactctgtagtgtagtttaacatgttcttttttccccatgtatctacaattgattggtaattgaatatacagattgattccggattttttgttttgttttgtttttggcaagattacttcatagttggcctttctttgatcacagtgcccataatgtctgaatccattgattctttatgggttgcaaaacagtattctaatgttattattacttcataattacttggaatataaagataaactttccttttttttttttttttttttttaagagacgggggtctcgatttatcacccaggctggattgcagtgatgggaacacggctcactgtagcctgtagcctcaacctcctgggcccaagcgatcctcccacctcagccctccatgtagctgggggccataggcacatgccatcatgcttgtttaatttttgtattttttgtagagatggggttttgccatgttgcccaggctggtttcgaactcctgagcttaggcattccgcacacctcggcctcccaaagtactgggattacaggcatgagccactgttcctggccctaactttccctctttaactctttgggttcatgatggtatagattgtatagaagaggaagggttaacggctgttttttttttttgttttttctttttttctttgcttagccagttttcacaaaaatgagttagttcatcagcttctctcagtgatgtccaattaaggttttcttgttttaagagtcattgtgaacttacagatttaaacgtatttaatgagattcagctgtttgcagtcatctttactgatgcacaaatgtcccatcattggccattagaagcctctttaaattgacccctaagtccttttgacatgaccctagttgtctttcttgatttctgatttcacagaatgtttcagtcccatcttggacatttcttgttctagtgtagaatccttcagttctggagcctggttccttttattggggaatggtatttcagtgccttactctgtatgccaggggtgcttattgttcctagattggtcttgtttctaggatcttcagtgggcagaactagaaattgtttttaaagataaaatacatcattttggtgcctgtagttcagattcagaactataaggctaatacctaggttttttttatctatagccccttacttccatgctaggagccctggccctcagtcaatagagtctgttttattttattttgatttatttttttattttgagacagggtcttgctctgtttcccaggctggagtgcagtggcacaatcttgcctcactgcaacttctacctcctgggctgaagcaatccttctacctctcagcttcccaagtagctgggactgcaggtgcataccaccacacctggctagtttttgtttttttttttttttttgtagaaatggggttttgccatgttgtctaggctggtctcaaactcctaggttccagtgatccacctgccttggcctcccaaggttacacccatgagccaccatgcccaggctattttagtttttcttacagggtcttgctttgtctcccaggctggagtacaatgtcatgatgatagttcactgctgcctcaccctgttgggctcgggctgggacccaggctcaagccattgcactcagctgtttttttttgtttttttttttaaggtttttgtattgacagggtctccctatgttgcccaggctggtcttgaactcctgggttcaagcagtcctcctaccttggcttcccaatgtgctgagattatagacatgagtaaccacacccagccaagtttattacaaattgtagagaagagaataaaattagggaagtgacatcagagggagcaagtgacagagcgaacccagagaagtggaacatgccaaagtatggcaataattgttcccaggagaaaaattatttttttaagaaaaggaaggccaggcatggtggctcccgcctgtaatcccagaactttggtaggccgaggtaggagaattgcttcagcccaagatttgaagaccagcctgggcaacatagcaagacctcatctccactaaaaatcaaaaaaaataatcgagtgtgatggtgcacacctgtgatcccagctactagggaggctgaggtgagaggattccttgaatccttctttgctgagaagggctgttttctgctcatcctggatcttgggggcttcagatatgtctaagagcagaaaagcttttcccattgccactgggtcacaaaatagccgaaaagtagacaaaaaatagagtcagaactgccttaaagagatggaaatgcactattagagagccagctttgttttggcaagagcatagaacacagaagaggagtgtatcgggcagaatgttcttttttctgcttccaggaagtgtcacacactgtgcttgcttggagaatcccgaaaccctgcaggagaatactgttgcctgctcctatctcattatgcacccagtgcacaaacatgtgcatactgactgacttcagcacatgaaggggcttggtagtcattcaaatgtcatctttctttggtgcagacctggctgaccagggctcttattcaaattattgacctttgcctgtacctagctctgggctcacttatgaaccagggtcttacagtaacaccagccctgtgggggggatcttgtaatagttcaaatactggcatattggctaggcgtggtggttcacgcctgtatttctaactgctcaggaaactggcaggaggagtctttgagtccaagagctcaaggctgcagttagccatgattgtgtcactgtactctagcttgggtgacagagcgaaaccccatctcttttttttcccttttttttttttttgagacaggatctcactctgtcacccaggcttaagtacagtggtgcgatcacggctcactgcagccttgacctcccaggcccaaggaatcctcccacctcagcctccctggtagctgggatcacagatgtgcaccatcacacgactaatttttttgattttcagtggagatgaggtctggctatgttgcccaggctggtcttcaactcttgggctcaaacaattctcccacctccgcctcccaaagttctcggattacaggcgtgagccaccatgcctggtcttccttttttaaaaaaagataaatattgtagaagagaccctgtatcttagctaataataataataataataataataataaaatcccccaaagagtatcagtctctttatctagagaagaaatgacaatagccgttttttttgttttttttgtttttttgtttttttgtttttgagatgggagtctcgctctgttgccgaggctggagtgcagtggtgcaatctcggctcactgcaagctccaccttctgggttcacaccattctcctgtctcagcctcccgattagctgggactacaggagcccgccaccacacccggctattttttgtgtttttagtagagacggggtttcaccatattggccaggatggtctcaatctcctgacctcgtgatccacccgcctcggccttccaaagtgctgggattacaggcatcagccactgcgcctggccggccttgctttttagagacagttgagatgagagaagacttggtaagggcaaacgggcgtgcatgccagttctttgggtcctggaccacctttgaaaatatgcaaagctctgtacactctcagagaattatgcatatatgcagagtttggtttatagttttctgtacttcactgtctctgagggcagtctttttgccctgtgttagccttggattagagggtaacaacaatcatgtaaggctgtggttctcaagtgtggtgttagaagtgctcatcatcaggttccacctcagaaacagattgggacccagctatctgtgttttaagaagctttccagatgatttttgccacactttagggagagtcccctgatgaaatttatactcctgtgtggtccttatgcttcacacatcccatattgtacctttgagagaccacctgccatcctcttgttgtgacagtactctattcctcctaggctatgtcttgcccagccacgtgactgaggagatgctatgggagtgcaagcagcttggggctcactccccctccaccttgctgaccaccctcatgttctttaataccaagtaagtgttctagaggctccactgctggcatctgtccagtgaagagtgtggaagctatccaagaggccttctgaattcctctgacatatatttgagaaactgggctactgaaagccctaaccccacttggctgcattttatttggtaaccagtgaggcaaacacccttgccagacccctaccatccatcttgatgtggttcctgcactggacactgcttgggtacgggcctgcccagatcttgggaatgtgggcagtggctcctctgaagcaccagtgggcagaggatgagtcatggtatcctcccggcacccctccctctgccttgcattttacttgtgatccaggtacttcctattgaagacagtggaccagcacatgaagctggccttctccaaggtcttgcgacagacaaagaagaacccctctaatcccaaggataaaagcacgagtatccggtacttgaaggcccttggaatacaccagactggccagaaaggtagggaaaggaggcagggatggcaaaaacaggtgctacttgtcctgccctgtcctgcccttgtgcctgtgaggctagtgataagtgtaaaggttgggatttgctggataaaattctccactcccttctccccagccaaaaattccaaactttcctcctagaagcagagaagccccagacagaatagctgcctcttcccttagtagtcactgcccatgcctcataccttccctcccccgaccctgtatttcctagttgggctggctgaaagcctaagtttcctgatctgggcctgaggtaaggcagtctgatgccaggtctgtggtggtggggatgtgtgttttatagttacagatgacatgtatgcagaacagacggaaaatccagagaatccattgagatgtcccatcaagctctatgatttctacctcttcaaatggtgaggctttattgtgacttgctgtccatgtgtgcgcatgtgtgtgtatgcgtgtgcatgctcacttgtgtgatcacttatcataggggagaggcattctctagtcccaaaccaagtaaaaacacttccagaaagctaaatttagaagcagccttgctctggctttccaaaggtgtgtgatgtgcctagcactgatagaaaaaggggtcccgggtccctacagtcacctttcatgaaaagggtatgaaggtacagagaatctaccttcatcacatattgagcatggccctgcttcctgaccttgaccttttgtcactgccatcattaatctaggtgagactcctctcagctttttctcccttttgccccttcaatggtttctcattacatagtaattcttttatggcagacaactcctttgatgcactcccccttgctaacctcatgtctgtggagctcttagttccctagccacactagctcctctccactcaaggacatcatattatgcctcttctcaacttaaacacagcttatcagggaagcatttccagattccccacctcttccctgtgactgtttcctcggtagcacttatcactgttttttattttgtatttgtttaactttaattgctacctgtgtcccctcctatctgtaagctccatgggtaggaaatacttttcctgcccatttttttaaatatcagcacctagtgctgacctggcactagtaacccttgaataaatcttgaatggatggatgaataactgttagaggatacagcatgccaagtacttaatagaggtacagcacagttcgggggaggggggtgaacccaagtttagggccccactgtaatggccatcattattgggtagaaaacacaacatgaggctgggcaccgtggctcacgcctgtaatccaagcactttgggaggccaaggtgggtggatcacctgaggtcaggagttcgagaccagcctggccaacatggaaaaaccccatctctactaaaaaatacaaaaattagctgggcttggtggctcgtgcctatggttccagctactccagaggctgaggcaggagaatcgcttcaaccaagggggcggaggttgcagtgagctgagatcacctcactgcactccagcctggagacaagacgccatctcaaaaaaaaaaaaaaaaaaagcgcaaagacttggagatagacgctttgagcagtgaagctggcttcaagtaggataaggatagactcacatgagtccatgagagccctaggctggtgcagtcagtgatggatcacagctggtttgtgggaaggaggggcagaggggaagtaacccaacatttgggggatttgcagtagtcccaaaggaggaccaggatgtagtgtgtggtggctgcatggaattcagtagctgtgccacaataacttggggccttactgtttgcagacagcatctgtctgggaagttcagggtgggagggttgaagttatattggtggtacccaacttttatccgcatattcttcagcccccagagtgtgaaaggccggaatgacaccttttacctgacacctgagccagtggtggcccccaacagcccaatctggtactcagtccagcctatcagcagagagcagatgggacaaatgctgacgcggatcctggtgataagagaaattcaggaggccatcgcagtggccaatgcaagcactatgcactgagatgccttggccatggcacaagagaaaccagccaggaaaaaccagacagactttcacactaaagaagaggcctccatttttttttttcttttttttattggtgtagttacgaagcctttcaggctgcttctgtttaaaatataaaagaaaactttgccccctttgcatcttcataaacctgctgcggcagactcctcagccgatggtggctctgggtttccttgagtgtcatatgtcctagaaagttgctggctgactcttttttgtctggggcctggggaaagggcttggactgtgaaaagaaatgtggcccctttccatcttcaagagagatggaattaatgatggatggaccctggagggaatctccccagccgacttccactgggctgacagactttgctgaccacaggggaacgatgttcttttctttcttcatgatcagacataaacttagcatcttaatggaagaaaaatgaggggaacttcaattatgatttattaaagacaatttctattacaccctcctttatgacaagtgacattttagatgtaaaagtaaaaactttaccatgccttttttttttttgttggcctaacattgaggccttaaaacctgaggctcctgtgcctgatggaattcttgtaacatacacttgtgtatcatataaagataccactctgtttctcttatgtattcttactctagttgtttattaagaatgacaagcacgtcttttcaacatgttagtgaacaacgtctctttattttggggaggagcccggcgggacagtagaagtaaacccttgcctgttaattgaactggccgaggtcctgcggggagtgtggggtgggacgtgaagtggcagctcctcagtgacaaggccactatgtgctatacgcatgcgctgtttcttcagcgccagctccgcccccgccgcagcgaggcgggtaggttccgcccgcgcgcactacgccctgacgtcagcgtcgcgcgcagcgcagtgacgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaagtgcgggcctatggggctcacctgggcgaagagaggggcggcaccctggggaaaaggccagatgggggcttccgagagccgccttgggcgtgggcgtgggggacaggtttcgggaattggccacccacctccggggctcactttgagacatctggagcggtgcttggggtacggagaagcatctcagtagtgcttggaatctcaggccggagattccatgctccagacacatggaattgtcagggtgccaggagcactgatgacagctcggtggcagaaaaggtcccctgtacccatttccaccttgtgctgtgcctgtgacacacagactctgtcagtgccactctctgctcacatgcgttacgggttgattggtacatggggatggagtctcatgctgccctaagctgagagctttactcccaattcactcccttccctcgcagtgactttctcattctccctgggtacatcgacttcactgcagaccaggtggtgagtatgatcaggaattgggtcctgaacatcaaggtgagctaaggtgctactatcacctggtctctgggctaactcaccagattgggcttgggggtggattttataggatcatgttgcttgttagcatgcaggtcatacaaaagtgcctttttgtgggggactcagtaacaccttgaggtgtaagggatgctttcccacactggttgacgtttgtctcctcaggacctgacttctgctctgaccaagaaaatcactcttaagaccccactggtttcctctcccatggacacagtcacagaggctgggatggccatagcaatggcggtgagccccatggggtgtgggggaaggagcaaggactccatcgcctttccccaaaggcattcagtcctgcttcttgtcacttagtagtagtctctttttatcctgtagcttacaggcggtattggcttcatccaccacaactgtacacctgaattccaggccaatgaagttcggaaagtgaaggtcagaagggcaacgatcattagcaagcgctcctgggaattgcactgaggtggggtggggtgggagtaggggtttattctaatttagtattctttcttcccaccatggggttcagttactgagaagaccctgagattctgtttcttaaagcagcagcaatagaccaggtgtacagtgcctccagcctacccatgtctctaagatgtgttggtgtgatttggtcttgtggcactgccaaagggatcgataagcagagaccccatgcttcagatcaagagcctgatgaaagtagttcaaagatgcgatgccctttctcaccatccctttccagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagaggtgggtgccactggcagagtagatccaagctctagcagcccaggttgaagacaaggggcttctgttgtctaagacatctctgatagcctcttctctctgggaaaggagtgtcaaaccaagtttctgactcctttattgggttcctgcatcctttccccaccagaggctttcaaactgcccaaatgcttgctagtattcatgctttgttcttttaaacccctaaggtaggggcagtgcttgaggtctgccctgattttcttgccattgttcctgtgttgtcctccttattccatagtgtaagagggtgctccctgtgccatgttgtcctttctactcatccctcactcaataccatactgctaagaattattgggatcccttgaggaagggtgttttgggtgtgaatgtatgaacgtggtggtccatagaacttcacccctgtaatctcagtactttgggagactgaggcaggcaaatcatgaggttaggagtttgagaccagcctggccaacatggtgaaaccccgtctctactaaaaatacaaaaaattagttgggtgtggtggcgcgtgcctctgagctcagctacttgggaaggaaagaaaagagttaactggtcatagtcgatgactggcccttcttcacatctcacctcccacgtagataatgacaaagagggaagacttggtggtagcccctgcaggcatcacactgaaggaggcaaatgaaattctgcagcgcagcaagaagggtaagtcctagagctgggaaagggcctggaactaatgcctagggtcctgattcatgtcctgccctgaccacaggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggtgagctgctacacaggtgggttggggcaataggggcagctgccacatcacagtctgagacttacttcttgtcctaggactcttcccagggaaattccatcttccagatcaatatgatcaagtacatcaaagacaaataccctaatctccaagtcattggaggcaatggtaaggcaagattgtgccctgaaggatgtgtggtgggagtgggtaagctgggctcccaccttaaccttcacatgagcattttcctttccttcaccatagtggtcactgctgcccaggccaagaacctcattgatgcaggtgtggatgccctgcgggtgggcatgggaagtggctccatctgcattacgcaggaaggtaagaatatactttgatagggcccacagagaccccagtttcaggccccacataccttggaaccaagcactcttatggggacaatagagccctccaataggggcaaccctggggccaaattggcctcttggatgggtgacatggctggaagcaagacaaggtcttgtcatccatcacctgccactcccttgcctagcctggccttcttgctcctgctctgcaccttctctaaactctggtctgtttgttttatttagtggctcccaagatccctccagacataaagtcccacagccccaaatgcccttctactgtcacgggttgctatagtaagtccagcccggcccactggcccggcccagctgcccactgcccggctgcttggttgacgtagctgtagctcccggggtttgtggtgctgatgggtgggcaaggccaactgatacacagaccatggtttgggggtggtgctcaagaacatagctccctcttccttctggggtgctgatagggcaggaccttcttccctaggcaggaccttttctgcccacatcttctgcagtaggcatagttcagggaccaactcctttgtgtggtccttgctctcccacacaaccactgcctgctccacacaaccacagcctgctctcctacacaaccactgcccttatcttgcctgagctgcccaccattcagggaggaagggctgggcctgacctcagtgcctctggggactaactgcacggtgactcctgccccatctgataccagctggacgggggctttcccggctgctaagactgcatgtgcctgaggctgccctgggcactgcacacatgcacgtgcacatgtgggggtgagtagaggtcagcacagctgtttgtactatttaaggcagatgtggcagcagccatcccagacacgtctgttcctcagccaagctgcagtcctgatgcagatgtagccaaaagctcctgggtcctaaatatggccacagggtccactgcccgtccccattaaccctatccacccatgtgttcctccatctcaacagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacaggtgaggcccagtacccgtgaaggccagtgggaccccctccctagtgctgcttaggctctaacccaagcactccatctgtccgcagtcatgatgggctctctcctggctgccaccactgaggcccctggtgaatacttcttttccgatgggatccggctaaagaaatatcgcggtatgggttctctcgatgccatggacaagcacctcagcagccagaacagatatttcaggtgggacaggcaagccagttaccccaccctaatcctgcactgacagtctcatctctgctgtgaccttgcccgtgtctctgcctctccctgcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccggtgagcttggggagctgggacatgggtagaggggctggtccagggccagctacccacatttgacctctgcccttcttcagagccatgatgtactctggggagcttaagtttgagaagagaacgtcctcagcccaggtggaaggtggcgtccatagcctccattcgtaagtcaccctgtccttggtggggcctctgccatacctcatgcctcctttctcctgccctcacctcacaggtggtccttctgcctgcaggtatgagaagcggcttttctgaaaagggatccagcacacctcctcggtttttttttcaataaaagtttagaaagaaaaaagtgatgcctgatctttcaacagacaggtggggctctgtagctgccactaccacagatgcacacaaaaacagcaccctcatttccagggggagcctcaggccccgagataaatgtgctccatggacctggaagcgggtagttccaggtccaaaaagttcctcctgaggctgctcacaaaacagctgactatagctatagctatggctcttggggtttcagtctcacactgagcatctgactctggctcccaaggggtcaaagaacaagccctgggactggcatacacagggcatcctgctagcccatagcttggccatataggaccaggtcaacacacatatatattccctaacttgaatctctctcggccaggcacattggctcacgtctgtaatcccagcactttgggaggcaggtggatcacttgagatcaggagttcgagaccatcctggccaacatggtgaaccctttctctactaaaaatacaaaaattagctgggcgtggtgatgcatacctctagtcccagctactcaggaggctgaggcaggagaatcactgaaacccaggaggcggaggttgcagtgagctgagactgcgccactgcactccaccctggcgaaagagcaagactcatctccagaaaaaaaaaaaaaaaaaaaagcccagtgtagtggtaggggcctctaattccagctactcaggaggctgaggcacgagaatcgcttgaatccaggaggtggaggttgtagtgggccaagatcacgccactgcactgcagcccgggcgacagcgagactccatctcaaaaaaagaaaaacaatcagcgattttgtgagaaaagccgttgaggtcctctcaaatctgcatgtgagcaagtaggtctacaacaggcaaacatactgcttcccgacttctgaaaagtcaaggaatcctaagtaatctagatgaaaaagtgactccttggtttcttcacattcccctccaagagcccagtgagccatcagctcctggccagcaacacacctgatacaaaatgggagaagtgtataaattattatgttgataagcaagataagtgccaaagggtagataagagtgaaagcattgggaagcctggcagagtgcagtcagcaggtcagttcctggcggttcattgagcagcttggcccaaagatgtaagtgaagtccctcctggtggagggatgagagcagctccagttactcggccttcatgacacaggaagttgaaggtggcacaggcattgggctgcaaagaaaaggccagcatcagcctgtctagcgccaggcctgtgctccccgcagcatgccccagtcccgggactcaccgtgtcctgcacttccacagcaatgccccgctgcctcatggcttgaagcacctgggactgcagcctctcggtccggtctccagtccccaccaccacgatctctagggaagggtgggtgtggctagtctacagttctgttgagaggctgcagtgggggtcgccttctggggcccagaacacctctgttctccctccccttccccagtacctatccggggctccagcaaccagaagagggaaaagctgtcttcggtgatgtcctggtgggatcccacctgtgcagggaggaggcacatttaatacgacaaatccacgcagcctctccccatctccatccactgcaggaggagacagaggaaagccaagtttgcagggaccaagcagggtgagggcctgtgactctgggcctcagtttccacactgcgggccaggactcacgttccactgcaccaccgagtgcgggagcagagcgcaggggccgagcacgcggtttccgtttatcatgaagccgcggctgttgtagctgtcgatgtacattgcctgagcggcctcgcgttgcagcagagagatgcgcgtccgctgatacagctcgtcatccgccggcgagagccgatgccctcgccgcggggccctgcggagggaaagggtcaggggcgcggggccgggccgggcagcccgagaggccggaaggtgctgggctggcagtcgccggccctagggggctggatggtcgagggcgcggggtccaagctcaccagggaagctcaacgggcggacagcgcagcgagggtcgcgctcggtacaagctacgtagcgcgagagcggtggccatggctgaccaacgcgcggcgaagtcgtcaccggcgccgttagtccccgggttgggagggccctgcggagcctgacccagcgtggctgcagcgccccctgcgtcccggagggcaccgcacagctcgaccggcccagcaggcgagtgtcctcagtcttaggaggccgagttccccgacctccggcgcagctccagtgtcagcacctgccgccctccccgccccgggcccttgcccatagtcccgggggagtggaacacctggcagcgtggccaccctcagggcgttgcctgggccgcagccgcggcctggcccccgggctctcagctattaagccgcgctcccggggcggggcgaccgcccacctggtcgcgtcccgaacacctggccaggcggtgggtgccagacttctagcccctaattccagcctttggggcttcgggcaccgtgggcggggcagccggctcaagtttctccggctagacgcggaagcacgccccgccctaaccgtcacccgcgcgaccgttggcctctccgcagcgcgcggagaggggcgtggccgagcgtggattggcttctcgggttctctagggggcgtggccaggtggtttctccttaaaatggctccaagtctgcaggcagccagagcaagcggaagggcaagctgtgatagtgtttgggtggctgttcggctggcccagaccaggccgaaccggaccagacttgaagtagaagcgcgtggagcatcaccttgtcctcgttcactctgctcgcgtcctgggagtcccccgtcccccgtcttgatccaagtcaagggcctactggcgcgagagtcgctggcccccgcgcggggtttgggcatctcggcacgccggctctgtcgtggcctcaggggaacattgtcgctttcgctacccgcggggccgggcgagcgggaagctcggcacagtgggagcctggtggtgggtctcctggggccggtcgcaatgggtttccgggggtcccgcggctgctctgtggaccccttcggcccctggtgctccgggcgctggcagcgtcaccggacaaaggccaccgagcgcgggggtgtccccgaggtggacgcgcgggtttacttcctctccggccccacgggcgcgcttccctcctgacggattccgaagcccgccccaccaccgtcaccgcaccagtggcccaggcttcgtgggaccaacagggctaatcctgccccacggatctaatccggatcgggacccggtcccaggggaggcccccacctccccttctattgttctgtggcccaggtgagcgtcttgttccctctagactccgtttcacaacctactcccgggtcttcctcctgggactggggatgggcgggttctgatgtggccccagggcgagtgacctgggggcaggagctcccccgccccccgccaacggctggacagcgggcaacggaatcccaaaagcagctgttgtctccagagcattccagctgcgcttggatttcgtcccctgctctcctgcctgagcagcgccctggcccagatggggtgcccctgacccccagacatactttactgagctgcttgggtctcagttcctctcagttgcgccctcaggctggaggtgatgggtgtagacgtgggagagccgaggctggtggccatctctggaaccctggggaggattggcgagggagggtggacccaggacctctgggtagggctgcaatggtagtgactcccccagggctgcctcagcccgcatctcgctaaagatagccctcttacttcctggggaaaaaccaccccaaccgtcttcgtggatgagagtatctgaagtcctcagtttgactgagggttcccaaccctgctaagcagttgtctccaggtcatgcaccttcagaatggaaagcgctttggaatgacacgatcactcccgttgagtgggcacccgagaagccatcgggaatgtcgtgtccgcccagtgctctttcggcgcctcccagcagggcctcagccctggcccagaaaggggccttgccaagcttttcctgcccctgggtttccctgctctccggatttcccaactctctctactgagttagcttctctattaaaaggaatgggggtggggtggggggtgagtaagttacagtgaaatgaagacatttgggaacctttgtgggagaaagaaaaagacctttcctattggtagaggagcaagatactccaactgaggcctattttctattatggtcgcattatttggttggcccgtaaatggctgttgcctaaaacaggaagctttaaggatcgttgttaaagcacaccaggttaaaggagtcacattaaaagctggtcattctgagccgggcgcggtggctcacgcctgtaatcccagcactttgggaggccgaggcaggcggatcacctgaggtcgggagttcgaggcttgacaaacatggagaaaccccgtctctattaaaaatacaaaagtagccgggcgtggtggcgcgtgcctgtaatcccagctacttgggagactgaggcaggataatcacttgaacccgggagggggaggttgcggtgagccaagatcacaccactgtactccagcctgggcaacaggagcgaaactccgtctcaaaaaaaaaaaaaaaaagtctggtaattctggaagccatcatgatggttgtgatttctcaggtatcaagagaagaaaaccgccaactgtatcagagtgcttatttattgggcataaagaccacccgggctgggtgcagtggctgatgcctgtaatcccagcactttcggaggccgaggcgggcaggtcacgaggtcaggagttcgagaccagcctggccaacatggcgaaaccccgtctctactaaaaatacaaaaattagccgggcgtggtggcgggcgcccgtaatcccagctactcgggaggctgaggaggagaatcctgtgaatccgggaggtggaggctgcagtgagccgagatcgtgccactgcactccagcctgggagacaagagcaagactccgtctcaaacaaacaaaaaaacacccatatctcaaacgagaaaatgcttgcaaataacctgaaaccgcggaacactattctttttaaaacgagatattttaagtaggtcgtgaaagtggccttaatgttatactgccttattccagtgacgaatattcatcatgtgtaaaatgggagaaatgaaatgttattaaaacaaacatgtgagacttcgatgagaagagacggtacccggtctaagcgcccaccgggtcgcgaggatccttttcctggttaaggcctgggtcacagcgaaagaaccctaggcccagggagggccccgagatttcagatccggggcccggctgtgcaggtggaccacgcggaaggggcgctgggggcggtaggtcgaaagcagccgacagggctaccactggcgcacctgtccacttacggggaccaccgccgcatccccgccccagctagtcggtcctttccggaagttccacctccctaaatttttttccggttccgcttactccttccggtcaccatggcgaccaggcgccttggggtcggggagacgctgggggccctcaacgcggccctggggccaggcggtccggtgtggatcaaggagacgcgcacccgccacctgcgttcccgagactttctggcaccgcaccgcgcgctgcaggcgcgcttcgatgacggccaggtgggcgtgagccgggcggggccgtgcggccgggagatgggccccgtgccgtggctcttttacacgcccgttctcccgcaggttccggagcatttgctccatgccctcgcctgcctgcagggccccggtgtggccccggtgctgcgctgcgcgccgacccccgcgggtctgtctctccaactgcagcggtccgccgtcttcgagcgcgtcctcagcgccgtggccgcctatgccacgcccgcctcgcctgcctcgctgggccagcgcgtcttactacactgcccagcactgcgcagctccccctgcgcactccgcttgagccagctgcgtacggtgctcgtggccgatcacctggcgcgagccctgcgcgctcacgggtgagcggggccgcggggccggaatggagaaagtgggactgccgggtacctagaaagcgagcggcgccgcccgtggggactgcggctggaggtgggaagtcgtggcgagctggaccaggtgctcagactgaggcggccgccctcccttcgcagggtgtgcgtgcgcctagtgccagctgtgcgggatccgcacatgctgaccttcctgcagcaactgcgggtggactggcccgctgcctcggagagagcttcctcccacaccctgaggagccacgcccttgaagaacttacctctgctaatgacgggaggacactgtcccctggcatcctaggcagactgtgtctgaaggagctggtggaagaacagggccgcacagctggctatgaccccaacctggacaactgtctgggtaggacctgaagcctagcagggccagaaaaggcaggagggggttaggggcacatctctgcttcttgtcagtctcagcacctgtctgttctcttttcagtgactgaggatctcctctctgtgctggctgagctgcaagaggctctatggcattggcccgaggacagccacccaggcctggttagtgactcccagccctgtaggttctcccaaaccaagtatactgtacttccacagttatgattgtcctcccttaggctggggcctcagatactggtacaggcggctgcctggttgtacatgttgttagctgtgaggaggagttccagcaacagaagttggacctgctttggcagaagttggttgacaaggctccactcagacaggtaggttaataatgatggtggagctccccaccacctaacccccaacctcagagggcccttgaaaacccaccgaggggcttgttagctgacagaaaccaacacttgaccttgggggagttgctggacttgagagggcatgtacagcaggtgcagaggctctggggaaggggggtctgtagacacatcccaagaacactgaagaccaggttgagaaggatgaaccatgcgtagcctgagtggctgggtagacggaggcactcaacctggcagttccaatttgagggagtctgggctgagtagaggcaccagatttgggctcctcaagggacttcctggagagtagcgccaactaggctgagcccctgacatctttctgacagaagcacctcatctgtggccctgtgaaagtagctggtgcacctggcactctgatgactgcccctgagtactacgagtgagtgaggctgggaggaacaccaacctaagccagggtaatgaggggggactctttacccaggaccctgcccactggccttcctctcttccaaacacaggttccggcatacccaggtgtgcaaggcctcagcactgaagcatggtggggatctggcacaaggtgtgcctgggaaaccctggctatgttctgggttaggggcaggttttttgcatccctgcccttgcctgcagactgactgaccaaccctatactccctcagacccagcctggacagagatctttggtgttctctctgtggccaccatcaagtttgagatgctgagcacagccccacagagtcaggtgagcctgggagcctgacagggccagtgttggggcacagggtgtggtggctgccttctctctctgcagctgtgcttctattccccagctcttcctggctctggctgacagcagtatctccacgaagggcacaaagagtggcacctttgtcatgtataattgtgcccgtcttgccacactctttgagagttacaagtgtagtatggaacaaggtctgtaccccacttttcctcctgtgagcagtctggacttctcactgctacatgatgaggtgagtgtccctcctggtagctggcacaaggaggcctggacttcccctcccagcacctttctccccaacagggtgagtggttgttgctcttcaacagtatcctcccctttccggatctgctgagccggacagcagtgctggactgcacagccccggggctccacattgctgtacgcacagagatggtgaggcatagacaaccaggacactctacactctattctttattctggcctggggcacaagagcaaagagatgggccagtgactcagtctctgtctctagatatgcaagttcctggtacagctcagcatggatttcagctcctactacaaccgggtacacatcctgggggtgagcacacagcaaaatggggtgggacgtgcagagaggtatagggtaaaggcaaaggaagcagaggatgagaccagcaggccctttctctttcaggagcctcgaccacacctctttggtcagatgttcgtccgcctgcagcttctgagagctgtgcgtgaggtgctccatactggcctggctatgctgggtctccctccactgagccacatttaaggccacagaggctccaatacctgggaatgttcacaaagtcatcaactggaaaaaaagcaaaaacccacggccaaaataaattggtactgtttgttacaaagttctgtcttgtcatggggagtcgggcatattcttggcagcactccactcaccttcagctcctgcaccgacatcaggaacccacggccaccacctcctcccctcaaggcatgctgagcatgggcacagacagcccatccctgctccatgctgtctgtgagcaggccccatgcccagcacgccagccaccgcaggatacctcagtcataccagttgtaaacctcaagcccctgacccccaagggcacaacggtggccaaactcagggctcacaggccagcagtccatgtcagccacatcaggcacatggaacacagtgctattcatgaaggtgggttcaccatgccccagacgccagaaggtcagccgttgatcaatggaggctgagaccatgatgcttgggcttaggatcttgaggcctgtcacatgggcagcatgtgcacaggggacagagtattcctctagcacacgcagctggggtaccagcccagcctctcccacagcctcttctagctgtagcatctccacagcaagcacgaagacatggagggatccatcttcactgccactggccacgagatggtggccctcacgggtgggcaaggtgtgcaggctgttgataccacagctgtgggcctggagagtcagggagggggtgccaagccctgaaggaagaggaagagggtagttgtcagggccccgcctgccacatgtgtgagggctatgtgacaggtgaggaggggtagccatggttgcacattagctactcacggtagggaagcccaggatccactggaggctccaggacagtggagtcatggtctagcatggtggtgagatcccagaaagccaggctgccatcagtagctgcgctgcacaggaggagcctcctgagagccaggaaaagacagcctggtcaataacagagatgaagctcaacaggaaccccccaacccagcccatgcaggaccatcatccagcccctctcaccgcctctggttgggtgcctcgtgtgtaaaggagtggaccttgaggacacatcgcttatggtggaaggtttcagcaaggagctgcagaatccgcccagaatcctgcaaaagaaagagcctggggggcggggggtggcccagctcagaacgcatcctagacaaccttacttcctttgtctcctgtcccactgggccctatgctctcaccttacggccccatcactacaggctgcagccacaagggggccaaggccgggctggtcaagttcacacacagcaagggacatgtacctgcagagacaacatgcagctgtcaggtggagcctgcaagcctgggagcatctgcatgacccataccacaccctgcccaggagcatatattacctggtctctgggtctaccttaaccatccgatgccgattgcgttgccggtcccaatactcatctagccggtgggacgaaaggtgcatgacatggcaggcgaggcggcttggggtgctggggtccggagtaaccatgatgctgaagcagtgcatctcagcccgcccccccgcagacaccacatgggcagtcaggcctggctgaggatcctgagggccacctggggtgccaatgccccacacagccacagcacgtaccgaggagatatggttacaaacagctgtgagtgcgtgggctgagcctgtggttgtagggagtgctaggacacagacagtagtgtcctcactacatgtgatcacaatgtcagtcaagtcgggcccctcactgccaggctccaggtcatcaggctgcatgaagctgggcactccatattcaggccccagggtaatggtgcccacacgctttacacaagtgatctcacggccatgcagaccctcccggagaatcacgtgtggccgggtgcagccacccagagccctgtacagcatgacatccccatccttgaggtaagcaaaggccatggccgcctcagtatcagagaatgcccacgaacggtgccctccaccacagttgacgatgtgcagcttctcgtgtgaccgagggttccacaccacaaactcattggcatggaaacccaggataaccatgctcccatcgggcactatacggagcccagctagccagttcatgcctcgacaggacttctgccttaggactggctggagctggccgtctcgtacaaacagctggtagtaggctccatcacgccctgtggtatacacatagccaccatggcatgtgactgaggtcacaccctgcttcccgtgcagagagggcagggtagacactgggcccaacccagtgaaagcattcccacccccactactaccactacccactacaggtgccccagcaccagcccgagccttgcctcccaccccagggtccttgagcagacctggtctggaggggaatagcagcacagagccccggcggtcaccacacaccaggaagtcacctgggggtaggaaggcactgcatgtgtgccatctctgcttgcttgggggcagcaggtaccgacaacgttccttgacaaagatggccttgccagagggtgcggctgagatctctaggcaagctactaccccgccagggcccgatgccagcaacaggagctcctcataaccacgcagggcccagctcaagctgtgcaccttcccaggaaacagggtctggtccacagcagcagttggagtgttgatggggacaaccttgacacgaccttccccattggccatagcacacaatccgaagccctcgggaccaggagctgcctccagcaggcagtaggactggaaatgtttatcctctagcagctgctcccagcacttgacctcgacgtcatagagatacagggcccctgtatcagtcactgccagcagtcgccaagagccagccagagtcacagccttgagtgtacctggcctactacgggacttgaagcagagagccgagacccccaatccccggtacccacgccctaccaagtgccacagccgaatgcctgagtcatcacccccagtgatcacccaggcctgcctctcatgggcagctatggcccggatcccacgtccctggtgtccccgaaaggcctggaggatctcaccttcatggctccacaccaagcagacacaatcctctcctgcactgataaggtaattctctagaagcttgacctgccacacacgggcgctgtgcccaaagcagtgcccaatattctgcacccgacccccaggcactcgcaggtcgcccaccttccagatacgaacgcttcggtcttctgaagctgtagccagcaatcccttgctttccaggtatgacatgctgaagatgatgcccacatgcccactgattcgtcggtcaggtgctacaggtttgttgtctgctaaggcagttgctgggtaccagaccaagagctggttggaaacagcacctgccactatggtcagctccttccaggcgtctccaatcaggcaggctgaagagagggtgcacctgtctgtgcagggcacctcttgcaggatgcaccctactacagggtcatatagcaccactgagttgtggcccagggccaaggctatatttccctcaagccagcgtgcatcccaaatccagtcagacatgttccacaggccagagcgccaaagctcccagaagtggccctgtccccagctaattttcacaactcggagtcccttgcttccaaacacagccaccatggcctccaagtcaaggtctccattaggctctggccgtacccggaagccatggataagatagtggccaagcaggttctgcactcgctttatcatccgcagatgcccaccaaagtccaagctgtacaccaggacatcgggaccctcacctagatagaggcaaagagccatgtcagagctaggtacctaactctgatgacccacagggaagagatggggatcagggaaacttctcggcatgtagcctatgaatgcatcaggacacacaatcctgcagcttgaatcttagaaaatccttggtctcggccgggtgcggtggctcacgcctgtaatctgggcactttggaaagccaaagccagactctgtctcaaaagaaaaaaaaaaaaaagaaaatccttggtctcggccaggcacggtggctcacgcctgtaatcctagcactttgggaagcccaggcggatgaatcacctgaggtcaggggttcaggactagcctggccaacaaggtgaaaaccccatctctactaaaaaattagccaggtgtggtggcacgtgcctgtaatcccagctactcaggaggctgaggcaggagaatcgcttgaacccagcgggtggaggttgcagtgagccaagatcataccacttcactccagcctgggcgaaagactcaaaaaaaaaaaaagaaaaaagaaaatccttggtctcagcttcagctggactttcagtgctgactttgtgcttccctcatcagtcattctttttttttttgagacagagtctcattctgtcgctgaggctggagtgcagtggcaccgtgcagctcactgcaacctccatctcctgggttcaagcaactctcctgcctcagcctcccaagtagctggaattacaggcgcccaccaccacacctggctagttttttttttttttttttgagacggagtcttgctctgtagcccaggctggagtgcagtggcacgatctcagctcactgcaagttccacctcccgggttcaggccattctcctgcctcagcctcccgagtagctgggactacaggggcctgcccccatgcccggctaattttttgtatttttaatagagacagggtttcaccgtgttagccaggatgatctcgatctcctgacctcgtgatctgcccgcctcagcctcccaaagtgctgggattataggcgtgagccaccaagcccgaccagtttttatatttttagtagagacagggtttcaccatgttggccacgctggtctcgaactcctgacctgcggtgatccacccaccttggcctcccaaagtgccgggattacaggcgtgagccattgtgcccggccccctcatcagtcactcttttttttttttgagacaaagtctcactctgccgcccaagctggagtgctgtggcgcgatcttggctcactacaagctctgcctcccaggtttacgccatcctcctgcctcagcctcccaagtagctgggactacaggcatccgccaccatgcccggctaattttttgtatttttagtagagacggggtttcactgtgttagccaggatggtctcgatctcctgacctcatgatccgcccacctcggcctcccaaagtgctgggaatacaggcgtgagccaccgcgcccagcctcatcagtcacgcttgatgttcacttcaaccacaaatttctcaaactcagagcctcctcctcacctcactttttttttttaattaaaaaaaaaatagagatggggcctggcacagtggctcacaccgataatcccagcactttggaaggcaggaggctcgcttaagcccaggagtttgagaccagcctgggcaacagggcaaaactccacctctaaaaaaattatacaaatgagctgggcataatggcgcatgcctgtagtcccagctacttgggaggctgaggtgagaggatctcttgagcccaagaggtggaagttgcagtgacctgagattgcaccactgcactccaccctgagcaatagagcaagactctgtctcaaaaaaaaaaaaagtaaaataaaatgagaaggattttgacaatgcaaaaagaaaataaaagatgtaaaatgagaaagtctaatccagtggttctccacagggggcaactttccccacaggagacatctagcaatagctggagacacgtacggctgtctccaggggttgtgctactggcaagtaaggccagggatgatgctaaacatcctacaatgcacaaacagcattccaacaaagaattatctggtctaaaaggtcaatcgaggcaagattgagaaaaccctggtctaatctaacaagactgggtgagtgtaaggggaggccaacttgaggacacaatatttagagttaggattcaaggataagcagcagttagccagaggaaaggaggcggaagagggggactgggaaatgttggggcgggggggggggggtggggagcaatgggagggtttgcagctttcttggtggagaaaacagcatgtatgattgccctgagatgggcaagagcattgagtatggtggatggaacaggaaatgaagagctcaggaagaggctagagaggccgggtatggtggctcatgcctataattccagcaatttggggggctgaggcaggcgaatcacttgaggtcaggagtttgagaccagcctggccaacatggtgaggccccatctctactaaaaatacaacaattagctgggcatggtggtgggcacctgtaatcccagctactccggaggctgaggcaggagaatcacttgaacctgggaggcggaggttgcagggagccgagaccgtgccactgcactccagcctgggtgacagaggaagactgtctcaaaaacaaacaaacaaacaaacaaaaaacacacacacacagaattgtagctatataaaagtcactttggaagccacagaagtaggtgaattcacttgcagagcttcttaaactgcatttcccaagttattccccaccttaaaacccttcaataggttctccccactgcccttagggataaagtcagatcaaggcctgaaacaatgtggcctctgctcgcttgtccagcttcctttcctcccagactccattcctgctctaacttcacaagaattccctccttcccccaaaatgacagattcttccagcctcaaggcctttggcatgcttaccctcttgccaggaactcaccccttttcctagttcactcttgtggttctttgagtttctgcttcgttgttccccctcaaggagccttaggagtttagctcgcggtaggaactccgcgctccaagaacccccacaccagatcaaaactggatcatccccaccccatacacacaccctcttaggactggtggcaactcactcaaggcctgaccgccaaggccctgcctcaggacccttatacaactcagcagcaccaacatgggtcattagtggcttcatgtaatgactgttcgagaccagcctggactctgacacctcaggtcccaggcctcgcctgtcctttgcgacccggttctccttggagggacctccacacctgatttcctggacctcaaccatctcaggagggggtctcagcccctgcttccccgggcaccgccccctactcggaaaggtcttatccgccgttttccgcgacgccaccctcctcagaggatcttcacccccaccttagggggaagagactcatcccgccctcgagaggccacacccttgccctctcccggccccgccttccccaagaggccacaccccctgaggggccggggccgcctccgcctcctcctcctcctcctccctccgccccccccagctcggccccgtctccttcggagaggccaagcccccgcccatctcctagaagggagcacaccccctcaaccctcagctcccgggcctccgcctccgcctccgcgcggccgcgttcccctgcaccctcccgcggttccacccgccctttccacgcgggctgaagtttatgaagcgccgcggcggccacatcagctttgtctctcgggccccgccctcttcaggttggccctcgtccccgccatctccggggctcccttcccacctccgatcggcctcaacctgctgcccgtccttctcctcagggcaccccttttgtccctgtggcaccgcccctgggaggcgctgtttctttccccctttccaccaggcgtgcctcaagccaagcctcacccgccaacagccggtcccccacgcactccagacccgtcactgggaggagtataagctccgaggttgcccgcggccaaacgtagtcctcgagagcgtccatgtcgatcctcgaggtgctgaggcagccacggctaagaagggagctgaactctcgcgagaacgagccttcccagcgcgccgcgctgcccatcaacagcgccctcagctacaggtagcagagaccagggcgcccgcggcggttgtccaatgacgacccttcgtcccacgcaatccagctcatcattggcggggcccgcggaggggcatcccgcccctcgccccctcacgtgacgcttgcggggcgctcccagctgccagcccgctgcacctatcgcggactctgtttcgccgacccggagtttgtcgggcccggcggctcgaaccttgtggttttttatttgacggggcagatggagtcagtacacaataaataacatgaatataggaactgcgccgtatcgcggctggcggggtggggcaagacattggccagacctttagtctgcagcaggacagaaggacagccggacccctgatcttgggcaactggcgacccgcggctgggaaccggggctaactcttccctcagagttccacgcgcgcatcgcggtaggcccggtccagagcccactcgggctgtgagtcggtgcccccttctcgggcaaggcgggccatctcctgttggaacagcgcttgccgcgctcggctggggtccacattaatccagttgttggcaatccacttggtgccgcgcgtgaccaggcagcccccgtgcagcgagtagtcgtctacgtcacccacccaacctagaagaggagggtgacgtgagatcctaggctgggctggccagagcttggcctcataggcaccaagagcatgaccaaggtgggtccagctatgcattccttgtgtagcaaacacccagacctaaagcttccttggaggctcctcatctcagcccactaatgtatagtcaacactactggccctctgaaaccagctttcttgctgttgggcctgtccatatcccttcccatcctgggttagcaagggacatgtgtcccaagccccagggagtaggaaggctggggcatcagggaatgatagggatggatataacccaataagcagtacaggtcctggggcagtctgctaaagtcactaaggatggcctttgggaggcaccaggagcagaaaactatttggaaagcagccagaaacagccctccattgtggcagacgggggctgggtaaagggaagctgtactcagggcaccccccccaggcctggccataggccctcaccttgcccatcaggcaggtagttgtaccagaagactgctgtgccctgttggggcttgacacgcaggtttcccttgtcacagtgcctccgtgtgtcacggaggtccacgtcatcctgaatcagactctgtgggcagcagggtggtggggtgttcaacctgtccccactctatggccaggccagccaagggtgaccaaagggaaaccaaccagatatgcccaaggaataatttgggcccacatccttagacctggagaggtgtgtacttcacttgtctaagcccctgccagcccacaagagtaatagcccagttgacccttaccatttcatcgtaggttctgttatctgctacagggaaaacagtctcgcccccaccagtgacgttgttcaaataaaacagcactgtcatgtagctgtaaggcagggggggcactgagcaggtccccagttgtggatgctcccaggggcttacctgtgggcaggataagctgcccaggttcctgttgccagggaccaggacagactaggatgggagacaatagggcaggccagtgccaaaatgtccctagcccctccttccccgaaacccagtctcttactgtgagttgcaatggttttttggccaagatcacaggtgcacttagttaaatgccatggccctgagcaagggcctggcagggaaaggtaggctagcagaagcaacagggcgcgctgaagggctccttggggatgggaaggggctgggccagaacagccacctgaagaggaaagaactggcttgacaggggagggaggcacagcttcagcttctctaagtggaatcaagatcaacacctggaggaatgggcaggacaagctaggggcccagccttgccccttgcttcagaactcagggggcaagttttggtgtctgtgggtacatcagtctgtgttgactccagtggtcacgatgaccagtagccacccctttccagccattgggtaaacaacttgtggggagaggtgagggcatcactaaccgggataacccagtgatctcctggccccatgccaaggggcacgcccacagtgcagggctgtgcctgtgtcatgggtgttcctggtctgaggattgaaggcagcccccagttgggagatacttgccggcaggaggtctcgaagggtacagactcgttggctaccagcttggtatgggagcagatggtctctgggtacacaggcccactgtccacgtgggcatggtagtggcccccctcaccatatcgaacaacctgcagcggctcgctgagctccacgatctcaggcgacaggcgagtgaggcgcagcaccctggtgggcagcaggcatttggctgggcagccccaggcaaggtggtgatctgaaggagctggccaaggtggaccctaggcctgccacaagctttgcccctacccacctcccctggaagtcccttaagccatctcagactggccctgtaagagcaggagggggttactcatgatgatccttctccctcagatgccaaagacagagacacctgctatgtggaaatgttgacatttccactaaataaagggggcggggagtcctgaggtcctcctccctggaagaaagttgtttatttaaaaacccttttcctgctgtgacggggtcagataaggggtcaaagataagaggtcatttatctaatcagaaagaagtgctcaatctctatctaaccccagttgcccattgtgtgcctgcaaggagggctaatttgcctttgttaattgcctgtctttcagtgggtcccaatcctggtctaacaaatggaacttaatcccaaatgggttaatccattctgtcctcttggccccagacaaggacttctgtggaggccctgcccagtcttctccccctgctccagtgagaacagcttcaggtgctcacctctggcggatggcacgcatgatgtggtgggcaccctcaccctggtagagccaggtatggtggctgttccgcaccagctcactggactctgccttgtggctcctcatgtacttgtggaagtcccgaaggtccatgttggagaactcctgcagactcagcactcctgcacagggcacccaccatcaatgcccaccaagcccatattgggaggcaacagtggcaggctgcacttccctacctaccccaaaggcagcagcagcccctgacctcaggcactgaggggccttgtacacttgtcccccacctggacttttgggtcagatgaacctggtttctgtcacatcaggccttacaggaagacccagagcagttccttttctcagtttaagccctaatttggccctaagaagaaagaggcccaccccctattagagtggccagagaaggttctccaaaggaagcttgagccatatggccaggaccctggccttccagcctggctatatagagtggtggccactctccggcctgtggagggtgaggagagagcaggcagtgctgggcctcatccagggccttacatacatacgccagggtgcaagcagggccagcccccggggagttcctcatgaccccaggtttcatcctgggtggaacctacttcgccagccctgcctactgcgttaccagcccaccttagcaacgaaagtcaggccaccccctctcatgagaacattctccactgtccctgctcaaaccattaagcaggggttctaccctcttggggttctggaagagtagttggtatctttgctccatgttattctggctgacccaaggacatcaccttccactctttggcccagattcctctgagggtgggggacattcaagggctgtgagactgtcaccacctctgttctggggcctatagcagtgtggcagccatccagccacaggtcacggccagattcttcactctggttcaccagccgcaaagccactgttccaagtcctttctaactgctgtatcttcctctcttggtccagaatttgggcatgagggtgatgaccacacctcagaaacctcctgagagttattaccagagggggcaccacttgcatgacagcttccctgcccacccctccccagcagttagcacaggtagcagcactaccattttaggcgcttcggcatgactccaggtggacaagaggaaggcaagggagatctcacttagaccagggaagctgtctgctggggtggacctcgtgtctggctggagagatggatggagcagggtaaacagccaagctctagctggcctcactgtcgccttgctcctgctccacccactctgttctctgccaactagcagccctacttcctgtccccaggctctcaactctgcctgatgttatcaaaagggtctccaagaactgccctcgagaccatcaccaaggggaacggggggcctggctgcctgcctacttcccaggggtaaaaagcaaggctggatcttcacctccccatctctggccactataaaggggtgcagagaggctgcctggctgtgggggaagggcccaagttttcaaaattgtgcacctgggagtgggcaggaggctcacggggataggactgtgcagaggtgtgagctcaccgtcaccatcagggtcagccttgatcgcggcgtacatctcctgaatgctctctggagtcatccaccatccatttcccaggcgagtctgggccagaacctaaagcataagagggtccctcagtgggtgaccccagtgatggagagccagcagagaacagatggcccagtgcttgttgtggagcaaagtgttcaggtgagggcatggatgaggacacagggcagagcccattgggccaaagtgagtgcaggtagaaaggtacagagcatctgaggagaaggccgggggctgggggtcaagaggcgtaggccatttgcattcccggactaaggccccgtggccttcatggagagcactgttggttggaagcagagtgaaggacaggcctgtgtcccactcagatactccgggtgagatggggaaagccaagtcctgggtgttaagggagaacaggcaccagggggagacctggttagggcatgaccaccagatccctcagaaagaccaggctcagtggggtgttctgtgtgggcagtgccccgcaccaccaccctgccagacttctctcagaagcttggccctccagcctggctgtagagtgtgtgagagttatgcagagagagaggcaggctgctggccacctcagagctgccaccccatccaccatgagttctgtggggcccccagccatgagagcaaggaatgcaggctacagaggtgcatccctccaaaactatggtgataaatgccatcacccccaggtggattctcctgccatcttctgaggttcccagggtagccaagagctctccagagggaaaggggacctcctgggtctgggcatgcccaggcaggtctgggtagtatctgacttttgggaccaggcctgggctggacaagtgacctggccaccagaaaggtgattctgggcactcccaccctgagcctactcaggtcccaggattccaacctcacggagctgaaggtgcccatcacggttctggtccagcagccggaagaggtccagctggctgacctgcatagtgctcattgcctcttcatactcttcagtaggcaggatctggctgcgctgtaaccccttcatctgcgccagatggatgatgagccgacactcttcatcagtcaggaagccggggatttctgccagaagaggaggtgggtgaggccaaggactgagccagggcgctggtgcacccagtaccttcctcccttcagggttcctggggtactgcatgtccctcagtggccaccaggtctggaggatggaggattttacagaccccttgattctgacttgtcaagattgagttgtcctgcaaaggctggctggcgttggaaatgtgggacctctcttgatgatgagagcacacattttccaggagagccctgggaggtgagccagagctaacctggatatgggctgacccatctttgggttgggactgaaggctagagagtgatcctgaagggcagaggcttgattgctactttttactgggtataaatatttaaagtggggagatggtggctgcttcttgctttcattttaacttttcagcattattcaaataaaaacagcacaagacatccaatgtttcaggccagtccaagggccttcccctccaatttcctgcaaagatgggtgctggccatctgaccagggctgagttgcccagtgctggaagatcagtgagggttactcaggttttgggcagatactggtctctgaaaagatgtcccaggtgtcctttgcttccttgattccttccctggtacaaatgttcacttagtgcctactctatgcctctacacccctgagtaaagatcagtcaggcctggggcttggcttcagtggctggctgcctgcacaccaggcacagctggtaggtggcttggtggagctagaacctgagcctcacatctagggagcccacattctggtagccccagacacttccagagcaggagcatgggccctgcttccttcccttgttcctgggagagcggtcttcactggaggacaagaagcacgcagaggagctgactggaggaagggcagcactgctacctgcggagtggcctgccgcttctctcagttacacttccagcacaaagttccagtcattgccaagaggaaggaaaatggtcactcagcaccagggttggagctttttttatttttttattttttgtagagatggagtctccctatattgcccaggctggtctcaatttcctgggttcaagctatccttccacctcgggctcaaaagtgctgggattataagcatatgccaccacacctggcctggagtggtttttaatagtaattacagcagaaaatacttaggtagcacagactctgcccaaggcactgtcctaagcacttcatacacatcaactccttaatccttatacttaccctaggaggccaggccccattaattcaaccttcctatctaagaggaaacccaagcacagagaaatcagtgccttgccactggccacccagcctgctgtgttccagaaaccatgctcatgaccagattcagctactaggagcaggtgaccctgatgtgataacactgaggataggacaaaggcccccactcttggcctgcatgatcccgtgaccccagcaaacccagaaagggtgtgatccaaggggagacagccctgtggaacaatggattagatcaaattgcaaatcaacagagtcacctcttgattgcttaacacacaaaatttaaaaagaaagaaaaaggaagccagaaaaagaaaagaaaacacaggcccaggtttcttcagtttattaggtgccagtaatctgcaagcccagtggaggtgcctccagcctctacagtcccctgctgtgtgctaatcaaaaacaaacagcccagtcagcatgttggggcctcaccaggtgggtccgggcacctcggagctgtgcaaacccctgcaggatctcctctgttggctccctgggtgcaggaacagccctataaaaccctcaacctcagttcattaaggccaaggcacagaaggcagtgatggagcaggggctgtggctgctggtgacactggtgatgctgtgggatgacagcagggtcaggggctccctggggctgcatgaggtgcatgcccattccccaagccatggccctatgccacgacattggctacacagatgcgtctgcccaacttgctggaccacatcacagcagctgaggccatccagcagttggtcagctggctgctcctgcttgcctgggagtgccaccccgatgcccgcctcttcctctgctatttacccctgtatgccttgacaggtaggacaggggcttccaggtgcagggccctggagggctccctcagggccctgctctggtggctcaggtcttcagtaatccttgctgagcacctgagcacctatcagggctgggcgctgacaggcacagagaggaaaatggatcgttttgttagagtgttccagacagagggaaccaggtgcccttaggcaggagaccatcaatggtggtcaagggctcttgaatgtcaagatagggcaggtggacaagtcgcttcaggctgggggttgggggcaggcgggctggaacctcctctccaatgaggcgtggaagctatgtctgtccaaagagaccctggcaagagatggagcagaggcccttctggtggccttttctcccagagagtccagagatcccaaggctgtttcctcttccccagcctaacctatcctgtgaacaatggtttctcccaagagcctctgggtggccatgtcagcagaactcaggatcaagcccttgaactgtttgccaaccccagccctggctgcggtgccccgaaggcctttcaggacaagagggagggccctgtttcctcactttaagatggagagtaaaggcccaaggtgcaggccacctcttgcagacaatggatgtccacagagccggagggagaggtgcactggaaagctggcaaggcacctgagtgggagggcgggagtgaagaggcagagctgagggctgagatgtggggcaagtgggaaagccaggctacggggctgttgctaggcgaccagtgtcgttgcccagcaaccagagagttccaggccacgagacaggggtaggaacatggagaggttccagctgatctgggtgctcagcctgtggcggtgcagcccccgaccctttcccccaaagggtcatctacccctcctacagcctgtgcgaggccatgcaggccagctgcgagcccatcatggcctgctacagctacccctggccagccatcctgcattgtggacgcttccccttgggccatgatctctgtatcactgctgtggccaacaacggctcccgcctggaccgcccatgtgagtctgcacatggctggtctccaccttgctcggccccacccctttcaaatcattcaaatcatacagggatcaggtaaactgtactcaatgtcacctacagcaggcatccgtctcaaaaagggtaaaaaagggggaaaagtggagggatcagccccctccaccccctcctcactccacccccaaccacactggccagtgcctcgccttgcccctcttcccagcgctgcatgccagctgcagggactgcgagttgcaggatgcaggctcctccaaggaggttctggacactctctgcaccagtgactttgatgagtcctgggcctgtagctttacacaccccttccaagtgcctccattgcagctcctggctcggggctgaggcagtgtaagagggaatatccaaatgctatgcctggttggaacaaaaagaaaaaattcctttacaagcataggacattgctaaaacaacaaaatgaaaccaaaaattctgctaaggaaggtggcagactgattctaagggcagagcatcagacaaaagggtttagtctactaggtggaggggactgatggactaaacactcttgggggtttagggaggactcctagaggcccatctcctcaccggcccctctgttcccactcagcagtgaaggtcaggttctccaggaccaacagtacttcctctggcccctgggactgcaacctgtactccagactagaggtgctgaagacaggaccactgccccctgcagagctggagcccaccctgcaacgctggctgcagctggatgtcacatgtgtgtacaatctttttcgaggaaggcacacagggacctatgtgttgagtgggaagatggaggcctgctggctgttggtaaccacggcctatgcctggagccagggccaccaaaattttcgactggctgtgcgccattggcaccctcaccagtgccaagaatag

SEQ ID NO: 36007 - DNA, 37771 bp, Homo sapiens
gaatctacaataagacaaatttcaaatcaagttgctccactatactgcataagcagtttagaatcttaagcagatgcaaaaagaataaagcaaatgggaggaaaaaaaaggccgataaagtttctggctacaatacaagagacatatcattaccatatgatctaatgtgggtgtcagccggattgtgttcattgagggaaaccttattttttaactgtgctatggagtagaagcaggaggttttcaacctagtcacagagcagcacctaccccctcctcctttccacacctgcaaactcttttacttgggctgaatatttagtgtaattacatctcagctttgagggctcctgtggcaaattcccggattaaaaggtatggttttcaataattgtcctgaactctgctacagactaataaaacttcggtcaagttgcgagcaaaagggattatttggtgagaaaaagaaaaggaaaaaaaaaactgttaaacttttatagtttttatgcaacattttaaacaagtattatttgaaaacagaagttaaatatttgataaaatgattgaatgcattgttttatttctttctcttctgtttttgcaaagatgcttcttaaaaaactgtaacctaacaccatgactctctatattaatgtttttgtgtttgtattaatgaatgtttagctcttcaagagatggtaaccgaaaagtattctgaagtagcatatctgtaattgacctatatatttaaaaaatgtatttttctcctgaatttttgattgctttaaggacttttaaaagcccagaagaactgaactctggtgattagctgaaaatacctaatgtatatttcttcaaccccagaaatgaacagaaattatcaccagagaagtgaaaataaacattgaaaatatttatgttattaaatgcctaagatactaaaaacgctgtataatttcttaaatgtaaagtgtcccagtcagtatcttcactgcaagtgaaattttaagatacattcactataaaatgaggatgtgggttaattttctaattttaaaacagggtaacacagtgaccactgattaagtgggctcccagtgatgtaaatacctgtggcttttttttttcctgttgctgtttctaaccagaaaagagccaaatgcctcctatagtaacccttgtttgtggataaatgccgcctttattctttattttaaaattacatatattataattgaagtttttaatcatctagtgctgtaggattttaattttgttttgcatttatagcttcacttatctcttgagggttaaattttgactttgaaagtgacaccagaggcatagataacataatgcaaatgttgatctggatgacatacttcatttaatgggcttaactagttttaggaaccagaaattattatttttggtaaaacatttgtaaactatggcaactagcttcagtggagtagtgatattacattagtaattagcatcttggacattgtcatgcatttttagactacttaaaacagtttcagtataatttaaacagcatatcatctcaataacaatctctttggttactacttggacagctgctctttgctctttatatttctgattaattaaggaaagaaggaaatgacgaaaggaattatcagtattgacagcccacattaaatgttttaagatgctgggtcttgaagtaccatgacactaatttaaaacagatgattttatggaagattttgcacaaagtttctggacatgcaattattttttcacagtacagtcagggttaaatgcacacacacacatacactctctctctgtcacacacacatgaacacacacacatacattctctctctctcacacacacacacacacgagcaaatgaaaatgaaataaaggtcggtgattgaagttataagctgcctgtctatattcagcttcaatcaaaaagaatattgtttggagaatttgtaccattttaacaggagtaaacaaacataaattataatactatttctctcagctaatactcaacattttctttttgtgggttgttagtgaaacaaccaggcatgttctgctctggagaaaagatttcaaagtgacatctgcattaactgtcgttgctatttattaaatctgcaatgactttgcttcatttttcttttaaacttgtaagacattaaatatgcaaggctagcaagcttgtggtaaaccataaacattgcatttttaatgggaaacagatacaaaaccactccctcagatacaatccaaaggaacaggctgccaaaacaaaagtcttctcttaaagggatactcagtaactgaatgagagtgggctgctagaagaagcttaatgttgaacttaaagtggcagtgtgaataataatctttatgatattttgttaaatgaaaagccacaagcctgtattcaacatgtgctgccttagacacatatcagtagtaaatataaactaagaacaaacatgtaagaaactgaaaaacatttgtttcttctctagagaatctaggcaaaaattcccagaagataccttaaggttagatcatacaaagatctttcttttctcttctcttctttctttctctctctctctctctttctttcactttcttcctttctttctttttctctttctttctttccttttctttcttccttctttctttctttcttccttccttctttctttcttcttttttttaatatgctacaattggataatgactcaaaacagctgtaagattctacttacgaacgtacagctttaatatggattcgtctaagtgtacaattcaaggtagagatgatgggactaaatatctgctatgatgggactaaatatctactatgttttggagatatcagaatggtttcaatgcaatttaaaaaatatttcatctcccaaatgactttgctgctatataatcaagtacttttgttattcagatttattacgattttgtcactcagatttatttagtgcacttcagttgatttaacaacatagattcgtgcttgtggaatgaatggataaatatggaatacatttatcaaaacaatacttgtttttttacaaaatgccctgttagcaaaatgagatcatatatacatcacataaaaatcagaattttccatatgtgtttattagcttattaaacataatgtttgagaaactaggaaattgatttattttttaaagccgatcttgcttataccaagttgaggttttcaatctgctttttttatatcagaaattcgatactgaaaaaaagctaattttgtgttttaaaaaatcagactgattgcttggaacaaatggaataaatcgtcttgtcaataaagtgatggtcaattgagtcatttgtgtgcaaaatattgtgcaaggcccgggtacagaacaaggaataataagacacgccctgaaggagtacatcgtctagtgagggacagaccaagcacgcaaaacaaattgcaatataatgtgataagttctttaaaagaggtaagagcaacgtgctttgggagcagagaagagggagaaagcagcatcttgcctggatgagccaggggacacagaagagaagcccactatctcatttaatctttacaactctcttgcaaggtcggtattctacatggcaagtagctttgattgtcagggttcaggtgaggactgggaatggagtgacaatgaaaaggaatgtggctagagctattaattcataccaatttatgagtggtctgacatacagcacagggactgtggacagtattgataagccataggaagttaataaatggtttatagtagaaattaataagacaaaattgaatttttagacgatgactcaggcagcaaaatggaagatggactgaaatagaggaaatatgcaaggcagagatgaattagaagctcttgtagtagtttagggagagatgagaagggcctggatcaaaataattgtggtaggatggagagatgtgactggcttccagagatatttctgaagcagaaattggagatctcctatgtggatagagataattttatctgaccatgtgttaagtgagcattgaaaagcccaacatgatttattaccatgacaattttgcaaatgatttggatatatagtatatcatcttagtttagacccaaaattcaaacaagcagatttaaataatactcagatttctcatcctaagtaaatagctgtgcaaatgatactataatgtacctgattgtctttcaatacatttttaatgctctgcttcctgataacaaatgaaatattattttgcatcttttctctgtgctcactgtattgtggcatattatataagaaacgacacacagattaggcagtgctactcttcttaaatctctcatttgtttcctaggttccctggttgtgaaaatacatgagataaatcatgaaggccactatcatcctccttctgcttgcacaagtttcctgggctggaccgtttcaacagagaggcttatttgactttatgctagaagatgaggcttctgggataggcccagaagttcctgatgaccgcgacttcgagccctccctaggcccagtgtgccccttccgctgtcaatgccatcttcgagtggtccagtgttctgatttgggtgagtgggatgcagtttctctttacctaccttacttgttttattcttgggaatggcaactctgagagtttagcattttcagttttaatctctctaaatttgagagacagtgccacctaatgaggagtaaaggaagcagaacaggatagaaagaaaagtagcgttgttgttctctctttctctctctctctccctctctgtccctcttccttttttcctccattactttgcaatcttggacaaatcatttttaaaaatatttctgagctttatatcccttcttctacaaaataaaattttgaattaaaaaagtcttatgttctaaaatttcagagtaatggtttaatcttaattctataatatgcttttataaaatattagatattaagaaaatcaggtcagtctctctactattcacttagcccagacaacagagtttcaacattactaaattgtaaaataatcagttatcaaaagcaaaacacatcaaattttatgacaaaatcttatctttcaagtatcaaaatactcccttaatctctgagtcttagttttgtctttacttttgacattttgtaatccagctgcttatattctttagaaagtttcaaaggaaatatttatcactaaggtatggtgtaaatattcaatataattgtgttacatatatctttagcctaacaccctaaagacagtttgatttatcatcttttcagaaaaatttggtctggaaattccaagagcattacacttagaagataaatctccagaaagattgaagctcagtggatgggccaaaggggaatgaactcagtttacatggcagctcattcacattcctccttttgaaggggtgtattttcttactggagatgaaaagaaaaaaaaatctttatatcatgattccgccatgtgtacttccttctggaagaaattccatactatgatcaggcacttctttcagaagtcctatatttactcagaacatgctttctagcagtagtttgcagaagaaaaatgcaacttctacaattggaataaactgcctataggaacccagaaaaaatataaagtatattcagtagtaacgactgaaaaacacttgaaatagcttcttcaacacatatattgtatagctatttaaaacccaaatacaaatgttatatgaagactttcaaaaggccgcaggataattccaatggatctatttgttcagtcattcagaagctatatcgggaacccatcatggatgagctctgctctaggcatggggagaaaggatgaggaagacaaatatggccctagttcttgtggatcttatgttctagtggtggtgactattactttttgaattgtgtatttgccacaggggagattggattactcttcagaaattttataagcatctagagatgacctgcattattgccttgggcaggaaaataacagggttgaaaaaaatctgaacaaagaaatcaccatttgatggatatacacaggataatcttttctgaagttactaaaatggcgaagttcccaaaaaatgtaatgcgaattaaatttcactttgcctctgagaaaaagttaaaagaatttattattactctcgctacatgtattatcaaaaatgaagggttgatatttttaaggaaagaagagttggccagtcactttagtgaagttttattttttcgtaaatatagtttgcctttgcttccatgaaaaaatagctcataaaccttgaccctgatgaaagcactgggccagttttccaattctctgttatgtaaaaaggcataagtcaattgttcaaagtgaaacaacaacaacaacaacaaaatgtagtcttaggaagcagcaagttcactgacttgggatctttatgacagttttgttgttgccattgatattgttttgtttattttttgttttcagatgagaaagttttctacatgttatcttttttctaggagctcaaagtgtacatcattcctttattatagctaggtttactgactcatatactaaggaagtagctaaaattataaaaataatttgtttttaaaaccatatttaactaagggaactaagtaagttccaatgagcagtggtctcatgcaaggtattttcaatattttaaaatttacagatgaatatttaaatatattataaaagttttaatcagctatctctaagaaaatacatttcttaaagggaaatgaaattcacttgactttaaataaaacaaatgaactcatttcatgtttttaactattatctaactcttccttactttatgatgctggcaagctgttgagagccttgacatctccatctgcagaaaaatcacagtcttagaaatcctattaatcgtgtgaggtacctgggtcatagtagcagcttcatgcagtgttaaaattatatgatgattatatgcagtaacagatgaagaaaaaaagaaagaaagcaggagaaatgcaccacctcattcattgtaaatgcagtatagttgattttttaatttgttttatgtcctctagtgatctaagcatgaagcttgaattattataataaagaaaataaatgcaatgcagttggggatggcaaatgttaatgcttatctgtatcaaagactaacactgtcttcaggattatccttggtggattatccttggcagacacttaatgagcagagagaagctacaatgttgaaggacaaaagtcctttgtcatcttattatcgaaataatgtttaatacaaataaactttttaaattaaaatgtttgactactttttaccactaagaaatattcttggcaaagttaaacaacatcaaaattttaaacaattctttcaaagctaagaagtaaaaacctatgaaattaaaattatgtaattactctgcaggataatttgatgcctctggaaaaatgcatggactgttttagtccctaattctaatttatcacagtagtattaacacgtgcttttttttttttttaagaggatgagggattgagacagtaaacatgaattcctcatagatattggccaagttgtttcattgaacttgttgcaacttaccttgtaattggaaccacaattttatgagacccatatcttgtcttcttttatctatcatgttaagaaataaaccagttccctcttaattatagcatttatttcaaaaagcaatgttaaaaataaatgtagagttagcaaattcagaagtctttcagttactttataataataaatccacaatgtaactcattcttctaaaaatcaaaaaaatttaaaacgttctgattttgatgggattttctattttatatgcttggcatcctgaagaagacagcttcccttacttaggtactctttggcttagccattcatctttggatcaagtgtcaccaggtagtataatttggtatggacttaacacctcattactgaaatgcaaatcagtcctgacaagtcaaataagaacaagtattgtcttttgactagtctccaaaattaaaataataattcttgatgtatttcttataaacaaatttcagaagagttaaaatgcctcttaaaactatttaatagtggaaagaacttgggctgtgcagttaaacacctctgatctcaaattctgctttgctgtttactacctgtaaccttgaaactttcaaaactttgtttcctcatttgataaatggaaatatatcttatttcactgggtaagaatagaaaaatatatgcacaaatgtttattatagtaacttacatttcacttaccatttcaggcaaagttggctaagaacatgaggctgtttctgatatttccttttatttttatgtattaatgagaataataggtataggccatatacttattagagactctcaatgacttatacttattattctcaattcatattatatcatattatactcattgaaaataagccatatacttattagagacttatttagagtcttattagagacttattaagagtctctaataagtatatgggttgtcaagctagacacaaaatagtaccatctctctccacctctctaaagaggaccacatcatctccaaatgtaaatagacaagaacaaaaaaaattgtgcatttactaggcaattgaatgttctccaaaccaatattcctttgaacaaaatgagtttgtttgatttgagaacaatgaagtatttggctattttataatcataagtgattcatacccccacacacttagccctctagaaatggtgccagaagatgaaacacatttaattttgccatatagaagcattgcaaataactactggtttctaataatgtaccttataatgcaaataatgttttaatttttaaaaatatcagaaaaagtacaaccttttaaattatgtagttgcttcttcttcataatcatttttcttgaactggtgaaaaattttgtcagaagttaccacttgggacatattgtactacagcttctcgcttggctggagaaactggttttccagaagcagaccttatacaagaggtaaatgaaccattagacttctcccatgaaatcaacccagaaaaataaattaggactattttgtagaggaacagacagaatgctagaggctcagttgcctttatcatttatgtctggctctgcagcagcaggggtgtgaggtgctcctcattcagagtttcgaatgcaccaaaagggtgtttccaaaacatgatatgggaaggaggctgtgcacagagtatgaccactggattgcctaaattgacattgggtaggagtggagtatgggtgatcttcagatgaagcaagagtaatgctcaatgtgacctggttaaacaagtctcctgaatccaggggttaaagatggagaggaggaagagagggagtcaagaaggtcaaagggagcgtctgtctccctgacctgaatgacaactaacatagcccttgtttccttcttggtccccaggagggagagagaggcagctgtgtgggatcaaggcattttgtgagattgcagctgtgattcattttcctttggaagaacatccctagctccaggggatatggtgggaattggttagctaaaatatcaattccctgggtaaaagaggaaaaccatgagaccctctaatcttaacttttctccttcaaaagagtggaaaaagattacatagttcctcaaaaattaaaaaaaaaatgagtctgcaattcagtcttaataaaaagagaaagcccttagcatatatactgtaacagtaaagactcagttactcttgacttagtctgtggactgctttaacttctgtagcttgcctacttctgccttttttactgtaatctacatttgctttgattattctataataatcaattatatatacatatctgtgattatacaatatcttttatctttttatatatctattttattttttttcactagaaaagaagtattgcaataatttatcttcgtacaacctctacacaacaaactgccttatactttgtagactctttacacatcactgaacgattgatgaatgaatacacgaacatatgcatggcttggttcttgaattaatgcttggatgaatattctacaatattcttgactctagcaagctgcaaagagaagggaacatgcctgattgagaaacaaaagtgatttctcagtgcatccttgctccttccctttaaggacaactgtaaaaccaggaagcttagaaattccttgagtttgactggaaagagaatagaattaaagagaagaatcatctatgtatgaagcctggtctaactgataacgcagtcagattgccatttttaagatggaaaaaggggaacatgcttgccttgagcagaaaagtttttggtggggctggagctcctaaatattattttggtcatttgcccaaaaactgaagtacaccaccaatgtcccaattatgaagttgaatacagaattataaaaaaaaattgttgaaagtcaataagaataaatcttagaatttggactcctgccacatggcagaaaaaaagcatgatgttttaagacaacctggcctttgtccaacatgatgtttaccagattgctgacattttctagcataacaatactattcatcattgggataaccaaaagaagggaaataaaaaaaaaaagaagtctatttcttactagtctttattcagaaatgatttttttggtaatatcttaagtagtatcttatttgctttaataaataacttgattttaaagaagataaacctccttacaaaaactgggagagcaaatgtctaatccaggctaccttgaaaatagtgtgttttagtggaaaatttagaattatgttaaataaggctgctcaatgaaaaataaatgtaggaaaccactatgctcctgttactacagctgagtgaattttaccccaaaacatggtggcttaaaaaaaaatttaatttgctcacaacttgaggtatggaaaatttgggaagggctctgaagggctgttctcacttggggtcactcttgcatttgtagtcaaatgttacccgggatttataatcttaagaaggctagcctgggctggacacctgttcactctcataactgacagttgctgctgctgtcgcccacaagcttggctgttgtatcctctggattgcctcagacagcctctcttttttcctatggcccctggctgtcccagagcaagcatcccagaattgggtagcagctgtacaaccttttctgacctagtctcaaatgttatggtgtttcaggctattgattcctagaggcatcacaaggccatcctgaattcaaagggaagagagaggaattagatgctacctcctaatggtattgggataaatgcatattgtagaagagcatgcaggatagaaaatttaatgtatgccatctttgaaaaatataatcatctacatatttacttacatttatatacatttctaatgagaagtttgagcataattatgtattatgtagagaaagcccacagatattacatgtcccccatgaaggtcattatttaatgattacaaactacattaagatgttaaataattataattaaattaatttacaaattaacttcatagttacttaattcttctacttaagattgtgagaaaagtattaagtcgtaccttaatgactttgttttcattatggaacattttttggacataaattgaacctggctaattgatacatataatttaaaatgctaacattttactttttatatcattttatgaataaccataaaattcatcagtatcaataggaattatttagttaaaaatcacatacaattaatacaatcataggcttaaaggcagaatttaaatttgtttatttaaaagttaaaaaaattaaggtaggataactgtttcatagaatactatctgtttttatattttttgaagattaggtttagttcaaataagctttttgcaattatcaaaaataatctctggtcctcgtgtatttctaccacaatttacttccggcttggtgttttcagatgaggaaatggagcctgaggaatgctaacttacagattccggtcatctctccttaacagccaagttgattttaacccgagccattctgactctaatgatgtacaaacaaagagtaatattttatagatttgcaaaagagtgtagcatttgctaccattaaaatagggttaaattgaccaggagcagtttttgaggagtctaattactcattggggatcatgtgcttcctaaactgaaggcttatccaaaagccctgaacttggtagacaagcaccccaaaggccctgaacttcatgggaacaatgatgaatgcagaaagaccaggaaataactgtcaagacaaaaacatttcaggaccaagatctttagatgaacaccttgtgcttgacatacctgaaaaacagatttcagcctctaggataatatgcatagtaattgtacagaaaagaaagagttacagatgaataatcagaaagattattcagaaggataatgagagcaacaccctctattttgcttattaataataatcataggtagcaatacttgagacgctgctatgcactatggtaggagattattttgtagcatagcttattgaattctcacaaaaattctgtgaaagacttaagaaaactgaggacagagggtttaaacaatatgtcttctaattttctttttcttttttttttttttttagacagagtcttgctctgtcacccaggctggagtgcagtggcgcgatctcggctcactgcaagctccgcctcccgggttcacgccattctcctgcctcagcctcctgagtagctgggactacaggcacccaccaccacgcccggctaattttttgtatttttcagtagagacggggtttcaccgtgttagccaggatggtctcgatctcctgatctcgtgatccacccgcctcggcttcccaaagtgctgggattacaggcgtgagtcaccgcgcccggcctcaatatgtcttctaatcttaaagataaagaagaggaaccagaattgaaattcacataacagtcttataaaaaaatgttattataggagcatgtttaaatatgaaaattctgcagaataaaatgaccccattgggtacccaccacagagcttcaaccagtgtcaactaatgccgttatttttctatctccacccacttccatatcattttgaagcaaattccagatatatgattttatctaacaatacacttaccagtatgtttctctgaaaaataaagctctcaaataaaatagccatagtttatagcttatttatatgagtcaggatccagatgaagtacatacattgctttttttaaaaatagcttctgttttttggtttttttttttttttttttttttgacaggatctccccctgttgcctaggctggagtgcagtggcatgatcacagctcactgtagcctcaacctccccaggctcaggggatcctccttcccgagtagatgggactacaggcttgtgccaccatgctcagctaattttttgtaaagatggggtcttgctatgttgcccaggctggtcttgaactcagaggctcaagcaatccacctgtctgagattccaaaagttctggaattagaggcaagagccacagcacccagctaaaacatctcttaactctcctttacactacagattcacaatttcttcattttcttttggaatttagaggattaatcagattcaggattaattgtttgtttttgaaaatacaaatctatgaatggggatttgtttcttcatttagaagcttctaactgatgcttttccaggagaaatatatgccatgtagagaaactcttactgctggagtagtcactctattagacagaaaaatcagtcttcttgagatatgtatgtgacaaaaggtgcttcacaaatatggcaaagacactgaagaaagtaagagcaattttcaggtgcagataatgggaatgacatatttgatagtaagtagcattcatttataaaatattcctggaaacaggaaaaaatataattattataaccagttgtatcctaatacttctgaggaaaataaaaactcctatgatagcaggttatagggagatggttataacagaacatggcagaaatgatctcaaagccatactcataaacttttcatcatgggacagcaaggcagatagactttaaaattaattaatcagaaaggcacttcttgttttcaaagcagccagagcaaaatgctgatgagaaacagtaattagtcctccttactcaggaaaaaaataaataaactaacaaaacaaacaaagaccctgaaatgcaggacagtatagtttaaacttatacatctatggcctgtaagaagtttagaggtgcaagattactgttatacaggggtggtcagcatgaatattacagaggagagggataacggatatgcttcaagggattgttagaatggaaatagaaataaatgaataagtggagttttacataaaatatgcattgcatgaacaaaaattgagtagctaggaatgagtgtaatatgctcacggaatagctgtagatcagcattagaaaatatgcacaatgatcacatgcataaatggcacaccacggctaggcacggtggctcacacctgtaatcccagcactttgggaggccgaggctggtggatcatgaggtcaggagatcgagaccatcctggctaacacggtgaaactccatctttactaaaaatacaaaaaattagccaggcactggtggcaaacgcctgtagtcccagctactgaggcaggagaatcgcttgaatcgggaggcggaggttaaagtgagctgagatgatgccattgcattccaggctgagcgacagagcaagactcttgtctcaaacaaaaaaacaaaaacaaaaacaaaaacaaaaaacatagttctggagtgaggactcaaactatcctggttcttgatctactttagccatgaggcaccttagataagctatttaacttctttgggtttctgtttccttacctatgaaatgagaagattagactgccttaaaattctctgatttctgggataagtaaaattttgaatgttgaacgagttaatttctcattaaagtcaataccaaacctaacaaaagaagagcctgccatctgctatcataatcattttttaaagaaggtgtatttaaaagtagaaatggaagtgaaggcaggaaatggtctcagatggtctcagaaattgtgtgtgtgtgtgtgtgtgtgtgtgtctgtctgtctgtgtgtgtgtgtctgagataatttacattaaaactaaccacactgcttttattgttttttttttattttgatatggattgctaaaaacctcatcatagagtctacctaatcagcatttgggaaccatagattagctgatatttaaggacccttccctttgtgacattcagagaactcataataactagagtaaattcttcattatactctgtctcttgtctttgagcaagctagttaacactccaatgccttatctaccccttacaggtacagcatattactgggtctgatgtcagaacaattatttcaggggatacagataggtatgccagaaaaaaaagtcatgctggaagccaggagagttgtcatctaatccacattttgtcattcctaactagataagcttgttcatgttatgaaactttttaaaataattgaaagtatgagattaccatactgccttacctatctcattgggttattgtaaggtaaataataacatattttcatttttaaaaataaactctaaaactaaattattaataaaaaatatgtgaaatccccccaataaacataaatttactaattcagagcaggttgtagaactataattttaatcattgaaatgactctccaagaactaaactacaagaattagaatcctgaggatggtattccttttttctgaatctctagaaataagatgtatataaattaccttaagtagttcctagtgttataaaattttaggatgacaacataagtgaaagtgtcagccatccagacacatcattctttccctacacatttgaaattttatctgcagtttcgcattgacaaaatgttgagagtcactagaatttaagttcgccaatgaataaaagcaagcgtaagtggaaattaggactgtgatgaaggtgcccaagaaggaatgataaaatgtagtaactacgttccaaatgaaaagaagtttgtcttttctgggttggagaacaccaattaacaaagatttggcagaaatctaccattcctaattgcatgaaattagcaaattgacatttccgaaaatggcagtgattacaactgtacagtgtcattaagcaacctcctacaaggtagctgttctggtgttttaccgttcatcactgaaaacacttaactcttgttatttctatgggaactgtgtctataagagttacacatttatgtaacatatttatgtaagttcagaattacttgtattttgatacttaaacttataaagataggtggtcactgaattaagaacaagattccacctgcaaccccaactatcaatggagcagtgatattataaataaaaaaatatttggaaaagactcagaaataggtagcttcaggtacgttttctgtaactttcatggaagaaatgaagacagtcaaagtatggctaccatggtggtttacaagtatgtttacataaaactcaaaattgaaaagtgattttctcgacatagcggttattataccctgttgtaattttattttaattgaaaacagtaaactgaattatatttttatgaagtcacgggcaatatctgccttggtcctgctatattcccaggatctaataaattcatggtgcccaagaggtattcaataaaggcttgttgaatttatgaaaaaataatcttcagtacttcaagtttcagatatgatggagagattgcttctaccaaaggctaaaaaatatttctgatttgtgttatgcagtcttaaaatacagaaatgatcacattaatttgagttaatagaatatcaaatttttacttgatgtcctacttcaatatgaaacaatgaaaaaaagaaaggcaaaaggccttatttaataattttctctattatgattcatgatgatttattcaaaaataactgccttttgtataattctggttcatccttatatgactagctgaatgactactaaaatattttttaataccaggaccatttggtaattcaatgaatttacatttacaaactaaaaacaataatacactcagctagaccaaaatctaaagtccaaaagtaatgcttcataaaattaatttcagatatgtcatactacccaatttatttcattctaactagccatatatctattggtcataaaatatcaactgaaatggatattgttttggcattccaatgaaaactaaaagaaccgttatcccaaaatgttggataaattttcaagatcctgccacaagttgattatatgtttatatgattttaactgtagatctgtgacagggttaggtgtatcaaaaagatctttattactgatgatttggctagagtaattattgacacggtatttatgtaaaaatgtataaatttgccaatcactcgtgctgactacttatcaaaataactacttttcaatacaacaacaaagaggtaaaacatatagatttgagccacaccctaatgcaacacaaatgttcccctaatgcagaggaataattccatgaggaaaatatcatgttgagtttattattaaatacaaaaagtcatttgacttggttgcaaaagataaagcaaaaattttaccctacaatgaatgtaattcttagaagaagaaaaatatgttgttactgttaagatgatcatcataacattaatttcttggtaaatatatgctgtgtgattctgtagccacatgtcctttctactcacagcacactcctattactcttatgctaggtctggacaaagtgccaaaggatcttccccctgacacaactctgctagacctgcaaaacaacaaaataaccgaaatcaaagatggagactttaagaacctgaagaaccttcacgtaagaactatttttttttaactcacaataagataagactcaaggtatttttcaaaacactacctagataaggccaagagtactatgtaccaacaaagaagcacattagtgtttattaacttcaccttttttttttttttttactttttttttattaattctgccccaaacactgtttttctttttctttttttttttttttttgaattatgcttcttttttttttaattttttttttattatactctaagttttagggtacatgtgcacattgtgcaggttagttacatatgtatacatgtgccatgctggtgcgctgcacccactaacgtgtcatctagcattaggtatatctcccaatgctatcccttccccttcccccgaccccaccacagtccccagagtgtgatattccccttcctgtgtccatgtgatctcattgttcaattcccacgtatgagtgagaatatgcggtgtttggttttttgttcttgcgatagtttacctttttagcagtggtagggaagcaaagcatcatatttattaaccactaacaatttacctgacttttttaatacatataccccatatatcttaggtattttcttcataaaaatactttagatcttaattctctctcacgttttcaggaataaaaattgtctttcaaattaaattgtattttaatagtggaacaaaacacaaaatggattgatcctagtattattttatttctttgtttcttttgtttgttttcatgcattttctaagagaggtgtgaatgatgttctaaagtctcaaagattggaatcaagtgaaaaaaagataattattcatatttcatttagcgaaatataattctatcttcatatatatgtttcttgctttatctttaggattatgcatgctgtgtccttatctgtatgtttattttgattttctcttatctctctactctatcataatgttcagtctatcagtcaggatttcatcagaaaagagatgccactcacaaaggggtttcatggaggagactttattgaaacctctatttgcaaaggggcatgggaacccaacaaggcactgtgaagcacccagtcccacaaaggtctagaagaatttgagggtctcagagccatgggagagctgggtagttccacctcttaatttcctgcctgtgtcttgtgtggttgcatctacttcagaccaaaagacaagggcatttgattaatgcattccccagaggtcagcttcccaggacttgaagaagggccaaaaaagggcaaagaatgaatattgtggtagttgggagagaatatgctatacaagggaaatgaccaacccaataaaatagaggtaagccttgctaagagaaccttctgtaacagtaaatgcattgtttgttcacacagaacaccagaatcactataaaatgcattttctcacccagttctctatctgtagaatgagtgtgatgtggtcttccatcaaaatatgagtgcacattaaatataaataaggcagacttcaatgtccaaaatatatactctggaaatctcactgtgtctacttccattctggtagaccactctgaagcattgagtctggttcttggcattttaagaaaggcattcaagaacatctagagaaggatgaccatggagataaagaatctggaaattaggtctcataggcaccgtggatggagaggtggatgtctaaactcagtgttgagggtcactagtggcacatttgaagggccatgttgaagaaaaagaatggtatttacttgtttcaactacaagatgacagaatcctcctagtgagtagaagttttacagaagcagatttttattcaatattaaaaataaaaattaaagaatcagaattttcagacaatacagagacttacctagtgatttgttacctgcctgtggagattagagttcacagcttcgtataatgaatgtcataggaatacattcttaatgttgggagcataaacataccaaactctaatttcatatctacttatttattctagtcattatagaaaataattgaggaagatatgtcatgagaataggcactacttactaaagtataaatataaatcatctgatatacattagaataaaaatatagatacaaaggaaataatataaaatagaataaactggtcataattattacagagttactataatgaagataccatttagttataaactttacaatagccaagatgggaaaagcagtaaacatttagccattagaagaaaatataccagatttttttaaaggaagaaaaatttttttctaaaattttaagactctacaaggaaccattttaaaaaatgcagaaaggccgggtgcagtggctcatgcctgtaatcccaggactttgggaggtcaaggcgggtggatcacaaggttaagagatcaagaccatcctggccaacatggtgaaaccctgtctctactgaaaataaaaaaattagctgggcatggtggcgcgctcctgtagtcccagctactcgggagtctgaggcaggagaatcgcttgaacccaggatggggaggttgcagtgagtcgagatcacgccactgcactgcagccctggtgacagagtgagactccatctcaaaaaaaaaaaaaaattggtagataaaacagtgccatgatcaatttattgacgtgtccaacaatataagcacaatatgatatgagtagtgagtgttatggacttaaagtaaaagaaaaaattaggcatcattatttatccaattaccagacacagttttgagagaatatgcgaggaaggagttttagacgatcagcagaagtttgaaggactttctgtacaagaagaaagcaaaggcagaagaaaataagaaacagacaaataaaaatacgagttggctagagtgaaagaaacagctgaagcaatggaggataaggacaagctggaggttccgacctttgggtctctttccgctgatgagaaccttattcaccaactccccctcacttcaccttaaggtttcaccgggaatgagctgatggggaaaccagcaaggttttcagtgactatttaagctactgttggcataagtttaaaaaggagaccataaaaaatgaatattattaaatttagattactaaaatatttttaaaacttttatttggataagtttgccttatagctactgttttaaaggatgaaacattcttactgtcatctcaacttcctgtacatttaagtatacttggaatattttttaaaaaaaccctttatatccttaagtaagtgacatctagtgtccatgacattctcattaaatctggcatttgtaataatgtgttgtttcttttcctaagactccttctgtttttaggcagccatcatcttgacaatctctttctttctacttcaaagtatacatcagatgaataaagagagttcattagagccttcaaccattcagaggatgttaagcagctatttttctcttactgtttcattcatgatcctttctatccttgttattttgcaaataaacatcataatttcacctagcaaagccacacttaaggaaggagagaaatgaaaatttagcaaggattaaaatagaaagaatttaacagaatcatgttccctgtatgtgcttcattatgagtggtgtgtgttacataagagtaattttatacctatatatagtgggaaaaactatataattgttctataaaataatggaaaattaagtgtggtaatgacaacatttaatatattttctttgaattgaagcttaataagttgagtaaggaaaatttttttaattaaaaatcagcaaaaattgtcaaagactgaacaaaagcaaacacttgtttagcaattactatatatactaggcactattcttagtaccttatatacattaacttatttaattcttataactattcttatgaggtagtcacacttgatatctcctttaaatgggcacagaaaggttaagttacatgctcatagtcacaggccaaataagacccagagcttgagattctaaactcagaattctggcttgagtatgtgcactaataattgcctataaatgtaacagtcaccaaaaaagcctttagaacaatatttggtacagtgtaagacctacataaatggctttggagaaaaaaatcatattaaaagtcaggttttaaaaacatttaacataatacagatttttcagatcatgtttaatacatctaattatatcacactttcaaaatggtcttctatggataggaattgaatatctcctttgcgattttcattaggcatccacaattttggatgtcttgtaatgatatatgtcacctcactccactcagctggctctggcttttccctgattttttgtttgttaatgtcaatttttttatgaccttaactcccacaagtttttgaacttttgattattaatcgcagtgtgttagaattgtgtatcaatcaaccaatgcatctttcaggattagttaaatgattatgttacttaataagaagttttaattcatcgagtaatgtgaactatatgaggatatacatatattaattaatcagctattacctttagaaaacattcttgcatttctgagactaaaaatactcgctttcctattataggtccccttttgcccctccacattttcatatatgcgaaacatatactataattgaaaatgcaaaattagaccttaataagttattttaagttccttataattagttaataaagtggcttgaaataataaaaccatgtggttttgttagacatacagataattgaaaaagaataaaatagtccaaaaataggcctagcaattgttataagcataataataatgaattagaggtaatttcttatataaggagaactcagaaataaaaatcaaataattacccaaaatattaacgtatttgtcatataaaacctttacacataaaaaaaggcaaaaaaaaatcaggagaaaaatatgttaaggctctctgtgtcatattgaccatatctttattttctaaatcaattattaacctatattaaaatttaataaacatgagaagtattggtgatcaagcaatctcctctctccaaaaaatacaataaatggtaggaaaataaaaaaaaaatagtttaacctttttaaatgacaaggaaatacaaagaaaagcaatgagctacaacatgatattattttggccatactcttaagaaacataatatcaaatattgcaaggctacgggaaaattttagttccttgcattgctggtgatagcataaattggtatcatccttttgtagcggaatccatgttcatgatcaatgaagatggacttttaagttaaaaagctgactgcgggatggatgtctgtggcattgattattttcaggtatctagggtcatttcaattgttagcagtatttattatttaaaaattacatagatatatacacgtacatatacatacatacatgtctgtgtgtgtagagtgcatgtatgtttatgtatatattatatatcttattacatttcccttctcttcattcctgattttcaggtcctcatattataactttttttttttttgagacaatctttcccagtcaccaaggctggagtgcagtcgtgtgatctcagctcactgcaacctctgcctcccaggttcaagtgatcctcctgtctcagcctcccaagtagccgggactaccggcacccaccaccacgcccagctaatttttgtatttttgatacagacgggatttcgccatgctggccaggcttgtctcgaactcctggcctcaagtgatcctcccacctcagcctcccaaagtgctgggattacaggcatgagccaccgcacctggcctatacacttcttaagtaaagaaataatacttacttaatttttttctgatttcttgcaattttttagatttctctgctatccctatgaatggaatgaacaaacatgcccttgttttacatgtatgtggaaggttttggatttaaagagatgtttttcttcactatctacaggcattgattcttgtcaacaataaaattagcaaagttagtcctggagcatttacacctttggtgaagttggaacgactttatctgtccaagaatcagctgaaggaattgccagaaaaaatgcccaaaactcttcaggagctgcgtgcccatgagaatgagatcaccaaagtgcgaaaagttactttcaatggactgaaccagatgattgtcataggtacagacatttttataactttaagaccaaaactcaagtttttatcttaagagatttcaactgggttttaagtgcaggaaggtaaattagctacaagctacatgcctggagcctatgtgatttataagaacagggccaagagaaattgggattttgaatctggaccttacagtgatgtttttatgtatgtccttgagtatctgagaatatggagaaaaccctagggctgaagttaccctaccacacacacaatatgcaaagatgagtttaaatagtgcttaactacagatattttgagatacctttccgttttggggacctgttgtattctaaacactcataaatcatttgctttaaaaatatgttatggctgggcgcggtggctcatgcctgtaatcccagcactttgggaggccgaagcaggcggatcacgaggtcaggagatcgagaccatcctggctaacatggtgaaaccccatctctactaaaaatacaaaaaattagccgggcgtggtggtgggggcctgtagtaccagctactcgggaggctgaggcaggagaatggcgtgaacccgggaggcggagcttgcagtgagccgagatggccccactgcactccagcctgggtgacagagtgagactacgtctcaaaaaaaaaaaaatttctctaaacatatagtaaaaattgtaattttattattggcttataaaatgctagattgaaattctttaacaaaattttaaaataccttaggaaaataataaataacgtaagatgggaattgtaaacttgctttagttgatttctgggcaaacctgtgtatgcatcttaaataattttattggtattgctttcactaatagtctttttcataagtcattattattcataagtcattgtctgtttggcttttgttttaataagggaaatttttatcctattttgctattctcctgaggagcatgctctttaacttcacttttgttttttagtcaagttgatattaatccctatttctttataggttgcttgctgaaacagatactacagtgactagtaatatcctaaaatttcctctaaaagccttgcacttattacatttgtagaactgggcaccaatccgctgaagagctcaggaattgaaaatggggctttccagggaatgaagaagctctcctacatccgcattgctgataccaatatcaccagcattcctcaaggtgatagaagattctccaaaacattttgaaaaatttaaattcaaaggctttaattaaaaaaaaaaaatcttgtggaaactggaattgtcacctaagaggccaaccttatttccagcaaattctctattactgctagtgtttcatccagtgtttatatttccagcaaattctctattactgctagtgttatatccagtgattcagtctggatgaccacggggccatccaggctcactgtagagatgggtagactcctgttaatgtctagtttaagacacaacttaatgcacagtgattttataatattgtaaaatcacaaagaaaaagtacatttatttaaaaaatagcatgccttggtgtttgtaaaaaaaaaaaaaaagatatatgggagtacctctgaaattgatccaatttttatcttgagtctgcaatagcttagggaatttttttttcctttttaagacactccagttattaatatctgaatgatagtggtagttgtgtgttgtgaagagtgtagattttggagtcagtttgcttgagcccaaattaccataaagtggttcaaagactttgaaaaagttattcatttgtcctctatctctttatctgtcaagtggaaataatactgctatccacttcattgagttgttttaaagttaaataaataattagagaaatatttagcatatagataagtagggaattaatataactctctattatgcattaaaaatgttctgaacaatcagtatgtgtaggcgatgtaccaaacacttaagacagggcagggaacaggatatgctacatgcctttaggagcttactctctaaaaccaagccagacaaatacacagcaatgaccacatagccacaagggtaagttcattgttccaagggattcccaggagaggcacaaaagccagtctttgtgaattacaaaaggcatcaaaccaccaataataaattcctctaacttgcacatcgtccctactctgggtttttcagtctcacagaagccctctatattatctagttttcccctcagtctgtccctttctcaacttagatgccttgttcttgagtgcgtacaaaatgtagacatttggccacagaaaacaccagttgtcctttattgttcttttacagaaatttcaactcctgagagtacatattccataggatgctttcttaccaccccttgccctcctcctagtcttttgaatacagagcatgcttttgacttccttagtagcaactactggcatagatagatacatagatgataaagactgatttataattcataaagcactttcatgttgagtctccaattttttgcatgtaacaagtaatcttttgctatccccagtgcaggaatgaaatatttatatctcagatagatataaattggggattgatatagatagatagatagatagatagatagatagatagatcttattaaaattcttgctgaaatttatttcatgcagccagatgacttacatttagcacaatctcagactttgctgtccctcttaatgcatgctccaaaatatccttcactgataccttttatcatttcatgatctcttttcctttactttgctatgtcttctatctatcccaggtattctttcctcatcatttatagcttgcttttatttactaccgcttaatagaaaagttaagtaactacaatttattaagcatgtatttagttccgggtatcatgccaaatgcttgtcatggagtcttctatatgattcttacaacgtccctatatagtagggttataattcctgtttcataaaagtggaaaatgaggcttaaacaggtaaagaaaattgtaattaagttcttagagctaggaagcggcagagatggaattgtgtggtgctgatgtcagaactcgtgtgtttaactatttcactctgttggcatattaagtcctcctttctattcatcgttatgcttatctaatacatgattccaccttgcttaggctgggatacctatgcctgaatatcagcaacctcctggtgatattttctcccatcactcatggaaatggaaaggcagtagaaagtagtgtagagactataaaaatcatacacttagatcaacctgggtgagagacctaactcagtcatttagttgtactgtgactttaggataattattctgcatttctataacctcaggtttgttagatgttacatggagctattaataaccctgtctactaggattattgtgaggattactctatagaagtaaggcttgtattgtacacgcaagtacttggcccaatgtaaacctcaatatattttatcttaaaaaaggaaaagaaaaaagaaaatttaaaataaatgaacaaacaaataaataaaataactggagtatgggttctttaactcaatgccacagttgcagaagctaatgatgcactttacaaatttgtctatctcaaacctattgcaaggttttctcccatagtcaaacttcttcttagctataactttacatttgggaaactgacatcccaaaaagggagacactttgaaactaagtaaggccgatggttgtgatagcaattggtgtactggaggcactgcattaaaaaatatacattttgcattactttgtaattactttgtaactttgagtcttatttatttaactgtgaaaagggattagtgaccaataatttatgttttgagaggcttaaaggatttgaagtaggaaaagtgccaaggtcaatgttcggtgcgtaacagacatacaataaatagatgttccttttcctagcagctctaacacaaaatatgctaccataggaaactaagaatcattttcaagtcaaatatggactaaactattttattaaatggacaatattgacagaattcagtgtgatgtgataaaaattttagacaaaatgaaacctgtggtttttcaattctgtgtctttatagacaaatagccaagactttctgccaatcagatgttctttctacacttaaccaatttgctattttctctgtatctattgctattaagtggaacaatatgttattttaaaagctgtataaaatataatacagcctcagatgctaggaggaaatgaaaataaaatatttaaacttttatatttataatactcgatctttggaaatcacagccatgcaagtactatctagaggtttagtgggtactttggatgtaaaattattaccccaggtgctccacatatggcagatcacttgattatagacctctccactccttctgcataaacattctggatttaataggcataagtaaatgttagctgtttctacacagacattttgcagaggtatttgatgcttttatggaaaagtcaattaaggctaagaccagcacagtatatcagtgttaatttttaatgatgctcattaatgaaatagacaattaagtttgtacatgggtttaatttatacgtaatctcttcattatggttcgaatagtgactttcccactttataattactatcttttatcaacgtcagttttagcccattaacaaaggtggaagagaataatgagactcagcgttgacttcagttcttctattccaagaacaaaaattgactacatgatagaaatcatccaggtttttgttaaagtcaacctaagagaaaaatagcaagggcttccactacttccaaaagcacacattattataaaagggatgaaaaaaaaagataaaagtaaagctgattctttgaaactgtgtgtcttttagaaaattgatggcatatgtcttctttaagtttgtccacattctgtacttataatgtttatctgctaatttaacatctttaattccacattccaggtcttcctccttcccttacggaattacatcttgatggcaacaaaatcagcagagttgatgcagctagcctgaaaggactgaataatttggctaagtaataatattctttcatgacattctatcagaacaatggctaggtatattagtgcttatatgataagaattataaacatgatgattgatttttgagtgtactacatttcactgctgttgttgtttctataatctcaaacttcagcatatccaattatttcttgagaagaagccaatgaaatagtgcccttactaaaaccaccaagatcagcttcatattttattaatactatactgtttatagattagttatattttatacacaaagtgtgtgattaaatcaatatgtgcatttaatatgttctaacttatttgcatcaaacagaaagttaagtaaattataacacagttgctagaatttgaaaatccattaaaatgaaatctaccaagacagagaaatattgagcatcacacaaattactattttaataattatgagattctctaaccccctcttctctgaaaagtttaaaataaaatatctctgggcatttaatgtagatcaacaaaagaaaagcttttgttgttgttgtttttgctggcccttcttaatgattttttttaaaataagtgatactagtacttgtcctggtttcaaacataacttcaatctggcaaacgttttcacttgtcttcaaggaacactatgttctttttgatctgtacatattgctgactgtccctacagagaagcacactatcatgccagatttactcattcctgttgttatatataaatttcatggtggataaataaatataaaatatatctttgaatgtgtatatatatatatatgcatgtgtgtgtgtataatcaactcctttactaggtaaaatattctttgatgggaaaagtggtttttgatccatgagacctctgtccctcacaatgcctagcataatatcatgcacataagttttcaagaatatttgtttattaaatatacaaataaatgtttgaataagtgaacagtttttaaaaataaactattaggaatattatgttccaatattatggttgaccataatttgatgttggaacttaggatattataaggaataggagactatgtccaatcacgttctgtcagatgaatctcaaagacagtaactttgagccgagaccttaacaataaatggactttgtccaggctcagagaggttggagaaagcactccaagaactgggaagagtaagtgcaaaaacaaaaaatgtcctttcctatagacttgattaactacacaatgcttgtaagaaaggcatccatgtgtggtgtttgctttcatttctgctttctgttgcaggttgggattgagtttcaacagcatctctgctgttgacaatggctctctggccaacacgcctcatctgagggagcttcacttggacaacaacaagcttaccagagtacctggtgggctggcagagcataagtacatccaggtaatgcaaagccactgcttatgtgaggaatatccaaaaagcaagacccccaccctgcttatgggatgctgggaagcaggaagctcttcttagaagttttttttccagagtgtcttagttagaatttctatgacaaaataccataaaaaaaattaaatcatgaagcacaatttacattagctagatttcaataaagtttttgatttagaagtatggagatgaaacttaaagtcttctgtaatgctgatatttttttcagtaggggtggtgatgttggtgccatagtgagtagggggagtttgaagccacaagtaaaataaaaattctttttttttactgtcactaattttaattttcaaattattcaagaattgactggaaagagcttctttggtctagctcctgattctttttgacatggcctcatcatttttctttatttcctctaaaaaaaaaatgagatacgtttgcagaatgtgcaggtttgttatataggtatacgtgtgccatggtggtttgctggccctactgacccatcctctaagttcgcccgctcaccccctaccccctgttgtgtgttttgttaccctctctgtgtccgtgtgttctcagcattcaacttccatttatgcgtgagaacatgcagtatttggttttctgttcctgtgttagtttgctgaggatgatggcttctagtttcatccatgtccttgtaaaggacatgatcccattcctttttatggctgcatagtattccacggtgtatatgtaccacatttcctttatccagtctatcattgatgtgcatttggattggttccatgtttttgctattgtaaaatagtgctgcaataaacattatgtgtgcatatgtctttatagtagaatgatttatatttctttgggtatatacccagtaatgggattgctgggtcaaatggtatttctggttctacatccttgaggaattgctacactgtctttcacaatggttgaactaatttatgctctcaccaacaatgtaaaagcactcctatttctccacagcctcatcagcatctactgtttcctgactttttaataatcaccatactgactggcatgagataatatctcatctccagccacagggaatcattaatctattttatcatttttgtttgtttcatagaccatagttttgtgtagattccaggaatactttaacatctagaaattttataattttaactcctgtatttggttttataatctaattttgagataatcctagtatatgatatgagtctaattcattttctgtatgtgatagcaattgtcccaatgtcatttgttggaaataatattctttctccaatgaattgtcttgtcactgttgaaaatcactcgatcataaatgtaagggtttatttctggactttcaattctattacatttatctatatgtctagtcatatgacagtattatacccttcaattactgtagcttttgattacgttttgaaattagaaaatgtaggttctccaactttgttcttttttttcaaagttattttggctattctggttcctttgcattccatatcaattttaggatctactttttcatttctggaaaaatattcttgtaaggctttgaaaggtattgttttgaatctacagatcattgggaagaattactatcttaataatattgagccttccaagtcacaaacaagggttatttatatcttcttttctttttctcaacagtttttgtcatttttagcatacatgccttgcaattcttttactacattcattgtttttcattctttttgatgctgttttgaattgttaatttttttatttgtttgctgctaatgtataaacatacaattgatgtttatatattgagctatcctggtactatgccaaatttgtttttagttgcagtaatttttgtgagttcctttggatattctatattcaggatatattatttaaaaatagacagctttagttattttatttggattcttttaggtctccccctcccccacaacccaccctttgcattggctggaatcgccagtgcaatgttgaacaaaggtgatgaaattagacatctttgccttatttgctagtttaggaggagggagcattcattttaccattagttacgatgttagccacaggtcttctatagatgctctttatcaagttgaggaagttcccttctatttctgatttactgaaaacatttattatgaatttttttcttacatgtttttcctgcttctattgagataatcatgcgagttttggcctttatatttttgatatagtgtattacattgatattactttgattgattttcataagttaaaccaattttacaaccctgagataaatcatgtttggtcctatagcatgaaatcattttatatgttgtgaaatgtagcttcctaacattttgtgaaagattttttgtccatattcataagaggtatttgattacatttttttttcttatgatgaattttgtctggctttggtcttagaaaatattgaccccatagaatgagtttggaatctacttttattttgttctacacagactaatacttacgtcttgatattttgttctctcactttcaatattaaccataaattgctcaccaaacaccccttcctttacttgctaatcactactggaatatagaggatggtaaatgacaacaagaaacttccaaaatatgagaaccataaaccatacatataagtgttgctttcactttaatattccttgtttctgtttttatatgacatctactaattcgcttttcagcccttacaaaaacaaagccgttttcaccagcacatgaatgtgaatgtcctagtgggtagaacaatatttcaaattttttttttttttttttttttttttttgagtcggagcgtctcgctctgtcacctaggctggactgcatacaatggcacaatctcggctcactgcaacctccgcctctcgggttcaagaaattctcctgcctcagcctcccgagtagctgggattacaggcacgtgccgccatgccatgctaatttttgtatttttagtagaaacggggtttcatcatgttggtgaggctggtcttgaacacctgacctcatgatccatccgcctcggcctcccaaagtgctgagattacagacataagccaccacgcccaggctttcaagttatgttttaagggagtacttcataggttttatagctcacttaagatcttgttggtggcaggacgcagtggctcatgccagtaatcccagcactttgggaggctgaggtgggcggatcacgatgtcaggagatcgagaccatcctggctaacatggtgaaaccccctctctactaaaaatacaaaaaattagccgggcgtggtggtgggcgcctgtagtcccagctactcgggaggctgaggcaggagaatggcgtgaacccgggaggcggagcttgcagtgagccgagattgcgacaccgcacttcagcctggataacagcgcgagactccgtctcagaaaaaaaaaaaaaaaagaccttgttgtcttagtgttatattctaaccttgcttgtatgatttcagagaagttgcttcttgacctacagaactcatatcctcaaagtgaactgtaaactcatttctaacattctttgtataattccggtttttagggaccctaagaaaatctatggccaaattaccattatcttaaacatgattgtaaaacataattcagaaaaaaaactctgattaattatattgcactgtattcaagtaaaacgtattacgtaaaatatgtatttgttaaaacttcctaggtctattctaaatgctgtgatgtttaaatatttaagaatttcttggagtttgtgattctttatttcaattccagtactttatgctctctttttctttttcactacacagcactttctcattctatatcattttgttaaaaggtgtatatattttttgtcctgaaaacataatatttcatgtagacccaatatagtcatgtagacctgatatatgaaataacatttattcattcaacacatatttattgaacacctggtctgttctagtactggagatacagccataaacaagcagaaccattcttgtctcatggagcttttactctagaggagagaaacaaacaatatcaaataagcataatatgctacatattgataatgctatgaagaaaaacatgtaacgtaattctgccccagagaatggcagaatgggatggtcagggaaggtctctctggtaagaaaaaacgacttacatgaggcaacaagccttgaagacaccttagagattattccaggttgagtaaacggtgttgataacttaagaagagatcatgctttgtgcattagaagagcagcaagtagaccagatgactggcttttacagtaagagaaaaggaggtcagagtagaaggatgtcagatcatgtaggatttgtaggcccctttgagaactttagattttattattctgcatgagattggaaaccactggagttctgaggcaaagaacatataatttggtttactttctaaagcaattgctctgagagcttaaaaaaagaataaaatttaggaaggcaaaaggggaagcaggaataataatcagggcaacttcaatcatttggaaggaaacaatggtgacttggacaaggttgtcggagtagaggtggagagaactagattaagtgtacattttgaaggctgagctagcaagatttgttgttgattatgtagagagcataagagaattggagctcaaggataatgacaatgtatatagcctgagcatctgaaatgattggcatgcaatttactgagatggggaagacaagactaaagaagggaaaagcaaattttcaaaaggaagggagaaatcaaaagtttaatctgagaagtagtcagttattcaaagtggggcctgtcgtggtggcttacgcctgtaatccaagcacttcaggaggctgaggtggccggatcacttgaggtcagaagttctagaccagcctggccaacatggtgaaaacccaactctactaaaaacaaaaattagccgggcatggtgtgtgtgcctgtagtcccggctactcagtaggctgaggcaggagaatagcttcaacctgtgaggcagaggctgcaatgcactgaggtcatgccactgcactccagcctgggtgacaaagcaagattccatctcaaaaaaaaaaaaaaaaaaaaaaagtgaaggattaaaaaataataaaaaaaataaaatgtttacctgaagggcctcaacatatttagagaataataattattttctatcgtttcatgttgtaggttgtctaccttcataacaacaatatctctgtagttggatcaagtgacttctgcccacctggacacaacaccaaaaaggcttcttattcgggtgtgagtcttttcagcaacccggtccagtactgggagatacagccatccaccttcagatgtgtctacgtgcgctctgccattcaactcggaaactataagtaattctcaagaaagccctcatttttataacctggcaaaatcttgttaatgtcattgctaaaaaataaataaaagctagatactggaaacctaactgcaatgtggatgttttacccacatgacttattatgcataaagccaaatttccagtttaagtaattgcctacaataaaaagaaattttgcctgccattttcagaatcatcttttgaagctttctgttgatgttaactgagctactagagatattcttatttcactaaatgtaaaatttggagtaaatatatatgtcaatatttagtaaagcttttcttttttaatttccaggaaaaaataaaaagagtatgagtcttctgtaattcattgagcagttagctcatttgagataaagtcaaatgccaaacactagctctgtattaatccccatcattactggtaaagcctcatttgaatgtgtgaattcaatacaggctatgtaaaatttttactaatgtcattattttgaaaaaataaatttaaaaatacattcaaaattactattgtatacaagcttaattgttaatattccctaaacacaattttatgaagggagaagacattggtttgttgacaataacagtacatcttttcaagttctcagctatttcttctacctctccctatcttacatttgagtatggtaacttatgtcatctatgttgaatgtaagcttataaagcacaaagcatacatttcctgactggtctagagaactgatgtttcaatttacccctctgctaaataaatattaaaactatcatgtg

SEQ ID NO: 36008 - DNA, 3630 bp, Homo sapiens
gggcctgagagattcgaaaggagccccgccccctcggagctgattcccgggactaggttgcgggagaaagcctgttgcgtggaagataaggcggcgcgggaagtggacacagggtgggctggaggtgtgcttcgcgtgtgatgccaggggagtggaaaggtggcttggggagtgcagaaccctgaggatagtggcggggaggaagatggggcgtgcaggccgcccccagtgaggagaggccaggatgcagggcggctccagggcaatctgggcagttgggggagccctccgtatcgttcccggaggtagcaggagtagctgtgcgggaggtgccactcctgggcgcttgctttgcctccagcatgacccccgaccctggcttgcaccctgaatctagctgcgagccttgggcagaatggatacctgaggaaaggtatggtttctctccggctcagatctaactggactctcgctcctgctggctggacatggaggatttggaggaaggtaaggaaaggagggagggaagaatgaaagggaggagtgagacccagcgatggagagctgcatcagggacccatgactggctttcattcttctttccccttcagatgtaaggtttattgtggatgagaccttggactttggggggctgtcaccatctgacaggtaccagcctctttatcccacttattttcctctaacagtacctctttgtctcgaatcccttactgctgaattattggcttgggttggtaacttagcaaggtttggcgcacttggggctgctgggcggctggctgactcgggcctctatgacactattggtagcggggagagaagggagaagctggagttagatttcagggtgttaagaagaaggataagtggatttgctgcatctccatcctggcatcatttctgatgtccgtaaatgctaaaggcctattaggccccatagaaccaggtatctcatcgcccagaggccacatctcacagccagcatgggcatcggggcctagggtcatgtccctggctctgttgtggggcttttatgcagtctcccttgcataatctcctgttcccttttgcatgggcatgatgcctggtttgtttcctgtctcagccgtgaggaggaagacataacagtgttggtgactccagagaaaccacttcgacggggcctctcccaccgaagtgacccaaatgcagtggcacctgccccccagggtgtgaggctcagcctaggccccctcagtccagagaagctggaggagatcctcgatgaggccaaccggctggccgctcagctggagcagtgtgccctgcaggatcgggagagcgcaggcgagggcctggggcctcgccgagtgaagcccagtcctcggcgggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggtgagttgagagagttgagttggaggtgtgccccagacatggtgtgtgccatgatgcagggagtggtttccttattggtaaaacagggatagcatttctacatctagaattgttggaattaaatgagaaccatgaaaaaagagaaccaaaactcttaccacagtgtctgagtatatgtctatgataaactcaataaatggtattggcaatagtgatggtgatggtgatgtggtgatgttagcagctaacttctacccttccttactgggatgtagacaactctccacctctatttcttaattccttaagccacagaacagatattttttccactctagtcttttttctctctctctttgtgtttcaggagtcacccacttgcaatctgttccctgcatccaaaagcccagcatcttctcctcttacccgatcgactcccccagtccgggggagagccgggcccagtgggagagcagcagccagtgaggagaccagagcagccaagttgcgggtgagtgggagtggggagtttgtgggattgaccctgaaatttctccacccctctccaccaggcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaagggtaagaggtcaggaggaagaatgcccgcccttgcccagcgtgtcctcaccctcccagagctgtcaacagtgaccacttttgccatccttattgcaattcaattggaagatggggagactgagttacagagaggatatggggctggacagagtctgagtcttagttttcaaatacctcatggtcagggggagagtactaatcccacactcgctcccttcatccagtatttcttttcgaggtcagttaaacttgctgctaactcatttcttttgttaacccccatgaagttcctgtttcccagcgactaaatcttcctgtcatgggtgccactcgcagcaatctgcagccccccaggaaagtggcagtcccaggacctaccaggtcagtctggtcctcccttgcccatcctgtctccctaccccgccatcatctgggattccaagctgttatgcacatcagccctgaattttgtatggaaagatggagagaggaggggagcctggggcaggggaagggggatcccatttcttcccaccctgaggagcttgaattctgctgggtgacaaatgggcttgaggaagaagggcattttaaagcagttattccttctatttctttaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgt

SEQ ID NO: 36009 - DNA, 9879 bp, Homo sapiens
acactggggtggtgcttagccggcgccagaccgaccctcgacttcggagaggcagcgcggttcctctgggtgcttccgcctccccttctcctgcttctccagcctcttcggcctcctcgcccgccgcgggaacccgagaccccagtgtatgccccacccctgaccccgctcgcgacatgtccaccccggctcggcggcgcctcatgcgggacttcaagaggtaaaccgaggggacggccgaggccgggggttgcgagctggggcacagggcgggtcccgaggcgcgccgggcggggagggctggggagcggccgggagcgggcgccagtgccggcctagggggacccctgtctgtcttcccgaaggttgcaggaggatcctccagccggagtcagcggggctccgtccgagaacaacataatggtgtggaacgcggtcattttcgggtgagtctgcgttcgtggcggtggcgagaaaactggggacgcgagcagcttcggtctgcgctccggggcgggccccccgcggaggccgagcgggtaggggaaaatgtttgggtctggctgggcctaggcgcctccccggagcctgtgcctcgattagctcagttcccgctgccagggggaaccgcttggggttctaggggggcggggcggggagtggtggcggttaggcgcggcggcttgccctgtgtctctgagcccgggacatccatttgtagtggcttccgaccccggtagcggtgctggagatggcagagctcgggatagccatctcagatgaagcagggagaagggggccccttaagtgggaactgaccatttttctctgtgttgcaggcctgaagggaccccgtttgaggatggtaagagagagtttctttacccacttttcaggagcctggtcatctggggaaagggttcccagtcatcctggaagtgtctcctgcttaggaacctgcctctgcctagcctctgtctgctaaaggcttgagtggaatgcagtgtgtggctggtggttctggatattgtatgcttgactagaactgcacctttcttcttgctttcttaaaaaaaaaatctgtgtaaggcagtcactttttaaaaggagcaatcatagcactggtattaaggatttttgaggcttgggctgtaattctgctaaattcagccctccatcactgaattagtataaacccaaccagttgctgataggcagcagagaccccagagaccatctggttcagaattctaccccaagggcaggagttgtgttcagcaggtgcttggtagatgtgtgttggatgttgagtggatgcgagaatcccttgcgtacaactgtctggtttctacaatctgacattgaatgcctgtcagcctcactgctctaagatggtcttaaatgcctcatttgagtacagtattctttcttatttttaagtgaatttgcagtgtgtgctttcatcaagacgttatgatgagtaatttcaaagcagcttcacaattgaagttagccttaatgtacccttttgatcagtgtcctgcctacctgaaagtactacatgtaccagtaggtacataatttttaattgatttaggtttaacttttaaaaacacgtgtaaattgctttttaaaaactttctgattttagataattatagattcatatgcagttgcaagaaataatagagacaccctttatacccttaacccagtcctctacccaaaccctcccatttggtaacatcttgaatgactagaccctatcacaaccggaaaaatgacactgatagttctacactcagttgtgtgtgtgtgtggttgttttttgaaagtttaatacatttaaaggatgattaaagtatttgaactcatgaaattctttaatatttgaggttttaaaaaaaaggaaaaggatctttctgttatttttttcctcaatgatttccttcggtcacatagcatttatacacacacacacacacacacacacttcagtttgaaggtgggaacaaaaacatttctgcaaactacttaatacatacttatgttgctgagccggattgctttttgatgctaccagtccacaaaatgttgtgaggtaagtcaatttcaactaagtctgtaattcatctcaagtacttagatttccccaggaaactgtggacagtcacctgaatatttttagcttcctctttacctttaccccctgggtaaatatcattactcttcagggctgcaaagaaaagaaatgacagcaggaaacagtgattgtaagggcatactactttggcgcagttaatcatttgaactgatttgtagcaaaaaactatagctagacttaattttcttctaccagattggcactagtttttttgtttgtttgttttttgtttttgtttttttgagacggagttgcgccctgtcacccaggctggagtgcgatggtgtgatctcggctcactgcaacctccgcctcccaggttcaagcgattctcctgcctcagcctcctgagtagctgggattacaggtgtgcgacaccgcgcccggctaattttttgtatctttagtagagacggggtttcaccatgttggccaggctggtctcaaactcctgaccttgggatccacccgccttggcctcccaaagtgctgggactacaggcttgagccaccgcacccggcgagcactagttctttatacctgagctttaaatgtacagattaactgtgtttgctttagctctagtaggccttgttttcattggcttcttttttcctcgttttactctgttttatgctgggcacagctttattaatagtacatcactttgctggggattggctacctaaatatttcaagggtgcttctcttaagtggtatgaattgaaaaggtacttacagagtccattatctaccaggactgtcacctttgacattactggttctatttttgatgatgtgtatctccatcctagcattactgaaaggaattactcaggctgatttgttctgttgaacagtctgctaccgatggatgcttcctcaggtgtctggaacactgtggcctgtggttcccccacaaaaaaaattttagcttttttttttttttttttttttgagatggagttttgctcttgtcacccaggctggagtgcagtggcacgagctcagctcactgcagcctctgcctcccaggttcaagcaattcttctgcctcagcctcccaagtagctgggattgcaggcacctaccaccatgcccagctaatttttgtattttttagtaaagagggggtttcactatgttgggcaggctggtctcgaactcctgacctgaggtgatccgcccacctcggcctcccaaagtgctatgattacaggcatgagcagccgtgcccagccttaaccattttttgaataccctttatttatagttggggaatttacagttagagaaaagactgattagggataagtggcatagttgattttgctgtttccaatgtattatgttattaattaagaaccccaaaactacttttgcttctttgttgtaaaccgttcgttatggaagtttctggaacaaccaggtcctagttagagtgatgaaatcttaagacaagcaacacttaagggtattttggtttaacttcacacactcgaagtaagaggaatatattctcaagagcttacactaccaaaacattggggagaaatgcttcctcatcagaatatcttggtatacatgctaaatacaaaggttatggaatataatcttcatcacataatctaaaaattgttaatagacatggtaaggtactggtatttgcttttcataatagatgtgttctttagaattggggtataaatcgtttttatttttttttaatttttggaaatgtttctgagtcataaaatctttttcaaaatgaatctctaaagtccactaagagtgttttaaatataaataaatcctatgatgaagagttttggatattacttgaaaaatcgattttcagtcatcaaaaataattttgaagttatatgtattttgctttcttctcaggggtcacaaactggtggccaaatggcagaaaacacctgcaggtgtgttttctttggccaacacagtattttccaaaacttgactttgtgagtgtctttaggcagaacatataccccctctagttcaaccatatcactccttattgccatacaccagtcacttaacacgtttatgtaattttggtggtctccctgtatagatggattaattgatactttccttacgatgtcttagcctcctcgggaagatgaacaaaattagtatacattatgtacaacaatggtgaggcttaaattttcagttattttaaagcctagccttctaaatattcagagggtaagctgtagtctcaagactgcataatactaattctgggattttaaattcccttaacatttgttttagagcttagaaattacattgaaggttatactaaacaggttctgattagtgtgactaaaagtgtgaagtttttaccctctttttaatgtgtaccttgaataagatttgggttgtcttaatttatattcaagtagacataaataggttgcttcacttctcaagatattaagtgaactgttttaaaagacttgcgattaacttctttggtagctaggtaatcacttagttgaacttctgggcaagtgtatgcagaaagctcaagtcaaggaacttgtgagccaccaatataggtactcaacttgctttgaactgtgagtgtttgatgtagacctaaaagtactgtttaatatctgaatgccttaattgtatatttcttactgatagttctgatttttgggttttgcctccttcagctgagtctagagatgtgaaactttagaattattatagcaaaaatagttgctcatggttttggagcacttaactttgtggaactatgcatattcctctcatttaaacctcacaacaatgctatatggtgggtactatgattaatctcattttacaaatgaggaacttaaggtttagtcaaggagaacaccttccccaaagtctcacagctagtaagtaccaaagcaaggacttgggcccagacctgtctgactgcagagctcatgctcttagcagtgtgttttactgtttttgcttatggcttccctatgtcttgctttactacctttagataccatatttagtgatggttttgaagtagctgggatctccatgtgctattacatctgcccagttttagagcagtgtctcttacccataatttagtcagattgcaacattgatccaaatgtgtttacacttgagatcataatacataaggaaactcaaagttttgaactctaacacattcccactttttcttgcatattatagtgtcaataaatactgaaaaggaagaactgtgctttcttcctcagaaagaggaagatttatgaccaggtggtgataaaggtgaagtatgttctgatggacatacttccatacttctaatgggcatatgtttgtccattccataagattttactttcttagttataatacatagtatcttcaggtctggctttgaaaagaaaatagggagtaacaataatttgaggaatataatgtctctgtatgttgcattttatattattttgaagctttgagacacttgttcatagtaagggcagctttgttagcaaattgtttccaatgagcttgctaaaaacaaactttttgatactgttttgtcacagatctagtcctagaatgattatagtcttctctctttcttaagcagtgataaaccttttaatgagaacaaaaaggaaataaattgctaactctgaaggaaccagtaagaaatacactgaagtatggtctgttgttttagaataatttgttaaatggaccagagtaatatagtggaacatgcatcaccttataccatatagtaactgattcttctaagtttacttgaacagatttcagtcaggaaaaaacattgctcaattgtgttcttcaatttattcaacaaacaattgaaaataatattttaaaggacataatctcttcatatcacatcttaacaattcttgaatgagatccagtttgtccatgccttgtaagtaagtttataacctactatgctttagggcctcctgctaccttaggttgacatatatttaagaaaaataatttcatttcaatagtagcataaacattagaaaaataaatttgctggaaacatgaatgcaatctaaaccaaatgtgattttaaaattatttctgccattaattccctccatatgtgtgaataattgagttgattttatagtgaagtaccttatgagccatacttaagggtttctgagagggactatgaagtttttcctggcttaaattcaattaagttttcattatagggtcactatgacatgaaaaggaaccagtatgaacacttttatacttattcccttctattttaaaaataacttgattatggatttgtattctggcattggtttttgaaccattgtgctttcattctttctagtctgtctaaaaatcactggagcgtttaagatggcagctgactaacataggcctttgaggtcttttggtcttctaaaggaagaaggccaaattttgggcccagtttcttaaggatgttttcaaaatgtacagtggctaaaatcttgtaagcagtaattttgtgtttatgatggctgtctccaagtttgggggaaaataatggcaaaacaaaaaatcacatttgagtagttcttagagcaattcctagagatgtatttcttacctggcctttcctctctaccctgtatctttgcattatttaatacttggaaaaacccacatagcattaaaaacaaagtactactgaacaaagtgataaatacattttcttaaatctttcttttctaaccacaggaacatttaaacttacaatagaattcactgaagaatatccaaataaaccacctacagttagatttgtctctaagatgttccatccaaatggcaagtatcacttttagtacagtgttttaaactactatagtgtttattatggagtattccacatttcctgtgtattttgtggtgcctgagtatttgtttaggcagcttgctgcttcttgaaagctgaacttgttcttggttgtctgtggctgtcttgtcctagaactgaagcagtggaggtattttccctttgcttggagtctgggagcctcctgattttgatgacctttgtcatttacttattaaacaaaatgaaggatgctcttgaggtttccttttaatgctaggccagattgggatagtcttgtgttgtaattattttcactagcgtttagaaaagtagttttcattggacgcatatcagaattactgtggaacattttaaaaacacagatgccttcgccccactccaaacctaatgaataggattctgttgttgaaggccaggcatacggtattgtcagaaaagcaccacaggtgattctaacttaaccactttgcactttttaaaatagtagtaagcctagaacagcttgccttttatttaggttaatgaagtatttttcagggtatcagatatgtttatctttatgccaaaatgaaatcttgtgaactctgagtgatcttttgttatttcagataggggatacagcctacaaatttggtggaatgaatttcccacatgtctgtggatagctagggaccctgttcaaaaatgtttctgatttcctggataatagggcagccttttccaaaggatgaacactaaatatcttccagttttatactgatcacatctgacattctctgatcatcctgattatttcactagtggtggttatgacttatctttttaggcagttaactgggaagcaacataggaatctttaaacttcaaaagcaaagtattcttgactatttttgttttgtctataatgttaaaaccttagtggtcttgttacgtttaatgtacctacttctttgttcttagtctatgcagatggtagtatatgtctggacatacttcagaaccgttggagtccaacctatgatgtgtcttccattctaacatccatacaggtgaatttttccttaatgtgacgaactataacttttaatatgtttatattagcaattgaattgtttttgaaagtcataatgtaatagatctttttatttttggtcaaagcttgtttgttttatagatgaaaagtagaccattaagacccaagtcagctgggtacagtcgctcacacctgtaacctcagcactttggcaggccaaggtgggaggattgcttgagttcaggagtttgagaccagcctgggcaacatagtgagactcttctcccttaaaaaaaaaaaaagccgcatatattttcctagctactagcagattcacataactctgggtttgtatgctaaagacaagaaatgtagctgtacttaggacaattcaattgagtgtcactaccttataaaatagttgttttgcattaaggaactgacattttaaaaattgtctctttagtctctgttggatgaacccaatcccaatagtccagcaaacagccaggctgctcagctgtaccaggagaacaaacgggaatatgaaaagcgtgtttctgcaatagtagaacaaagctggcgtgattgttgaccccgggtacagtttaaagaagctggccataagaaaaatatatattgatgtgtttgtcacctccctactcctgtcattacatttactttattaaaagcaaaataactgttgtgctgtttccatcttccttgccaagttttcctaccccttctaccctctccttaaacatcagaaaacaccctctatgaaatcaaatgtactgtacctgggttacttgcaaaaattactaatgcttcagtttttctgttgtatttcatttccagttttcaggcagttatttttattattgtactttaagcttttaagatgaattgttatacaagaggtgcttatgcttagcttgatgaccaggatgttatttttaacaaaatgattgctgaagtgtttcatcctggctggtccttcacttgtgttggatttagaagtgaatgtgtttggaatatggcctacagagaatagaaacaaatccatgtaaacaattttgaaggaggcatgggagctaaaaatcctgtgatactaagatctcagtcatatgaattacaacgtagtatttactggcaagaaggagaaagttgaaggactcagctaaaggagtacagcaattgtagtaactgacacatcctctctttgcaagctgctgactgggcacactcatgccaagtttcagaattattggtcttctgggtttttgctttttaaaagaggtgtgggagcagaggaatggaaacaatcgtgagtttttgagctagggaaagttggagctcctttaatctttttaaaggatcagtgctgccctaagtgaataaactcaattgtccatctttattttagagttttaatgaattcaaggaagggagcatagcatatctgtggcaaactattttccactcaaatcctgagttattgctgcatgctttaatttcttccctttcagcatctgagaaccttaaagccaatgtctgcgatctttttttggatatttatacttttagatatatagtacctttaagtagcagtatgggacaaggcttgtaaatgttttgtctaatgttctattgtcaccttttatgcatttatcacttccaaatctaactttgcacaagtaacccatgtaaaaaaaaatgtacatttttcaaaagttgtaaataaaaataacctt

SEQ ID NO: 36010 - DNA, 19223 bp, Homo sapiens
agcgccacctgcctcattgtgcccaggagttctccaaacccgcgctgcggagtgagtgaccaagttccggccagttcgacctcgaggatccagaggtggagacggtactacctcccagctctgttttccatccccttcaggtccttcctcgggaggcggcgaaggcggtccaccctgcgcgtgatcctttatgcccggcccctgcccctccctccgggtggaacttccccctcaccgccagacttaagctgaggatcgttggatctctggcggggtgcagaactgagcccaggccacagtaccctattcacgctctgtgcttgtgccaaggtgagtttctcttgctgctggcctatctttctcccggaggagatggcctcgattctttactactgaaatgtaagcccctggggttgagtggagagcgcagagcactggaggggacgagacttggtttcggatttgagctcttctttttctctgtatgatctcttgctaacttcccagtttctctgaacctgtttcctcagcaataaaatgaggtcctacattagaactgtagcaagaattgagataaagctttgaaggcgcacagcgcatactaggtgatctgcaagttttaattgccatctttttgtttgctcacctatgtgctttttccagctgctccggctttcttatgcaggtgcagggatagttctcagaagtggggagaagtggggataattctcttacttagacacctgctttgggtctgagaaagtctgacatgttattctgttgccccagaactctgttaaagtaagacacagatctgaaccttcactggatgaggctactgttaattaactcttccccttcagatcgttcatactcagggctgcaggcctgttacttttccaagatctgtttccttatctttaatacaggagcaatctcagtatgattctatctggtccactgggattttttgccgagtatagtaaagtgctttgatattctccaagaggattcttttcaggttttccaacaggtaaaggaagaaggtgacagaggcagcgacttcctcaaatgtccttccagctggccaaactcaacctgtcaagatctctcccccataagctgtgtgtgtgtggtgtgtgtattgtgtacattgtatgtatgtatgtatgtatgtatgtatgtatgtatgtatgggacaggtactctaggagtgaggggttcaggcagatgacaggctcagacctcaaggagtagccaggtttgtgggggaaatttatatataaacagaaaaatgtagtgatgtgcacatgctatcagtacatggaagtagccatccatttatttatttatttattttctttttagagatggatgggggtctctcggtcttttgcccatgctggagtgtagtggtggaatccttgctcagtgcagcctcaaacttctgggctcaaataatcctgccacctcagcctttggactataaactacatgccactgtgcccagttaatctttaaaataaaaaaaaaaaaattccccctagcaagcagactcagaaagaaaaaaacaaatttttgtagagacagtgtttccttttgttgcccaggtttcaagtgatcctcccgcctcagcctgcccaggtgctgagattacatgtatgagccactgcacctggaaaggagccagaaatgtgaagtgctagctgaaggatgagcagcagctagccaggcaaaggtagggtttggggaaggaaagtgcacacacctagagtcaggtaagtgatgtgaccctgttgagtgttcaaagtctggaatacagtctgacatgaggaggtggtgaaatgagaaagatagaagccaggttttgagaagcctggactttatcctgaatataggggagaattgctggaagggtttgagactgggagtcacatggttggatctggtgatggactgcgggaagagggaccactctggaagccaagatctgtggtttaagtaaagagtgatggtcagctgggcacagtggctcatgcctgtaatcccagcactttgggaggccaaggtgggtggatcacctgaggtcaggagttcgagaccagcctggccaacatggtgaaaccctctccgtactaaaaatacaaaaagtagctgggtgtggtggcacacacctataatcccagctactggggaggctgaggcaggagaatcacttgaacccgggaagcagagattgcagtgagccgagatcatgccactgcattccagcctgggcaacagagtgagactctgtctcaaaaaaaaatttaaaaaggctgggcacagtggcttatgcctataataccagcacttcgggaggctgaggcgggcagatcacgaggtcaagagatggagaccatcctggccaacatggtgaaaccccgtctctactaaaaatacaaaaattagctgggtgtggtggcatgcgcctgtagtcccaactactggggaggctgaggcaggagaatcggttgaacctggaaggcgaaggttgtagtgagccgagatcacaccactgtactccagcctggcgacagagcgagactctgtctcaaaaaaaaaagagtggtggtggtcagagatggggcagtggcagtggaggtagatatggatggactagagaaagatttaggaatatatattttaaaattcttttcacatacatcaagaagtacaggaagcattattgcaatcttaggtcttaggttacatattagagcattctctttttctgtagctattaagtattaacaagatttaaaacccagctaaactgacaaaatctggccaacattacatatgtaaggtgattttccaagctggcttttctagaagtataggagaggccgggtgtggtggctcatgcctgtaatcccagcactttgggaggctgaggtgggcggatcacgaggtcaggagatcgagaccatcctggttaacatggtgaaaccctgtctctactaaaaaatacaaaaaaattagctgggcatggtagcgggcacctgtagtcccagctactcgggaggctgaggcaggagaatggcatgaacccgggaggcggagcttgcagtgagccgagatcacgccactgccctccagcctgggtgacagagcgagactccgtctcaaaaaaaaaaagaagtataggagaaagccaggtgtggtggctcacacctgtaatcccagcactttaggaggccaaggtgggagggtcacttgaggctagaagtttgagggggcaacacagtgagaccctatctctacaaaagaaaaataaggccaggcatagtggctcacacttataatcccagcactttgggaggctgaggcagaaggaccacttgagcccaggagtttcagaccagcctgggcaacaaggagaaaccctgtctctacgaaaaacacaaaaaatgagctggacatcgtggcccatgcttctagtcccagctacctgggaggctgaatggaaaggatagcttgagcttgggaggtggagtttgcagtgagctgagatcacaccactgccctccagcctggacgttagagcgagactctgtctcaataaataagtaaataaataagctgggtgtggtgacatgtgcctgtagtcccagctactcgggattgctccagtccaggagttcgaagctgcaatgagccatgaatgggccactgcactccagcctgggcaacagagtgagaccctgtctcaaaaagaaaagtacaggagaaaatactctcctcaccaactacttatcaaaaccataatctgataatactcataaatgcctgcaaggaactacaaatactttctttagatggcttttatttatttattttttagacagggtttcagtctgtggcccaagctggagtgcagtggtgtgatttcagctcattgcaacctctgccccccaggctcaagggatcctcctgcctcagccccctgagtagctaggaccatagagacacatcactatgcctggctaattttcatattttttgtagagattaagttttgccatgtcccccaggctggtctcgaactcctggactcaagcaatctgcttgcctcagcctcccaaagtgctgggattaacaggcatgagccaccacacgcaaccagatgtttttttttaaggcccaaatggattatactatcaacatgttgtctggtttgctttaacacttgttatccagggctttggtcttttggtgagatagagtacaaagtcaacactctatccacaagttgtgcatctgcggattcaacctagaatcaaaaatacttgggaacaaaaaccaactttaaaaattcaaataaaaaaatacagtataggccgggcgtggtagctcacgcctgtaatcccagcattttgggaggccaaggtgggtggatcacctgaggtcgggagttcgagaccagcctgaccaacatggagaaaccctgtctctactaaaaatacaaaattagccaggcgtggtggcgcatgcctgtaatcccagctactcgggagtctgaggcaggagaatcacttgaacccaggaggcggaggttgcggtgagccgacattgcgccgttgcattccagcctgggcaacaagagtgaaactgtgtctaaaaaaaaaaaaaattataacacctatttacctagcatttagcatttatattgtattaggaattataagtatttagagttgattaaaatatacaggaagatgtacttaggtttatgcaaatactatgccattttatataagggactggagcatcccaggattttggtatctgaaggggtcctggaaccaatctcctgtggataccacgggatgactatacagaaagaagagcatgggttaggccctgtgcaaggtgctttagatatagtatctcttgaaaatatcagaactgagattcaaacccaggtctgcgtagccccacagcctaaactgtttcctctgtactctactgctggatttgatgagtacagttttggacatggcgaatctcagatgcctatacatactagtggagaggtccagagggcgttgaatatacagaagtggggtgagaagaatcaaggcctaaggcgataaccgaagacatgaactcaactagggaatgagaagattgaggagaaaaccctgaagggacctttcctttgcctcccacaccagcatatgtgggagccagaggagaggcccatgcagctaggaaacactcatgtagatattgtttcctttttttcctgtgtcttctacttccctgcagccaggcagcaactgtagagccctttgagaaagaaagaattcaacagagggaaggaacctaggcattgaattggaaataataaaacctgattcctgataataccctcctccccactcaacccacacatctctcttttacacttgaatataacatgaaggtttccgccgggcgcggcggctcgcgcctgtaatcccagcacattgggccgaggtgggtggattgcttgaggtcaggagtttgagacaagcctacccaacatggtgaaaccccgtctctactaaaaatacaaaaaattagccaggtgtggtggtgggcgcctgtaatcccagctactctggagtctgaggcaagagaatcacttgaacctgggaagtggaggttgcagtgagccaagatcgtgccactgtactccagcctgggtgacggagcaagactccgtcttaaaagaaaaaaaggatagccgggcgcagtggctcacgcctgtaatcccagcactttgggaggccgaggtgggtggatcacaaggtcaggagttcgagaccagcctggccaatacagtgaaaccccgtctgtactaaaaatacaaaaattagccgagcgtggtggcgggcgcctgtagtcccagctactcgggaggctgaggcaggagaatcgcttgaacctgggaggtggaggttgtggtgagccaagattgcgtcattgccctccagcctgggcaagaagagtgaaactccatctcaaacaaaataaataaataaagtaaaagataggctgggcacagtgactcatgcctgtaatcccagcactttgaaaagctgagactggtggatcacctgaggtcaggagttcaagaccagcctggccaacatggtgaaaccctgtctctactaataatacaaaaattagctgggcgtggtggcacatgcctgtaatcccagctactggggaggctgaggcaggagaatcgcttgaacccaggaggtggaggttgcagtgagccaagatcgcgccattgcaccccagcctgggtgacaagaatgaaactctatctcaaaaaaataaaaataaaaaagataacatgagggtttctgaatgctgccaaaggtccagataggcagttcctgacaagctcagagtctggaatctgttcacgcacagctaggctggaaagcagttgtatcaagcagaagatgaggaagtcaagagctggccgaggatgattttctgtcctagagaaaaacatctatgtggcaccttcattcttccctagggagctcttgttctttgcagatctcctccatctttcatccctgttccccaagcctcagccttttcggtgttcagtttcaccagcaaaagaaagggagaagcaagattcaggtttcttcttccttttccccttaagccagggtgttgttcaagctctcaccccaggtgtaatttcagagccttctcatgcgtgctgggtaatctgcgagaggccaacaggtcattgggcattaagcccaggaaacctgccttagaccctggtggcagcaggccaccaggttcctcttgtcaagtccagacttgcttgcttgatcccttggaaatttgattataaagagcattgccctggtagcttgtggtttgacactcagattgaagttttgattttgttttagcagaaaagagtggtttccaaaaccaacttaaactagactataaaattcttcctgggtcagaagtattaggaaagacagtgttggtgtactggctttactcacaacttgtctttttttttttttttgagatggagcctcactctgtatcccaggctggagtgcagtggcatgatctcagctcactgcaacctctgcctcctgggttcaagcgattctcctgcctcagccacccgagtagctgggattaaggtgtgcaccaccatgtccagctaatttttgtatttttagtagagagggggtttcgccttgttggccaggctggtctcgaactcctgacctcaagtcttaagtgatctgcctgcctcggcctcccaaagtgctggggttacagacgttagccactgtacccagcctcaacttgtcttattattattattattttttgagacagggtctcgctctgttacccagactggagtgcagtggcactatatcagctcactgcaacctccgcctcccgggttcaggtgattctcatgtcttggcctcccaagtagctgagattacaggcatgtgccaccacgcccagctaatttttttttttttttttttttgagatggagtcttgctctgtcacccaagccggagtgcagtggctcaatctcggctcactgcaacctccacctcccgagttcaagcgattcctcctgtctcagccttctgagtatctgggaccacaggcatgtgccaccatgcccggctaatttttgtatttttaggagagacggggtttcaccatgttggtcaggctggtctcgaactcctgacctcgtgatctgccctcctcggcctcccaaagtgctgggattacaggtgtaagccaccaaacccggcctaatttttgtattttcagtaaagatggggtttcgccatgttggccaggctggtaataccctgacctcaggtgatccgtcgcatcggccttccagagtgctaggattacaggtgtgagccaccactcctggccacagcttgtcttattacttgctctatcctacatccttttagaacctggaaactaagattatatttataaagatattgttggcaattaaatcaatcccaagagtgatattcatggtactgatgagatcaagggaaaaggttgtatctacctcattggctcttggtgtgaacattctctctccttttctttcacttgaatagctcctgttcagttattctttaggacttgactcaggaagagattcctccaagaagccatcctagcaaggttacccttttcttgccacccttgtgcagctcttgtgcagaatttgatcaaagctcttatcacagtgtactgatatcacctgttcccattacaagaccataaactgaaggaaggcagtttaaatatttaaatacatttttctcttgggtttagcacaagagttggaacattcaatttactgacaaaacgagtattcttgggccatttggtgacctcttatttgcatagctttccagagggggaggctccagttacctgctttgtttggttggaaatttacttgtatctgtaattagttacttttctgctgcactgaagtcatgtgtatagtttcctttcctggaaagagttcttccccttaactcttgggaattcttaaaaaccagtgtcaatatttctttgtccttgcccttttctgtagtacatcatacttgtgtctaccatgagtatctttttataggtctgtgtttatttgccttttttccattagctcctccttagatccttggttttgccacttcttttctcttttcttttctttttttttttttttttttttttttttgagacggagtctccctctgtcacccaggctggagtgcagtggcatgatctcagctcactgcaacctccgcctcccgggttcaagcaattctcctgcctcagcctcccaagtaagtagctgggattataggcacccgccaccatgcccggctaatttttctatttttagtagagacggggtttcgctatgttgaccagggctggtctcgatctcttgaccttgtgatccgcccacctcaacctcccaaagtgctgggattacaggcgtgagccactgtgcccagccagttttgccacttcttagctgttgatttggagcaaataacttcacttttttttttttttgagatggagtctggctgtgtcgcccaggctggagtgcagtggcgcaatcttggctcactgcaacctccgcctcccgggttcaaacgattctcccgcctcagcctccatagctgggactacaggtgcatgccaccacgcctagctaatttttgtattttttggtagaaatggggtttcactctgttggccaggctggtctctaacttttgacctcaagtgatttgcctgccttggccttcctatgtgcttgtattacaggtgtgaggcacagcgcccggtctaacttcacttctttgagcctattttctcaactaaaaaattaaagatctggatatggtggctcatacctgtaatcccagcaactcagggtgctgaagtggctggatagcttgaggtcagaagttcaagaccagcctgggcaacctagccagaaccatctctaaaaaagtttaaaaacatccaggtgtgctggcacaggcctgtagtcccagctacttggaagggtgaggcaggaatatcacttgagcttaggagttcaaggctgcagtgagccatgatcacaccactgttctccaacctaggagacagaaccagaccctgagtctaaaaaagagttccttttttaggactccctttacctcccttgcaggagcccactcgggcctaccagcatggctgaccagacctctgtgaaaggtacttggagaatctctgcagttcttttttttttttttttttttgagacaaagtctcgctctgttgcccaggctggagtgcagtggtgcaatctaagctcactgcaacctccgcctcctgggttcaagtgattctcctgcctcagcctcccaggtagctgggactacaggcacccgccaccacgcctggctaattttttgtatttttagtagagatggtctttcactgagttagccaggatggtctcgatctcctgacctcgtgatccacccgcctcggcctcccaaagtgctgggattacaggcgtgagccaccgtgcctggccgagaatctctgtagttctgacaacctcctgggaacatttatttcattctcagagaagtggccccttcctgggcctattcagttacctggtctctctctcataatggcctttgcctgccttacactggcttgagaccttatttagtcaagactgggtgcttctgtgtggccaccctgcttttgtttttagatagtgcagttctttaacagagatctttagcctgccacagagaagggcagccaggctggtggtctggttagtgtttgtccaggagctactggccatggttggttttgggcaccctgtctctgctgcctttgctcacaggcacatatataaccacgtgtttgtcctacacatctgtcccctcttcccggcccatgctttgtagtagtgagacagagtcttactctgtcacccaggctggagtgcagtggcgcaatctcagctaactgcaacctccacctcccaggttcaagtgattcttgtgcctcagccccccgagcagctgggactacaggtgcgcgccaccatgcctagataatttttgtatttttagtagagatggggttttaccatgttgacccaactggtcttgaactcttgacctcaggtgatctgcccgcctcagcctcccaaagtgctgggattacaggtgtgagccactgcacttggcgctttgcagtattcttgacagtggaaatctgagacctgaacaacagcactaaccccaacaccattctcttcccatctgtgtttcagggggcaatggcggcttcctgtgttctactgcacactgggcagaagatgcctctgattggtctgggtacctggaagagtgagcctggtcaggtgagggatgggggaagaaaaaagaaacttgttgagcctctgcctgcattttcctagcagccccacccccatactccccttccagcggggatgagccagtgggaagagataagagaagacaccaattatacatcctgggcttccccagctgactcagagagtgggctgaggggcccagcagggctgggggcataggaaggacatctttctctaactggatctgcactgagtgctgtggcaaacatggggcccctctgtgcccatccctatgctatgacccctaatatggcagttatcaccctgtgctgtgatcatgtctcctctcccacactgggttctttgagggctcagcctctccctactgctcagtccagaattaggcacatagcaggtgtcaaggtttgaagaataactaggtgaattgtatattgtatagaccaaaggtcagcaaatttttttttttttttttttttttttactcgagacagggtctcgctctgttgcccaggctggagtgcagtggcacaatcttggctcacggcagccttgacctcctgggctcaagtgaccctcccacctcagcctcctgagtagctgggaccacaggcacacactaacacacgggcccagcaaacttttttttttttttgaaaccgagtctcactctgttccccaggctggagtgcagtggcgtgatcttggctcactgcaacctctgcctcatgggttcaagtgattctcctgcctcagcctcccgagtagctggggctacaggcatgagccaccacacttggctaatttttgtatttttagtagagacagggttttaccatgttggcaaggctggtcttgaactcctgacctcaggagatccacctgccttggcctcccaaagtgctgggattacagatgtgagccaccttgcccggccacaaactattttttaaagaacaagatagggccaagtgtggtggctcatacctgtaatcccagcactttgggacgccaaggcaggaagattgcttgagcccaggaatttgagaccagactgggcaacacagtgagacccccgtctctacaaaaaattaaaaaaattcgaatgcgcctgtggtcccagctacttgagagactgagttagggggattgctggagccctggaagtcgaggctgcagtgacctatgatcatgccactgcactccagcctggacagagcgagaccatcttaaaaaaaaaaaaggtaggctggacactgtggctcacgcctataatcccagcactttgggaggccaaggcaggtggatcacaaggtcaggagttcgagaccagcttggccaacgtggtgaaaccccgtctctactaaaaatacaaaaattagccaggcgtggtggcacacacctgtaatcccagctacttgggaggctgaggcattagaattgcttgaacctgggaggcagaggttgcagtgagccaaaattacgccactgcactccagcctaggcaacagagcaagactccgtctagggggaaaaattaaggaaaaaaagttaaaaaacaattagattctattggacaagttacagatggaggtgattatacactcatgtgaccttttaatatgtaaccacttaagctgggtgtggtggctcatgcctgtaatcccagcactttgggaggctgaggcaggcggatcacctgaggttgggagttcgagaccagcctgaccaacacggagaaacctcatctctactaaaaatgcaaaattagccaggcgtggtggtgcatgcctgtaatcccagctactcaggagtctgaggcaggagaatcacttgaatccgggaggcggaggttgcagtgagccgagatcgtgccattgcactccagcctgggcaacaagagcaaaactgcgtcccaagaaaaataataataaaataaataagtaaccacttaaaaatataaatgtagttcttaactcaagaactgttaaagttgataattgactgacccctggtgtagaccatcccagctgaggggagtctgggaatatggacctgctctctcagggtggacgtagctatgagatttggctcctgcctggaatggggcatttccccagggcttcttccttcttccttggaaatcttgagtcagagtgaagagaagtttggggattaagtttcagagaagccccagcagagagaacagattcttctatctgggatttagactgatgtttgtggtgtgcttggatgacctgtgtctcttttcccttttgctttctttcctatagctgccaaggagcctggagccagggtccctgtgctttaggcaggcacttctcacagcctcggagaagtccaggagctaggtcaaggcagagggttgggggccacagacaaggccaaggcggggcatggaacagcaggggtcagatgttaggggaagtacgtcggcacccgggtggggatcttgaatactatgtcaggcacccacaacaagagctttgggtgctttgtgtctagggccgggtacccttgtttctgctgctgatgccgtgtttccagtctggattttagcaaaattaactgacccatccttctatctgatgcctgttttcttctctctcattagggagttctgggtccagcttttagcccacttatctgcctccagctttcagcctacttatctgccttccttaatcttttcccccttctaacctcttttgctggcctgtgctcccagagttcccagagtctgtctacacaactccctgtatgtccttggcctaggaattttttcctgtgtttctctaaccagctccttagaacctggaacttgtttccatggtctatacttcttttctctatttatccatctgtcttctgattgaaaaaaaaaattatttatttttgaaaatttttaaatttttatttatttatttatttatttaattttatttttgagatggagtcttgctctgtcgcccaggctggagtgcagtggcgcaatctcgcctcactgcaagctccgcctcctaggttcacaccattctcctgcctcagcctcctgagtagctgggactacaggcaccccctaccacgcccagctaattttttgtatttttagtagagacggtgtttcaccgtgttagccaggatggtctcgatctcctgacctcatgatccacccacctcagcctcccaaagtgctgggactacaggcgtgagccaccacacccagccatttttttttttttttttttttttttgagaaggagtttcactcttgttgcccaggctggagtgcaatggcatgatcttggctcactgtaacctccacctcccaggttcaagcgattctcctgcctcagcctcccaagtacccgggattataggcatgcaccaccacgcccagctaattttgtatttttagtagagacggggtttctccgtgttggttaggctggtctcaaactcccgacctcaggtgatccacccacctcggcctcccaaagtgctgggattacaggtgtgagccaccgcgcctggcttttatttaaaaaaaaaaatttgttttcaattttttgttgttattttttttgtgtttttttgagacggagtctcactctgtctcgcccaggatgaagtgcagtggcatgatctcagctcactgcagcctcccccgcctgggttcaagcgattctcctatctcagcctcctgagtagctgggactacaggcatatgccaccatgcacagctaatttttgtatttttagtagagaaaagaatttcaccatgttggccaggctggtctcaaacccctgacctcaggtgattcacctgcctcttcttcccaaagtgctgggattataggcgtgagccaccacgcctggccttaattttttttttttttttaaagaggtgggggtctcactatgttgactaggctggtcttgaacttctgccttcaagcaatgctcccatgtcagcctcccagagtcctaggattacaggcgtgagccactgtgctcagcctgaaaaaatatttactgaagccctctttatggtagatgccgggaaaatattgttagtttttgctagaccttgctgagatggcttgggtaggaaggcatcttagagactggttggggtgggagcagagcaaagggtttggagcctctgaagaggcttctggtcccttagactgaaaccatcttccatctttttttttttctttctttgttttgagatggagtttcgctcttgttgccgaggctgaagtgcagtggcacaatctcagctcactgcaacctctgcctcctgggttcaagtgattctcctgcctcagcctcctgagtagctgggattacaggcacctgccaccacacctggctaattttgtatttttagcagagatggggtttcaccatgttggccaggctgacctccagctggccaggctggtctcgaactcctgacctcaggggatctgcccacctcagcctcccaaagtgctgggattacaggcgtgagccaccgcgcccagttcatcttccatcttttcacctccactgcatagatgtgcctgttatatttctgagcccccttcccccagcattgaccttggggtggtgacagtagaaggctgaaaccaacatagctgaaacctctgcttctctcacctggcaggtaaaagcagctgttaagtatgcccttagcgtaggctaccgccacattgattgtgctgctatctacggcaatgagcctgagattggggaggccctgaaggaggacgtgggaccaggcaaggtaaggactggggttgtaaatagaggtgggataagagaacttagaagctgaagctagggctggggcccagctggagggaatctggcatcagcttccttccagttcctctcccagagttgagggtgggtgagaccacgtgctcatggctcttctcactgtgggccctgccccctgcactaggcggtgcctcgggaggagctgtttgtgacatccaagctgtggaacaccaagcaccaccccgaggatgtggagcctgccctccggaagactctggctgacctccagctggagtatctggacctgtacctgatgcactggccttatgcctttgagtgagccttgccagagcctcatctggggaatcagggggttgagcaggatggtgttagtaacttattgtaagtcacagcagcagagcaggataggaacactcatttgcatgccaagctgaggagcttgacatgggatcttagcctcttctgctacagcagcttagctgtagctacaggagtttaactctggaaaaaggaaggcagtctcacatggtgtgtaccccagggtatgcacctgtaaccctcctgctccctttattcatttagaaaaggtgctgacttttctgttgagcacctggggttacagtaataagtaagtctcagcagaagatgtgagaagagctcaccattagtgccgtgccctgtgctggaagaagggtggataactccctgaggatgagttaaggaagacttcctaggggagaggagatatctacgtctaggaagaggagggggcataggcattccatgtaaacttaacacctgggttacgatctggaaggatgaaaaagcatggctttttttggccaggcgcggtggctcacgcctgtaatcccagcactttgggaggctaaggcgggcggatcacgaggtcaggagatcgagatcatcctggctaacacggtgaaaccccgtctctactaaaaatacaaaaaattagctgcgcgtggtggtgagcgcctgtagtcccagctactggggaggctgaggcaggagaatggcgtgaacccaggaggtggagcttgcagtgagctgagatagtgccactgcactccagcctgggcggtaaagcgagactccatctcaaaaaaaaaaaaaaagaaaaagcatggctttttaaaaattcttggccctttgtcctctctgggattggagtttgggacatagagtggctggatgggcaggtagggtagaagcctggcatttgtgtccacacttggtggggctgtctctcactcaggcggggagacaaccccttccccaagaatgctgatgggactatatgctacgactccacccactacaaggagacttggaaggctctggaggcactggtggctaaggggctggtgcaggcgctgggcctgtccaacttcaacagtcggcagattgatgacatactcagtgtggcctccgtgcgtccagctgtcttgcaggtaaggacagcaagcagatgagtggtttaggggttgtctgctcaagagcatgagggagcagacgatggatctgcttaagggagatagctagcaagttgtcagagtgttggtgcagaagtcctctgcataaaggtgggcattgaagcagtgggagagaatgaaattgccgatgggaaatggtgagaaaagcaggctgaaggggagtggaggagtcagcaatagggggtggtccagacatgcatgtctgggatgggccaagcaagctgggtgtcaccacttcatggtgatgggttattctttggctcaggtggaatgccacccatacttggctcaaaatgagctaattgcccactgccaagcacgtggcctggaggtaactgcttatagccctttgggctcctctgatcgtgcatggcgtgatcctgatgagcctgtcctgctggaggaaccagtagtcctggcattggctgaaaagtatggccgatctccagctcagatcttgctcaggtatggggcagtcttagggagagggccctgggttgggaggcaagggttaagggatttcttatttcagtgtctgggtgaggctgaggatcttgccttgtgatctggagggaggccactgtaggcatatttcccatttcagcagggctcaggtgctccaggagcttagggaagctgcatggggaacaaaatagtgcttatgaatactgaccccttttcctcatctgtctaatcccccaacttaggtggcaggtccagcggaaagtgatctgcatccccaaaagtatcactccttctcgaatccttcagaacatcaaggtacttggtaatgggttctatcttctttagctctttgggacattttcttggccctgactctacctggctaaaaaggcagtgttgtggaaccccagcttctgctcacaaagctggctttcttgaaccccactctccatcctcaggtgtttgacttcacctttagcccagaagagatgaagcagctaaatgccctgaacaaaaattggagatatattgtgcctatgcttacggtgaggatgtatcagcctcctagacttggggaatgtgagatttggggtgggattctggcccaggtgtgacctaaggcttgctggttgtgagaaggacacaatgttgtgggtgggattgctatgctggacatagtgccctcatttctctttattgagctcagggaagtagtatggctcagggataaggcatataacctgtgagtcccagtcctgcttcttgatatcttgtaacctagagcaagttattaaacttctccaagcctcagcttcctatgtgtaaaatgagcccagttcctgacatgtagtagattctcagtaaatgatatgaggagagcccagaaggcgttgttgacctcactcgagggattggggttgggagggaagtcggctgtacttagggaaataaatggttcctggcctcttgatctcagttcagactgcaaactcttaggggcaggggtagctacatatcaggctatgggtttggtgctagaatggtgttgatactgtggtgttctctgaggatggggatcccagccaatgccatctggcatagtgctgtacacaggtgagtttgtttaggaagatttggggaagatgcctggagtctttggaatggcaactcctgctgatggagtaatctatctgtctctctttccaggtggatgggaagagagtcccaagggatgcagggcatcctctgtacccctttaatgacccgtactgagaccacagcttcttggcctcccttccagctctgcagctaatgaggtcctgccacaacggaaagagggagttaataaagccattggagcatcc

SEQ ID NO: 36011 - DNA, 10667 bp, Homo sapiens
cagtctacgcttgcgcggcgcaacagggccgactgcagctggaagatggcggcgtccgtggtctgtcgggccgctaccgccggggcacaagtgctattgcgcgcccgccgctcggtgaggtggtggcgagagcgcggggcttcgggacagggcttcgggaagcggacaggtgtgggctgttagcagtggcaggtcgaggtggggaggacgcggggtcagggccgtgggaaggtcacggcggagggcggggaaaggtatctcgccgcttgcctaggggcggggttcgggggtcctcctgaggacctgggaggtggggagcgatcccctgaccgagtcctcactcgcggctgttcccttccacagccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacggtgagttggggacgcttttggggagagggcctccaggttgggcctgccgtcttttccctggttggggtgtgaccttgggctcgagtcttcccgtttgtggtttgggttcggacccaggaccactcaccccgagaatggccccattccctaccctagccacgccttggcttcacgggacaatcttcactataagccaacattatttagcatataatgcccgttaagtaggcggccaaattcttttccagccttttgttaaggagcccatataagggaagtgatcatgtctcctcttataatgcggaaaatgggattcagacaccttaggtgacttgcaggggtccaggtctgtcagcctcactgcccaaggtcataatctccaggctagaccagaaatacattttaggaagcaaatgcattttaacagtacaatgaaatgtgtgattttccaaaaaatacaaattctctaaattgacacaagaaatcttgagtcacagatagatatatgaataggtgagaagattcccaagaaataattatctcctcctcctttcagcccccagccccagggccagatgtttttattgacacatccttttagttttccagaaacaatgtcctgcgatttaaattgttactaagcataggaaaaggtggcctgcaacttccttgttatatgtcacttgttatagtaaagaatgctatattacatgaactctaaaatgtgctagattgtaaggagctgtctgtgctccagtgccagagaaagaatctcaagaatcttgccaattttaatcaaaggatactatagattgtaaaatgcctcttgcattccaagatgttagatgtgaaatacatgttcatctaagattgtgtgatatatggtatatgcattgacatctcttaggaaagcaaatatcacatgttctcacttatcagtgggagctaaaaaatacgtacatacagatgtagagagtggaatgatggacagtgaagacttggaaggatgaaggggtggatgatgagaaactacttaatgggtccaggcctggaggctcacacctgtaatctcagcactttgggagaccaaggcaggcggatcagctgaggccaggagttcaagaccagcctggcaaacatagtgaagccccatctctactaaaaatacaaaaattagccatgcatggcacacgcctgtaatcccagctcctggggagactgaggcaagagaatcgcttgaacccgggaggcagagattgcagtgagccgagatggagccactgcactccagcctgggtgagagagcgagagtccatctcaaaaaaaaaaaaagaaattacttaatgggtacaaggtttgttattctggtgatggataattcagaatccctgatttgactacttgtgcattctgtgcctgtaatgacatcacacttgtgggcggggcacagtggcttacaccagtaattccagggctttgagaggccaaagcaggaggatcgattgagcccaggaataagaggttgcagtgagccatgattatgtcactgtactctggcctgggtgacagagcaaggccctctgtcttaaaaaaaaaaaaaaagaaaaaaatggagtttcaggtgtggatagaaatttctaaaaattgtgcttgtaccccataaatttatacaataaaaaaaagtcttggctgggcgcagtggctcatgcctataatcccagcactttgggagaccgaggcaggcggatcacgaggtcaagagattgagaccatcctggccaacatggtgaaaccccgcctctactaaaaatacaaaaattaggctagacgcggtggctcacgcctgtaatcccagcactttgggaggccgaggcgggcgaatcacaaggtcaggagattgagaccatcctggctaacacggtgaaaccccgtctctactaaaaatacaaaaaattagccgggcgtggtggcgggcgcctgtagttccagctactcgggaggctgaggcaggagaatgccatgaacctgggaggcagagcttgcagtgagccaagatcgcaccactgcactccagcctgggtgacagagcgagactccgtctcaaaaaaaaaacacacacacacaaaaaaacaaaaattagctgggcgtggtggtgcacgcctgtagttccagctactcgggaggctgaggcgggagaatcacttgaacccaggaagcagaggttgagtgagccgacatcacaccactgcactcgtctcgtgacagagtgagactccatgtcaaaaaaaaaaaaaagtacttaggaaagtagatgtgaaaaacttaaatcagctgtgaacaaatagtaaattaaaagactagaccgtgtgaccaagtggggtgagtggtacgtgtttcttttacattttttttttttttttgagatggagtctctctgtcacccaggctggagtgcagtggcacgatcttggctcactacatcctctgcctcttgggttcaagcaattctgcctcagcctcccaagtagctaggactacaggcacgtgccaccacacctggctaatttttgtatttttagtagagacagggtttcactatattggccaggctggtctcgaactgctgacctcgtaatccacctgccttggcctcccaaagtgctgggattacaggtataagccaccgcgcccagcctgtggtgcgtgtttcacagcaaccaggaggctgtcaagaaaattaatattaccttattgggtgccaaggcaacactgtttggtgttcagagctgattaaaaacaacaacaaaaaagatattataggaacaatatttagtgtgataaaatatacagtctaaaccaatagtcccttccttaatgatgaaaggataaaatcattgccagaacaaaggcagcgtgtaatttttagaaaggaaaaaataagttgttatttgcaaatgatatgttgtatgcttagacaaaaacaaataattaactgaaaattgagagtgaatttaaggatttgtatgctggtgagaccaggtaaatgtgcacagttagaagtgtccctgtgggtccttgatagccaatcaggagagcaatgatgtggtgtgacgagtcattcggctgcccctgttttccaagcatgactgtgtccccaagcacaggggtcctgctggggcagctctccctgactccaggattcataagtccctgcctggggcttgtactgagtcactcaggtggggtgtgagtagggggctggggagtggtttgtttgtaaccttttctggtggcttcttgaccaggtgggagtgtggattgatgttggcagccgttttgagactgagaagaataatggggcaggctactttttggagcatctggctttcaaggtgaggctcttaaagtctgtctcctctgggcttagggctgcctgttgtccctcctgaggatgaaggtcagaaaaattagcctgattatgggcctcagttgcggggctgatgtctggctggctttcctaaaaggagccacatgagcttaacctctcctgagtgggcacgtatctgatgagcccctgcctgaggccctcagagccaagaggacccaaggaaccataggagccccacttttcaccagagaagccaggcctgtggaacacacgtagatatgcacatgcattttaacaaacccacagacatgggcatgcatgcttgcttatgaaatgttcttctctggtggaatatctaggcatcccttggttgtaaagacccatgttttttaaaggaatgaaaaacatggagaaggattatggggtgggcagggccatggagccatagtaggcaacctagccagctgcaatgtcacaggtatgtgtgcagaattaacgtgtgtgtgcacaccaagagatagcaccactgttctccacacacaggactaggattgggtcccacagaggccactagcatgtattcacaaacatacagtcatgggaatggcatgggaggagtgggttctatcacttgaacacaggtgtgggcttacctgaccatggctgtcaataaggaggggggaggtgtactggtaatgatccccacagcttgttggtaagctgttacaggagctttaggcaacacttgctctggccatgcccttcagtcctggccctggctatctctgttctgttggcgcatgatgccatggttttggtcacctcaaggcctgcttagtgcttggtaaacagactctgggatctgtgtccccagagtctatgctgagggaggtacctgtggaccagtggtcctgctgggtgtttagcctctgaggacagggttcttgggttcctgtgtagctcctgattgttctggttgatatctggttccagggaacaaagaatcggcctggcagtgccctggagaaggaggtggagagcatgggggcccatcttaatgcctacagcacccgggagcacacagcttactacatcaaggcgctgtccaaggatctgccgaaaggtaacacctggaggaagaggcggggacagagggcagggaagcagaggacagctacctaggagcccctggctgaccacagaatcatattacccttagcgtatggctttgcagctgggcaactaggggtgggcagcaggagatgccaggcctggggattttgtgctgtcgttggtctgcagtggtccacctggcacctaaacatgtcctccttgcatctagctgtggagctcctgggtgacattgtgcagaactgtagtctggaagactcacagattgagaaggaacgtgatgtgatcctgcgggagatgcaggagaatgatgcatctatgcgagatgtggtctttaactacctgcatgccacagcattccagggcacacctctagcccaggctgtggaggggcccagtgagaatgtcaggtgagagttggctggccttgtggggggatgcttgctccattctggcctggccagaccctttccaggtcacatttttagttggctagctgtcggggttattttcctgagttatgcaactggagacagtttctgtatccatgtggtccagtgagtcttttttaatggctttgtgggcttcacttgaattttgggctttgttttaaggtatgttttggtgcatgtcctgacagtccaagggcgaagtgtctgggtgtcccctccatgtggtctcttgtctcctttgtggatggctccgggagctttgatgctgcccttttgagagtcccacagtgttggctcacgccttctcagagaagactatgagcctgtcctgaagtcaggcatgaggcaagggcagacaagggttgccctctgggccctggaggggtgggtggcagagacaggggaagggggttggggagtgtgctagggcccactcttcggagaaaccatgcctctcctagtctgcctcctcagtcccattcatgcatgtaccccaactcactccagtgtggtagaggtgttgacacactgaccatatgtcttgtaggaagctgtctcgtgcagacttgaccgagtacctcagcacacattacaaggcccctcgaatggtgctggcagcagctggaggtgagtgatggaatcactgaagtcctgggtagtggggtcccagccttggttatcaaagccgaggtcctggttcccaccataggggacctttcaccccaggggactctgctcccaccctaaccttgaggggaatgaccttcctcctgtgctctctgaggtgggataggattctaccctgccgccaccactgggactggttacacaggatgctgtccctctggtacaggtctgtcttagccccacctggttctaggatactgagttcatgggctggtaggggatgtaagctcctggccttgttccttgtggccttgcccttgggagagccagccattagttgtgtgttgatgcatgcctgataacaaaccaagaagtgccttgaaaggaaggcacagaagggtggggaagatttcactggggactcagagttggagtttgggggaggggctttttaaagcacctgtagtttgaacagaagcctgaaaggtggtgagtgttatttaggtggggtgtggggagctgagcgcaggggaagagcagtgtcatggtctaaggtttgctctgctgctgtgtggggtcacagtgcaggtaggctggctagagaggggctgtggcagggactgggcaggagatggcaggagcaagggggagcagtagatggactccaggtggttttatagatggaacctggttggggtctggacatgggtaaggaactgaggtcaaggtgcttcccatcttggctggtcgtggtggctcacgcctgtaatcctagcactttggaaggccgaggtgggtgaatcacctgaggtaaggagttcgagaccagcccagccaacgtgacaaaaccccgtctctggtaaaaatacaaaaattagccaggcttggtggcagttgcctataatcccagctacttggaaggctgaggcaggagaatcccttgaacccgggggacggaggttgcagcgagctgagattgtaccactgcactccggcctgcacaacagagtgaaactccatctcaaaaaaaaaaaaaaaaacaaacatgcttcccagcttatgaccttggcggctgagtgtgcagaaaagaccaataggaagagcatgaccaggggctttggagctggggaacctgggggcaagagcaatctgacgtgtgtgtcagactagcagggcttgagctcatggaaggaaggaatgaaaggccaacgcaggccgggcgcggtggctcacgcctgtaatcccagcactttgggaggccgaggcgggcggatcacaagatcaggagctcgagaccatcctggctaacacagtgaaaccccgtctctactgaaaatacaaaaaaattagccaggcgtggtggcgggcgcctatagtcccagctactcgggaggctgaggcaggagaatggcgtggacccgggaggtggagcttgcagttagctgagattgcaccactgtgctccagcctgggcaacagagcgagactccgtctcaaaaaaaaaaaaaaaggccaatgcaactggtggcaccacagagccctcctcttgtggaggtgaggaggcaagatccaaggagtcctagggtatacgtttgtaacattatttgcaaatgtccccagctctcaggggacccaagagctaatcacagccctgtaatagctcctctttctgccccctcacttgccaccccctgcagggccagcagccagaaatacttgagggagagctagagggaaaaggcaggccaggtggctttgtgcccaggagtaccagtcttgtccttgatgtaggtggaatgcatcttctcaagtgagaacccacacttggatcacatggcagcccattttgaaactctgaacgcttttgctctcctgggactgaggccatgggagctatttggccctgaggtgcctgtcctgtccacaaggcagggtctgtctgaggaggaccttctttcctcaccctgttctaatgtcacatactcctggtttctcccactaagacaggacatgggggtcctctgcctgtctgtgaatcgccccaccctgtgccttgggccctggctggtcagtaatgccactgtctgtctcagcaggagtggagcaccagcaactgttagacctcgcccagaagcacctcggtggcatcccatggacatatgcagaggacgctgtgcccactcttactccatgccgcttcactggcagtgaggtatgctgccttttgggcaggagtagtgctcagctgggggcctgtgggaggacccccatgtgcatggttatcctggtgactccagagatacctcagcagttgggaaggggttctgtggctgctgcatcacaggcacacatgttcacacacatacaccctctacccacacctgccaccttttctgttcccctggcagtctggctgttcctcagccttgtcatgtactgtttcagatccgccaccgtgatgatgctctaccttttgcccacgtggccattgcagtagagggtcctggctgggccagcccggacaatgtggccttgcaagtggccaatgccatcatcggccactatgactgcacttatggtggtggcgtggtgagtgccagcgcgagcatgggacctcgccttcagggaagagagggtgctggggctgtgtgctcctgtgcgtgggggtcacagtgtgcgttgaagacaagagggtgggtgctgaccacctatccccctggcagcacctgtccagcccactggcttcaggtgctgtggccaacaagctatgccagagtttccagaccttcagcatctgctatgcagagacgggcttgctgggtgcacactttgtctgtgaccgaatgaaaatcgatgacatgatgttcgtcctgcaagggcagtggtaagtggcagcctggtattcctaggtgggatggcggctttaaccagcacagtgggaggctgagagatgacacactggctcagaatgaataccacccacccccccactttaggatgcgcctgtgtaccagtgccacggagagtgaggtggcccggggcaaaaacatcctcagaaatgccctggtatctcatctagatggtgagtcctacagctcagcggggaggggtagagtacatcttgccagcgacagcaccaaggtggccactgctcctaactaaccaaggttagaaaggaaaactttgaagaccacgccatgccccatcaccccacccttggagatgcaggcaggtgtgagacaggtccacagcccatcactgccataataggtgaccatagaagagagggctgtgatctgagtcagcatgaggtcagggaggtccttgtcaacctgaggctggagattgtttgtgtacctgtgggtccaggattgggctgggtggacctctgagccttctctcacccttaaaggcactactcctgtgtgtgaggacatcggacgcagcctcctgacctatggccgccgcatccccctggctgaatgggaaagccggattgcggtaacatggacccctgggagaggttctggagtcttggcctggcagacacctgggaggtgtagggttggggcctggcatagcgcagcctgctcctataggcatccctggtgtcctaggcagctgtcacctgcaggggtagcatagtgggagggcagggcataggtgctgatggctgtggagatgggcggggcccatggaggtctatagcagggatcccttctgcctttcctcttttgggctggggacagctgcatgctgcctgtgggagatctctgctagttggatgatgctgactggctgaggtggtggccaggtgcccgttagccagtatgccctctgcctcaccctgcaggaggtggatgccagtgtggtacgtgagatctgctccaagtacatctatgaccagtgcccagcagtggctggatatggtaagtggcctagggggtctgctctttgtttatttcctcaggccgttctcttggcctccccttccacctctgctcccgcactgctgctcagcttacagagcagccagttaaggccccaagcagctctccccagtcccctggctgccagggagttcttgctcagaaaacctgtcccagcagttccttgactgcctgccaaggtgccttcatcaataccctgcacccgtcaggtaacgggcacctccatgtggggtggggcttcaagggccagaacatgaagggacaggctcagcacccctgggggaatgttctctcctctctttccactcaaagcctgtcttgtgctgctctgggcagcatctccgagctgggtgcggcacagggccaggtgtccctgtgcaggccaggtaccccaccctgacgctccaccctatccccacaggccccattgagcagctcccagactacaaccggatccgtagcggcatgttctggctgcgcttctaggcgggaagcctatgtaagcaagagggcagggccggggtttgtggtcccccccccaccacaaacacagcacttcggctcctctaacctgtgccacaggtgaccaccaataaaatcctctgctgagaagtg

SEQ ID NO: 36012 - DNA, 122793 bp, Homo sapiens
cgccccctcccgccctccactcaccctgtgtcggccccgctcccctctcccccaccaggcgagcaggcgagcgggcagagcccgcggcggaggccggtccccgggccgggacacacccacccgcccgcccttcttctttccctcccttcctttctccttccctccctctctcccgccctcccgccctcccgccctcgctcgctccttccccctcgcccgcccgctcccgcttccagcggcgccgggcctcccgctccgcctccccgtgcgcggctctcccgggcgcggctccggggttcatggtgacgaggcggcggccgctcgagcccagcggcggcggcggcgggagctggggcgcgggcccgggccgcctctcccagagcgcggggccgggcggcgggcgcgcccaggcagcggctgcgagcgcccccccgcgccgcgcccccgcgccccccgcgccgcgcccccgcgcgcttggcttgcggggggccgggcctgcgggcggccgccgcgccgcgcacccatggacggcccggccatcatcacccaggtgaccaaccccaaggaggacgagggccggttgccgggcgcgggcgagaaaggtgaggaggggcgcaggcggccgcgggctgggggcgagcgcacaccccgcgccgctggagttcactgccgggcgccggcatgggcctgggggaggggtgcacagggcccggagggtgcgtgggtgtggggtgcgcccggaggagagcgaggctgccagagtgcgtgtgccgactgagccagtgtgagtgtgcaggggctggcggagagactgggagcgagtgtgtgtgcatctaaccgggaggttgtgagtttgtgtgcgcgcacgcccgcagagaagttgtgagcctgtgtgtgcacctaacacagaggttctaagtgtgtgcacttgtatgtgtgtgtgcacacgcggacagagtgattgtaaggatatgtgtgcacctcacagagaggttgtgagattgtaagggtttgcgcacctaacggagatgttgtgagtgctttttttcctgacaggctgtgagtttgtgttgtgtgtattagaggtttgtatgggcctgactgaggggttgtggaatgtgtgtgcgtgagcatgagcctggagaggttctatgcctgttcactcctgacagagtttgtgagtgtgtatgattgtgtgactacaccacccaactggcggattgaatgtgttgtatacatctactgggagggcgtgtgtgtgtgtaaattgtatacaatgaggctgtgtgcatcagtgcacctaaccacgaacctgtgtgtacagatgtgtgtgccttcctgtgtatcagacaatgaggccatgtgtctgggtgtgtttagttggttgtgcaagtgctggagtctgggggggagaagaggcagttcggagccatccccgctttctcccttctccactctttgctgtctccgggccaccagcatgttgggaggacttacaaggcctggcccttccagggcccttttaggacccagctttaaagggcacttgtggatcccttatagtgccaggagtgtcccctcccagagagctggccaagggctcagccagcactgtgcttctgtgcctgatttgattttggcacattttgaccccagccccccattctgtttcctttttgtcctttctcttggtgtctgtgttcccacttagagacttggcgtgtccccctctcttgcatgcctggaactttctgtgcctctagtgtgttgggacttggacagactgttttgaagggtcaaggaatctggcttcttttgttctggtgactaaagcttgcctcattctcttcctgtcctgcgcctcgtgaacacctggactgaggtcaggtgcagcccaccaggacccctgacccctctccaggccggagctggccacagccggctttggggatgagtcagatttctttctaggggctcccacctttgctgtgccagtgggtgaggtgtgcagcccctgctagaaatctgcgtgggagtgaggggaatattctgcctctcctcaggcagaggccactgggcaagcccgtcagaaaaacggaaggaaccagcaggtaccctcaggttgggcatttgtcaacctgtttgcagtttcgtagaccacaaacattgtatgtgtctgcagactggatttcttttatgtaaaataaagaattcaaactctctcaggcatttttctgtgcctttcagatggtctaaaaaattctgcaagagagtgctccaggtaaatccccgtatttctctgggacccaagtgggcagctgcttggtgatctggacttcctgccataggggctgttagttcttggagccctggctgggtgtgtgccctcagggagcgtttggttggaggcatcaaggaggtttgcttcctgtgctccttaccagctgtggattgagtgctttgtgtgatgctttgccagagagaatccacagctctttgaggagaggtgtggcacaaagcagggaaatatttgtcagagcctcagacctcctgctgccccccacctgactccaggagcaggagcaggagctctgccaactttcccttttcctctaggtgctaggatttttaaaacaaagaatcaatctatccaaaatccaaaccatgtacaaatactccaggatagtgcttgttctattcaacttgtttacattacttttcatgacaatcttttattatctttagcagcctattttgtttgccagtgtcagattggttgtttgttaaccgattagaggaattctttacctgcagccctggggtggggtggttggctagtaggtccttcttgctgaagcattgaaatcctactcaatttagttcttcactttaaaaaatggaaataattttggttacctataatgtcgcaataaactctagagtcaaatgttggaataatttcttcagatttataaaccagtaaaccggttcagcaatgtttctagcttaagcatgttgatatcttcagatgggcacataaaattatgtaaaatacatttttacataattttacattatgtaaaaatgtattttacataattttattttgagataattattttgttttaaaaatattgggcctggaatattttaaatatttaagttttataatagggaagaaactattgcttttacatgtttactttcatcatttattctgtaaaataggaatagtaatgactacctctggggtgtgacctgagggttcaaagagatgatgtacattaaagactctgcctggttcaccactgtgtcatgattccataaatctttctttagatacagatttacaaaggaagtactaagcatgggctgtggtgttttgcaccaagttgaattacttcttgacacattgccacgtggtggtgcacaactcagagatgactgtcactgtcagcctggcctgtcacagaatgctcatatcttacagttgtgtttgatttggttgataatgtcaagataaagagacaaatttccctgtaagtttaactcagcctactttgcaatctggaaatttcctcttacacattaataggaaaatgtccaacagtacagtagaaaagtggacaagagttaggaacaagaaagtcgtagaggaagaaatctgaatggccaataaatatatgaaattgtgctctacttcatgtgaaaccttttcatgcatcagcttggttaaacatttaaatgactgccaatgttcaaagtagacaaaggtttggaaaatgacttaatagacttttgtgagagaataaagtgagtacagagtttttagagagtaatttaatactgaatcaattaggaacacatttggctgcaagtaacagaaaaccagatttactgcagcttaaaccaataggagtttattcttcccacataataagctgtctgaggtaggctgctgatagctttttcagcaactcattgataccagggccaacatcatagtgattctcctggttttccctcatgttatagcatggctgccacccttccaaacaccacagccacctttagggctggaaaaagagtgccagtcttgtgtattccttttacctggaaagcagaaacgcaaaaacattcctagggaccacccagaaaactttgctgatgtttaattggccagaaccaggccacatggctaccccttgctgcaaacagagtgaggaaagtgagtttccagcttttaaaccagcctttgctgtgggaggcaggaggggagaagattgaaaataggtgggaacaggtattggttcagccaaacagcagtattgaccacacattgaaagctcctgttctacttctgagtttctgttctagagaaataacctcatttgtgctcaaagaaacatgtacaaggattttcacttaatggctacattgcttgcaatagcaagtattagaaccatcctaagtgtcagtaggtgaatggttaggctatgatacatcattagcagaatactgtgaggcagttgaaaagaatgagctaaattaaatctaaacatacagataggtgaattttcaagacattttaaagcaggaaaaattttgaagaacagtataaacagtatggttcctacctttgtaaaaaaaaaatcacacatacacacaactgtatatttgtttagaaatacagaaaaagtaatatggaaggaaataagctgacaacaaatattcctctgggagaagactggacaacaaagattcctctagggagaggaaactttgccttttgtttaaatattaatgaaatatactcattttacagatgaaattttttaactaaaaaaagaaatttcccatagctctttgaagggaaagaaataatttgagggaattgaacaataataaaaccaaaaaaatctcaattagtatgcagtattagcaagaacatatcaatgacatctaaacagttaattattttgtaagctaatatgtgtccttgatgagatttctgcaggaaaatttgtttgggcagatatttttgcctaaggtgctaggtgtgtttcctttaaatgtttgtaatactcagtgttaattcagaaactttaagctttgggctgctaacaaaattatagcaaagagaagacttttggaagcaataattatttcagatgacagaagcagatttatagtagattcagactaacttttttatattaaactttttatttggagataactgtaaatttacatgcagttttaagaagtcacagagactttctatgccctctacccggtttctcttattactgacatcttgtaaaactgtatagtatcacatcaggatgttgacattgatatagtcaaggtatagaaaaatttcatcatcaggaggatccctcctgttgcccttcagagtcacactgcttccctcccatgcccaccctgctccatatcccactggtgaccactaatccactctacatttctaaaattttatctttttaggaacattatctaaatggaatcaaacagtatgtgatcttttggaattgctttttttcactcaacataattatctggagattcatccaggttgttccttgtattaatctttttttttaaattgctcaattgtattccatgacatggatataccacagtttgtttaaccattcacgctttgaatgatctgtacattgtttctagatgttgagtattatgaataaagctgcaataaacattggtatacatgtttttgtttgaacctaagtcttcatatctctgggataaatgcccagtgtgcaattgctggatcatatggtagttgcatgtttactttttaaagaaactgccaaactgttttcttgagtaaatgtagcattttacatacccaccagcaatgtataagtgatccagtttctctgcatcctcaccagcatttggtgttgtcactgtttttaaaaatttttattttgaaataattatagactcgaaagaagttgcaaaaataatacagagaggtcccatgtacccatcacctagtgtcccctaacgctaacgtcttatataattgtatatttcattatcaaaaccaggaaattgacattggcaaatacagttgtttagactacagaccttactcacatttcaccagtttttgcatgaattcattttttgtagctttatgcatctttaacacatttatgtttgtatagccaccatcacaagctacagaactcgtttgtcaccacaaaggaactcctttgagttacctttttcatttcttttttaaaaactgatatataatatttgtacatttttctgaggtacatatgatattttatatgcatagaatagtgtaatgatcaagtcagggtatttagggtatccatcaccttgagtaattatcacttcactatttttcatattagccattctgatatgtggtggtagcttattacggttttaatttgcatttccctgatggctaatgatgttgaacatcttttcatgtgcttatttttcttctatatatcttctttgatgagctgtcccttcatgtcttttgcccatgttctaattggatttttttaaaccgtcaagttttgagaatttttatatattatagatattagtcctttttcagatatgtggtttgcaagtatttcttctagcctatagcttggcttttcatcctctaaagagcctttttcagagcaaaagttttaaattttgataaggtgcaatatataaatatttccttttattgattgtgcttttggtgtcaaatctaagaactctctgcctagcactagatcccgaaggttttctcctacgctttttccaagttttataattttacattaaatttaagttcatgatccattctgagtccattttttaataaggcgtgaaactttggtttggttttttgtctctgagtgtctggttgcttcagctacatttgttgaaaaagttatctgtccttcctcctttgaatttcttttgcatctttgtcaaaaattagttgggcatatttatgtgggtctgtttctgggtttatttattttgtcccactgatctatatgtccatccccctgcctatactatataatcttgatttctgtagctaaataataagtcatgatatagagtagactgatgcttccaacttttgttctttttcaaaattgttttagctgttctagttttgttgccacattatgtaaattttacaatactcttgtctatatctacaaatatcttcctgagattttgataggaatttaattaaacctgtgtatcaatttgaggagaactgacatcttttctagattaagtcttccaatccatgaacacagtacgtctctctatttatttagatctttgattctgccattaggctttcagcatacaagtcctattaatattttattagatttacatctgagtgttctttttaaactatacatattttaattgatacatcatagttttacatatttatagggtatataatcatataaacacattgcgtagtgatcagatcaaggtaattagcatatccatcatctcaaacatttatcatttctttgtgttgggcgcatttattatcctccttttagttatttaaaactatatagtattgttgcccatagttatcctacaatgctgtagagtgtttattttttaagcgactatcaattgtatttattttttattttggtgcccacgtgttcagtgctaacatgcagacatacaaaagatttttgaatacttatcttgtatcctatgaccttgctgagctcacttattagttgtaagaggctttttatagattccctgaagtccttcacatagacaaacgtgtcatcaaataagaacacttacatgtcttcatttctgacttgtatgccttttatttctttttcttgctttattgcactgactagaactttagcagtatgtcgaacaagagtagtgagaatggacatccttgtcttggtcccagtcttagggggaaaccattcagtattttatcattagtataatgtcagctgtaggttttttaatagaagtctttaacaggttgaggaagtaaccttctaattcaatttttctgagagtttttaatcaagaatgaatgttaacttttgtcttatgctttttctgcaacaattagtctaatcatgtgatttttctcctttagtctgttaatgcgatagattaaactgatttttgaatattgaaccagacttgcgtccatggaatgaaccttacttggttgtggtgtataattctttctatatattgatgaattctatttgctaatattttgttaaggatttttttgtctgtaagtgatgttggtctgcagttttctttttttgtgttgtctttatctggtttggtatcagtgttacctctcttttgtattctggaagagattgtgtagaattggtgtgaattttccagtgaaatcatctgggcctggacgttttttcggagggatgggggttggggggaatttttaaactacagattgaattttcttaatagttatagagctatttaaattatctctttcagattgggcaacttgggtagttttttgtttttctgagatttgagtcatttcatctaagttgtcaaatttgtgtgtatagagctattcatagcatttttcccttattacctttttgatgcctgcagaatctgtagtgttatgccctgtttcattcctgatgttgacaatgtgtgtcctccatcttattttttgtgtgtcaatcttgcttgaggtttctcaattttcttattctttacaaataaccagttctttgttgcattgatttttaaaattgcttctgttttcaactttgttgatttctgttcttatctttatttccttacttccgctttatttgggtttattttgctcttctttttctaggttcttgaaggggcacttagatgaatgatttgaggctttctccctttcctaatttatgcatttagtgctacaagtttctctctcaacactaccttagctgtgtcccacgaattttgatattttgcaattttggttttcattcagttcaatactttttaaaaatatactttatttttaaaagcagttttaggttctcagccatattgagcagaaagcacagagaatttccatatattccctgactgcacagatgcatagctccccatactatcaacatcccacaccagagtggcccatttattacaattgataaacctgtgttgacatgtcattatcacccaaggtccaagaacataagggttcactcctggggttttatattctatgagtttgtacaaatgtataattacatatacctaccattatagtattatacagaataatttcattgccctaaacatcctctgtgctccacttattcatctctctctcccctgcccaatccctggcaaccactgatctttttactgtcaccatagatttgccttttctagaacgtcatatacttggaatcatatagtatgtagccatttcagatttgcttccttcacttagtaatatgcattttcatttcctccatgtcttttcatggcttgttaacttatttctttttaatactgattaatatttcatagtctgtatgtaccacagtttatccattcacctactgaagggcatgttggttgcttccaagttttagcccttatgaataaagctactataaacatatgtgtgcaggtctttgtgtagatttaagttttcagctctttagggtaaataccaaggaacatgattgctggtttgtatggtaagagtattttgttgttttgtaagaaactgccaaactgtgttccaaagtggccctaccatctttagctttcagaagtttagttatgatatgtcttggcatggatttcttttagcttattctgtttgcagttcattctgcttcttggtttatgtctttgctaaactgggggagttttcaggcattattttcttgagtactttttcagctctgctctttctcttctccttctgagactatgatgacataaatgttagatcttttgttatagtcccacagatttatccatactgagcttttttggttttcagtcttttctcccctatgttgttcagttgggtaatttctgttgttctgtcttcaaatttgttgggtttttttccttatttcttctagtctgttattgagcacatccactgagatttttatctcaattattatattttttagttctaaattttccatttggtttttctttatatcttcctcttctctgctgagactatttctttgctgaggctctgtctcacccaggctagagcggagtgcagtggtgtgatcatggctcactgcagcctcaacctcatggactcaagtgatcctcccatctcagcctcctgagtagctgcgactacaggcacatgttttgttttgcctggcttaatgttttgtattttttgtagagtcgggggtcagcctatgttacccaggctttaaacatgctcctaattgtttgttgaagcatttttttaaaaatcatggctgctttaaaatctttatcagataagtgtagaatctctgtcatcctggtgttgggttggcatttattgttttttttcattcagttcgggaagtccttgttcttcgtataataagcaaattacaattgaaacctggacatttttgtattatgttatgagactctgggtcttatttaagccttctgttttggttggttttctctgacatgcccccatcaggaaagaagcactgccttgttaatgtcaggtggagtggatgtcaagtcttcctacttaggctcttttttttttttttttttttaaattcttttatcttttttttttttttttttttttgagactgagtcactctgttgcccaggctggagtgaagtggtgcaatctcagctaactgcaacctccacctcccagattcaagtgattctcctgcctaagcctcctgagtagctgggactacaagtgcctgccagcatgcccagctaatttttgtatttttagtagaggtggggtttcaccacgttggccaggatggtctcgatctcttgacctcctgatctgcccgccctggcctcccaaagtgctgggattataggcatgagccaccgtgcccagcccccactttgcctcttttgacctgctgctgggcaggaagagagttcggcttctgtgtggtctctactgtactgcaatgggagtgttcattaccactggctgtgagtgaaagccctgacttcctgtgcctcctctgacaccacctcaatgggaaggggagcacctcattactgctggataggagtagaagtccaaggtggccatgtggtctccactgaccactgggagaagagggagctcattaccagctttcagggatgagcttcatatttggccacctttaacaccactccagcatgggtggtaggatgcctcattacaccctatgagggtggaattctaggtagccattaggttttctctggcatgagtaggtgtgtggcggaagggatgggggtgatattaggctatagtagagcagttttgtctgaaagatttctgtcttgctagactgccccttttctggtcctttggttacagagagtaggcttttattgggtctcttcgtctgcaactgtcggttttctcccatagccagcttctttacctccaagtctagggtctgtctaccaggcaaaaagaaaacccagggaaatcaccaccctattgttctttaggattcaaggtccctagctgatctgctttcttctttccatctttcacagtcttttgatgtttattttatatataatgtccaggattttcagttgtacttagtggcaaacaggaagacgtatgtctactccatcttcttggaggcagaagtcccctgatttttagacctacccaaattaagtattttaaggaagactagaattagaaagttgtcattttaaaggtttatttcaatattatgctaatgactgatgtaaaagtcaaattcagttagtgctttgaaaatcttaattgtccattgaaaagagaaaagataattcactgtgaaatcaagtctagatcagtagggcatcagtgacaactgtgatttaagcaaccttaatgagatgcattcataaactttggtcttaatatcaaaattttagcttcaagttcatgagtgtcctaacttaaatgtattttaaatctaatattctgtttgattagcaagcatgtttaacctgatagctttcactttgtttctcagttaaggaagcatccatttaagtaaacagaaatgtcttcttggggcaaacacaaaggaccttatatctggatttagcactcatggtgcgtagacagggcttgctggccagtgactagaagagtttgcttccagtctgggctaccctgaaagtaggtctttgggctctagaaacttgccccaagctgtacttaactgtagcatcccaggttggggaagaaccccgtttggcatggcagcactgggtgttcagaagggaccacaccacttcaagtttaattctgaagtaaatggctttttcccttttggtgatgttgagggtgtggattgagggggtacataaaagtgccagtgggttcaccaggctgttcagctaggagttggccatggtcaggaaatgctctggccataaatgagtctagatttaaatacagacacaaggccgggcgcggtggctcaatgcctgtaatcccagccctttgggaggccaaggcaggcagatcacgaggtcaagagattgagaccatcctggccaacatggtgaaaccccgtctctactaaaaatacaaaaatgagctgggcgtggtggcacgcactggtagtcccagctgctcgggaggctgaggcaggagaattgcttgaatccggaaggcggaggttgcagtgagctgagactgcgccactgcactctagcctggcgacagagcgagactctgtctcaaaaaataataataataataataataaataaatacagacagacacacgcacacacacaagtttcttcatttgctttgatggtaacctatggtgccaagggaagcagcatctagctattgaaaaagggagtgaagggattctcttgggtaatgttgaaagaattatatgtcttagaacttactttgcagatttgaaatcttgacttaccagacatttaaagttcagtattttaatgacctatctttctcttaaaaatccactacctttaaataattcttccctttaatttcttaacatatattttcctatatttaaaaaatggggatgcatattcagtgctttatttgaaataaaactaagcaaatacttgtctttatggctctgaaataatatcaaataatggagcaaagtctcaggaactgtttgtagcactgggttgggatgtggacatttttgtatttgagatcaggtctggaaacactggtggtatagtcctctgaaaccaggacctaataagcagtggcctttctggatgctagagattatgtaatcacctaagtaatagctcattttgattctgagtaactgcttctagttaaaaactgaaaagctttctttgtaattataatttatattaaggctatttgccaaaatgttttaaaatcctggtatttaaagcactttaaaaattgaagagaagcagcttaatatttgatgactgatgctgttcttacctttcaaaatcagtatttaagctttcagtgtttcaggctgtcttgaacagactgcactgccttgtcaacatggcttgaataaatgtagccttttagtaccaataagaattcatactgtactttaaactgtatgtaatctttctctctgtattctgatcaagatttagctcttatgcttagcctatcacacatttgttctaagtatctggctcccttatgtacaagtcagaaaccattgactttaattccaaagacttcagttagagtcatattttattttctctttttgaggatatagctgaacatattcatttttgttttagttagaattatacatttcatagcaatcgtgaaataagtataaaatttgagttgctattaattctaatgtatgagcacttattggtaagcgttagtttttatactctgtagtagaccttgtatcactacataggcctgtcttctgtccttgaatttttttaagtttaattttttattgactgggtgtggtggctcacacctgtaatcccagcactttaggaggctgaggtgggaggatcactggggcccaggagttagagaccagcctggaaaacatagtgggaccccatctgtacaaaaaataaaaataaattaacagggcgtggtggtgcacacctgtggtctcaccactttaggaggatgaggcggaggattgcttgagcctgggaggtggaggctgtagtgagccatcattgcacaactgcactccagcctgagtgacagagcaagaccgtgtctcattaaaaaaaaaattaaggtaaatttgcatactgtaaaaattactctttttcatgtaacccaggttaaaaagtttcaagagttttggcaaactcatacagctgtataaccactaccacaatcaagatagagagtatttccatcacccccaaaatattatctgtggtggtaccattttgactcccaccagcaatgtatgatacttctagttgatgtgcatccttgtcagcacttgatattgtcagtttttaaattttagccattatagtgggtatttagtggtatctcatcatagtttcattttgtgtttcctaaatctctgatgatgctgaacttctttttatgtgtttatttgctgtccaaataacttccttggtgaagtgttcaaactgctgccattttttaaaaactgaattgtttgagtgcttattattgtgggtttttaatgtaattctgtttacaagtactttgttgaatatgtgttttgcaaatgtttttcccagtctatggtttatatttttatcgtcttagtaatgtcttttttttttcagaaattcttattatgataaaatacatataacattaaatttagcagtggctcacacctgtaatcccagcactttgggaggctgaggcgggtggatcacgaggtcaggagttcaagaccagcctgactaacatggtgaaaccccgtctctactaaaaatacaaaaattagccaggtgtggtggtgcacgcctgtaatcccagctactcaggaggttgaggaaggagaatcgcttgaacccaggaggcaaaggttgcagtgaaccgagattgcgcctctgcactccatcctgggtgacacagtgagactctgtctcaaaaaaaaaaaaaaaaaattgatcgtcttaactacttttaagtatacaattcattagtattaagtacattcatattgctgtgcagctatcaccaccatccatctccagaactcttttcatattgcaaaaacgaaactattcattaaacaataactccccattccctccttgccctgacaaccaccattctgctttctgtctctgtgaatttgtctactccagctgcctcatataagtggaatcatacagtatttttttgtgataggcttacttcacttagcatactgccctcaaggttcatccatgttgtatcatgtgttagaattatcttcctttttaaggctgaatagtggtccattgtgtatgtatgccacctttgcctatccattcattggttgatggacacttgtgtcacttccatgttttcgtgattgtgaattatactcatatgaacacaggtgtttgagtctctgctttcagttctttggtatatatacagaagtagaattgctggatatggtcattctatttgtactgttttgagtaacttcctgtattagtctgttttgcattgctataaagaaacacattttatttggcttgtggttctgcgggcagtacaggcatggcaccgacatctgcttggcttctgctgtagcctcaggaagcttatagtcgtggcagaaggcaaagagggacggcaagagaggaagcaagagagagagcgaggaggtctcagactctctttaataatcagatctcctgataactcatttccatggggagggcaccattcatgagggatccgctcccatgacccaaacagctcccaccgggccccactgtcaacactgaggatcacatttcaacatgaaatgtggaggggacagacatccaaactatatcacctccatactgttttccacagcattcccaccaacagtgcacaggggtttcagtgtctccacatcctcatcacacttgttatcttctgtttttgtttgtttgtttgtttgttttttatagtagccattctcatgagtgtgaggtattaacagtgtcttttgaagatcagaaatttctaatttgatgaagtccagtttatcattttttttcttttctggatcatacttatggtgtcatacctgagaaatctttgtgaacccaaggttacaaagattttctcctgtgttttctctagaagcttttttgagggaggaaagggaggtttctattttggattagcttttggataaagtaaaaggcatggattaaagtttatttgcatacgtggatgtccagttgtttctgcatcatttattgaaaagaccatcctttcttcattgttttgcctttgaacctttattaaaaatcaatgactatatatatgtgtgggcctatttctggattctaatctctccttaaattttgatcgctttccttactgtgaagcagtgttaaacttaggatagtaccagctttccctcagaagtaaatttttggtcatgatttaaacagaagagaagatgaaagcgttggacaatctgtcagagcagatttattctacattttgcaattagggggactctgaaaggcaagatgtaggactttcttcactctttattttagtcacttacccaaacagattttgtatcgtgtatctttttttcaggtttaaaattggggctgagaatttcttctaatactgagtatacttatacagaaagttaatacaaaagcataagataagataaataagcatttgagtttaaactgtaattatgcaatagtataaaaatgatgactgtcttaatagggtgtctaagagaataagggagttgcatgtcactaaaacaaaaataaatgtactgaagccccagctctgcagagagggcctagggtcttgagggtgtgtgggacacctttctggccatccagaaaaaatctacagaaaacaaagaagtggttacactacccaaaacaaaagggaagagccaagctttttctctaagtggcttgagttctatcaccaccaggtaaataaatcaggtgaaactttcctaagagtgaagtcttcattcaggaagtataacccagttcatatagagatcacaattctgatggccaacaatttcaagacatcacttagaaaataatgtagagatggccagagtcccagagttggccaaagactggacaagtggctaacatccttttctacctatctgcctgtctcatcagggctctcattccagacaacctccaaggggctgctgaatgtaaatttctaaagcacagctctgaaatgttggattaaagatgtttctcagtgacccccaaaacatgagtttcacagcatgtaacccttcatagtctggccaaaggccaccttttgagcctcctatgcgggattctccttctgtgccacttgttgagcctaaacaccattttttcacttcactgtacactgtacatatactggttcctcttactgagatggcttttccctcatgtacctgataggtgcttagttttcctctgagatcccctcaagtgtcaccttctcttgacaccttcctgcagtgcttgtgcaggatgcagcaaatagagtataaggatgtgggcttggatttgaatcccagctatatcacttaagagttatgtgaactctgacaagttatttaatctctctgagccttgatttcatggtagtgaataccttatagggttaatatgaatattaaatattattttatgtatacatatatagtacaaagtatatgagcgtttaataaacattaattattattaatactatctcttatttattcagtaagcatttcttgagcaccaccgtgctattcagtcattccaagtgcttgggatgcatgtgtgaataagaccttgccgttgtatttgaggtatttaagcacagtgctttaagaaaaggatatatgcaaagtgccatggaagctatcatgtttttatgactacagtgtaccaagtaatattatatatatataaaaataagatatatatatatatatcttatttcatcttccaaaagccttaagatataggtattattttctcccttttacagctgaggaaacagtctcaaagaggttaagtaacttgcttgtgatgtagttatgcacctaacaaatagtagcgccaggaggcaaacctagtctgtctgactacaatgtaaaaatgaagcttagatagtatttggagactattacaagccctttcatagtatttggagactattacaagccctttcagatttacatcttgaaagatgtatttttccaaaagatgccacttttgcctctgtcatgggcagcatatttaacagaataaattctaagctcacccaagatgacagtccacatttccttataatgcacgttattttgttgtttatagaacaaattctgtttccttgaatctttttgttaacccttgactgtcttcataatcacttgtgtactacgaatcgtagaagtgagagaaagaatttgtagtaaaggtcaagaatccaatagcatttatctctgaaattctgggagaaatgataggcctcactcttaccacttacacactatatctaggtgtataactaaatacaaatggagttttgagatgtttttagaaggaaactgtgctaaggaggctcttaaagatgcttgaatctcattgtattggtcagagttcttagttgcaaaccagagaatccacttaaactactttagatagaaaggagtttgtcaaaagacgttagtggcttatggaccctctggtgtagcctaagagtcagatttggccatttcacagcaggaaaaatgctcagctacaccatggaactattctagtgaaatatactgcagcttacttgctcttgagggggaccaaaaaaaaaaaaaaaagaaagaaagaaatgtactgtggctcctacctgctcatgtttcagcttggaagaagcttcataagatgcttgctttaattaaacctggtgctcattttctaggaactattagaaataaaaagaggctagttcttataggccccttgattctctttaggtatatactcttttgagacctgtttagaagagatcatataaatacaaaatcctggccaggtgcagtggctcacacctgtaatcccagcactttaggaggctgaggcaggcagatcgcttgaggttaggagctcaagaccagcctggccaacatggtgaaatcctgtctctactaaaaatacaaaaattagctgggcctggtggtggctgcctgtaatcccagctactcgggaggctgaggcaggagaatcgcttaaatgcagcaggtggaagttgcagtgagccaagatcgcgccactgcactccagcctggatgacagtgcgagactccgtctcaaaaaaataaaaataaaaatcctagataaataaattgatacatgttcaaataatgaaattaaaaggaaaacactaacataacatctactaacatggctaaaactaaaaaatgtaatgttgaacaacaacaaaaaacaccaagttccataatacatacagcatggtaccatacatataaagtgtgaaaacgtgcaaaaaatagtttctatatagtgtatggatatatatgtgtgttgaaaaactgaaaaaaaaaatgtttacgcatggtgaataacaaatttataatagttatttttggagagagaggaaaggagggatagggatcaggaaggggtacacagggagtttctgttgtatctctaatgttttgctttttatgaactgttttcttgaaataaatataccaaaatgttaagatttgctagagctgggtagttcaatatataattgtgatatttattctctgtatgtttaatatttcataatgaaaaatattaggccgggcgtggtggctcacgcctgtagtcccaacactttgggaggcaaaggcaggtggatcacctgaggtcaggagtttgagaccagcctggccaacatggtgaaaccccttctctagtaaaaatacaaatattggctgggcacggtggctcacgcctgtaatcctagcactttgggaggccgaggcgggcggatcacgaggttaggagatcgagaccatcctggctaacatggtaaaaccccgtctctactaaaaatacaaaaaattagccaggtgtggtggctggtgcctatagtcccagctactcgggaggctgaggcaggagaatggcatgaacccaggagacagagcttgcagtgagctgagatcgcaccactgcactccagcctgggtgacagagcaagactctaactcaaaaaaaaaaaaaaaaaattcaaaaattagcaggatgcagtggtgcacacctgtaaacccagctacttaggaggctgaggcaggagaatcgcttgaacccaggaggcagaggttgcaatgagccgagattgagccactgcactctagcctgagtgacagaggaagactccgtctcaaaaaataataataataataatcctggactctagctgagtattaggataaaattttaaaaatattactgccttcacatacagatgaactcaaaagaagaggttaaaatgcagttattacatttagttggttctttcctccaataggagagtattcaggaagattgccaaaaaacttggtaattgagctttccaaagggggttcaggtgatcctcagtgacagttcaggctgtgccaggtatgcacactggagccacgtcagaccccagtcttaatatgtttctctaaggtgaccttccaaacagtgttctacgtgcttggtttggagccaagttggttttgtgtagtgctctagccacaaatggtttaacatgttctatttacaaacgtgtagccagatagtatgggtgtcatcaaaagaatgatttgccagttctaccttgttatcatgggaatttattttgggaataaagaaactgaatgtttagtcagggcctttatacaaagcaaagtgaaatcatattggaaagagaacaaagacatatgtgaaatggaatattaagaagagtcatcttaaaagaaatccagttggaccaagtgtttgaagacctgtggcatccccagcacagaagctccactaaggctttaaattgttgggatttccactcgggctggagcactggctcccccgtggtctaagctgccactatcactgtgtctttagtgtaggaatttttaacctggagtccacaggttcccaagtggtccacgaatagaattcagggagtccatgaacttagacaaatattacatcttaattttcattgacctctaactaaaacatggcatttttctcagttatgaaggtaggcaacaaaccactgtagtacttaacagtgctggtgactttatcatcatgttcaaaagaggttggcctgtgattttcctctctttaaacgtccttgtgaggtcttggtatcaaggttatgctggcctcaaacaggttgaggaattttattctctggcagaatttgtgaacaggtggtgttacttcttctttaaatacttagtagaatactttagtgaagccctttggggcctggaatttctttatgggagagttttcaaatgtagatttaatttacttaatagatacatgattgttcagatcttctctttcttcttgtatttgttttgacaagtttcttcttcctagatatttgcccgtttcatctcttttcaaaataatgagtgaaagttgctcaaaatatcctcttgtctttataatgtctgtagaatctataacagtgtcttctttttcattcttgatattagttaggtaaaaattgtaaacattaacaaaactcagggtccttaagggtttagggaaatggtcactattgataggagtccaagttatacaacttttctagaaaacagtgtatatcaaacataaaatgttagtatatttcatccaacaaccccttttaaggaatttgccataagtaaataatctcacagaaatattcaacacaggattacctataatagcaaaaaatattgaaaaaaatcaataggggacaaggaagtaattaaattcactagaatgccctcatgttataaaacatagcatattgacatggaaaagtgcaagggacatatcgttagttacaaaaagcaggttgcagaagagcatatacagtgtaggctcttctgtgttgaaacatatacatcaatataaatgaatatgtacatagagaatggtttggaaccatggttatcaaaattctaacagcagttatctatgagtggtaggatgttgggtagtagttattttctttttgctcttctgtattgtttaagatgtttgcatgagcatgcatcattcctacaaaaatagcaaaactttctaaagatcttagcagtttgcaagatgagagggtggtaggggaggagagtgtcaaagcatttttgttgcctcctgaggaacagtcagggaaggagagtttggagctgtaagaaagaaggggtaatcggctgagtaaagcccttagaaagataggagggcctgtactcagacacagaagttacccttaaagggacaggacaatatttctttccagaaaggaggaaaagatgattgaagatatggagaagttcagagctggagagaagggaaaattagagtgttcataagccacggcttctaatttcttggtgaaatcagaggtaagaccatttgccaggaggtgggggtgggaatcagagtagaacaggggtcttgaggaaagtgataagagtctccaatagaactgacagcaggaaagggatttgatggggtgtgggcagctgagttgatcagaggccttactggaactataagcccgcatttttagggagcccaacagagcatgattggtatggagttagagggtggcccagcaggcttcacagagcttcagaggatgagagaattcaggatactgataagggcaatttaaatgattggctttagaatccaaatccttgggagaagagtgaattagagatagtgccaaggactggataattaattaattagttggaatatgggtatccaagaggccaaaggataggagtttatggccaaagtggggtttcagagtttgacattttataggaattctgggcaacctggagtttaataggtagccatggaagtaaaggaacgatcatagaatgtgggtaggtcagagggttgtgttgctggaagtttcagtgttcttcctcatggatgagagcatttcccagggaggtgacaggaattcttttggagaagaagattttgaggcaggtagagattgtcttcaaggatggaaagaaagttgactcctcagggaaggcttgatgaagagacctagtagtgtcgtggtgtgagctactgtggggtagcaggaagtttgctgaccctctctcccaaggctgggaacctggaccctggcagaagtctctcttcgaggctgaagagcaaaaccaggtttgcagtaccagagactggcaggaaaaatgatctggaaacgaagaagaatgctctgcagaagcttcttagcaaagggacaaggggtctggggtacaggtgagcaggaaaaaagatgtgagaaagtaggttctgaagagagacagactagtgctaggaagggctgatctgcaaaggggtggagatttatatgcaggttttccaaaggaaatgccaaatggtatatttcttttaatcacaaagtagtgtctgcttactacagagagaactgaaactacagccaagcaaacagcaaaaacaagtaaacaaaagaagcgtaagaactacccacaatctcagggtcctggagcttttccagttgacatgttcctcccctccatttcccactgccacagcttcaggtcaaggccacaaaggccacattgcttttagaatgagcttgtgctctggttcccaagtgtctctaactgagcccccagggctgcctgaaccccacccttcacgtcctacttgggctgccaaagtcatcttcccaaaacatgacttttcctcagtcacttttcttattagattttatcatattccacatcccttccctggccctcaagggtgcctgtaacctagaaccatcttacctttccacccttgtttccaaaccttccgctttacttagacatgccttcccatttccctcccgacccacttccctcacagcctcacatctgggtctctgtcccctcactaggatgtctgccctatcacaatgaccagtcccatccagattatgccagttgtcgaggtcccataccctactttagcccatagtgatttttgcccttccagttactcatctgatcaccccttttaggatttacattagttctgttccagtaaaggcttaggtaggaagcacaggatgtagagctgagttgaacctattcccctgatcttactaatgaggtgcctgatattcagagagaccaagggacatccccaaagtcaaccagcaatccattagagctgagcctagtaccttgattctcagacatgaatgctacttgttgaattgaaaattgcattcataatacatctcttcatagattcctggccaggaagccccagagaccaaaacagtggttatcaatatttagaatatatcagatttacctggggagctttatcaaaatccacactcctaagcccaatagggggaaactctgatgtggtaggtttagggtaagacctgagtatttccaagaaaacctccctggatgatcctgacacagggagctttcagatcatcctttgagaaaatctgctttagagctcattctttggttcggctttctcttttgagctcactgatatcatccctgtggacactgaagcttttctgaagctttctcatctcaggaattggtttgggttactctacaatcagatttccatccaggatgtcacggcagtggctcagtactgcagcctgtgtaccttctcagccaaactggcctgggcccaagcttgggccaggttatttttcaaagtactcttgggcatactgtgacacaatattgagcatagtagaattcttgtgggaaacgctccgtttgtcaaggtgtttgtgagcaccttctgaagtgtggatgcctagcctctgtggcctgccaactgtctgcaccacaggttaaccaaacccaaactgtctgcacccaagtaaacccaatccaaacatgagccttgagcttgccaaaccccagcacatggagacctgggccaggattaggaggtagagaggcagtttgtatagtgatgagggcaaggctctggggcacactgcctgggtttgtatcccagttccacggtttctagctgtgtgacctttaacatgtttcctcatctataaaacaagaactcaaactataaaaataattatattctacaaaataaaaataattcctagctcccaggatggttataaggataacaaatctatgcatgtgaagcgcttaaaacagtgtttggcgcatagtaagtgttcaataagggcttgctattgttaaaattatttcttgaaaactggggtgaaatacttagactgcaaagagataactcagtatgcgtctgtgcagttatcagtctaaaagttatcaattatctcctggttgcatgcatgagcatagatccgaagaatgacaagcgatatagtaatagctcctccaaatgctgcctggacctctgaagacaatttaaaaatgctaggtatttcccagcaataaggtcaagccttgcataatttaagaaatatacagcaattccacattttggtgctttgataaggtggcagttacataacaggctgcaaccacgcagatgagcagagccaaaggtgggggagagggtgttctgaaaagatgtgtgagtgttggagtgaaggctgtgcgagatgaaagacatggcagcagttacagtcttcataaagtttgggtctgaaggatccacgcatgccctgtgacattataaatggcctgacagcaggaaaaacatctcctgacatttactgtcaggctaacaccaatgggaggaatgaaagtttgccttatatttgtcatattaccaatgttttcttattccttgataatgtttttaagctaaaagtaagattgcatcagtctctaaggtgacacaaagctgaatttgtctctagaatttatatgttttatcaaacttttgcaaaagactcaacttagagtgttgccaaagcatcaccttcctgtatcacgttgccaagttaacttttcttgatgctccgacttagtggtgccattctccaaattccaagtacaggagagccctagaagggtgtcagaaagcaggttgcagtagcttacttctgtttttgggtaggagatgctggtccgtgagcactcagcaagtgatcctgtgtgctaaccactaaaatacttagaccaccctgtttgagttgtatgatatctctttaaaagggaactgactggtttacatagattgcgtagtatttatcataacataatgctcagacttttagagaccagaaagccagtttgtttgggggaccatctttaggcctagcatcatcctcatctcctagaagtggccagaatagcttggttgttgcccaacctttttggatatgatgctgtagctgggggcctttagatccaggggtaaggagagtgctaaagggcactgccaccagccagggcaggctgaaagctttggctctgcctcagcacttgttagcctaccattttccttagcaagaagctgctgtggaatgagttcctgggagtggatgaggcccaggtaagccttgttggattgaaatgtataatcttacctctgggtcttttaaaataaatcaaattttaatatttacaaatgataacagaatttggaatgaagattttctttttattgctgcctgtccaagcaccatgggagatcagaatgttagcttgatggctgagtagcaggcagtaagcagggaggccttagctagctgtaacttttatttattcatgtactccctcctcaatacaggacgtggaccacactgtgccgtagagggaggacgttgacataacacgatctgacctcaagcccttatatataaggcattaatttggatatcaaactgtttgaaattttttgtaataaagttttttaaaacttagcacatttgaggataagaaggagatcttggaaaataaaaatatcactaactaaacaattataaaatgtaatagaagggctagaaaatgaaatcggcggtttccaaaaggtagaatgaaaagatgaagagacagaaaataggggagaaacaacaaataaaactttaaatggcacatccaggaggttcaatatctggctaataggagttccaggagaacacagaaaagagagaaaaggaaattatcaaagaaataatgtgagagaattttcagaactgaaggtcaagacactctattttgaaagatgttttcaatctagaggccaatacaatgaatggaaaaaattagccacacctaggcacattataatcgacatcccaaatgccagaaataatcataaaagcttttggagggggaaaacttgtcccaaacaaactgatgaaaatctgaatgctatcaggtttttaaacatcaatactgaaagctagaagacagaataaagtcagtaaaatttggagggtaagttattttccgtttagaattttatatacagttgaactttcaatcaagtgtaaagacagaacaaagacatttaaaaatctgcaaggactgaaaattttgcttcctgcggatttttttctaggaaacaaccagaataagtacttcatcaaaatgaggaaataaataaaaaacagagaaacagaacccaggagccagaaaaccaacacaggaaaacagccatgagaagcccagtggtgtaggcccagctacttgggaattcccaaatgatctgatataaccgaccatttggaaaatcacacatgtgcggatgcatgcacactcaacgtatgcgcgcacacccacacagagttaaggcaggatatttggaaaaatttgaatatagatgcatagaatattaagcaaatgaaataaagagggaatgttaactgtaagggagttgtacaagggaaaataaaacaaaacttagctttttaatgaacagttcttacaatatgtaagggaagggaaaatgtggtggtgcaaaagagctaaaatgtaaacagttaaacaggaaattaatagttgaaggataaaatagagaaatcaagaaatgacaatattagtatatttggttaaaaaaagctaaaagctttgaaagtgtttgcctcaaagtagtgggttttaaaattttttttcagcaatttgatttaaaccatgtgattttgtttgttttgataaaaaagtaaaagttaaaagtttgactgtgaatagaaaactcaaaccagtatcatccaagaagcttttgccaccacaggcgtcgccagcatggtgggtagagcacagagtctccatcagatccaggctccgtgctctgaggctcctcctcacaggatgtcctccctgtctgttggcaggtaactgggctatctcctgccagagccataccaagtttcagatgaggttataaggctgagcgggagtgtatacctaataacaggaagggaggaaagaggaaggaaggagaaaatttccttcatagatggatttagaaaacggttttgccaccttgttattgagacaactccaaggaaattctatctgaaatccactcaccagcggaatatggcatcaaatgacaattctacttcactgtctgaagcttgcctagtatgacacaagagtatatctctaggccagccccaggggtagagttaaccagtgggcacactaggctctcccatgcctaccctgttccatgctggggttaggatatggttctaggctgacttgatccagtaatcagtctagagaacagagaatgaaccagatttccttccatccctacccgttacccagggagtgacctttccatacatcaccaccgctgacctacagtaccttatatatctgggatctaccccaaaccagattaatccatgtctgggctcactgtgtgtctggttataattggaccacccagaccacagtgatattcaagcagccattcacttctctgtaccctacttctgttgaccagcactggctgaaagcagtggttgtgaaggaaagggcccttctactcctacgcacaggtgtgcagggcaccaggccagctgcaagcgaggacacagctgtttgtggagactgtgtgcattaaaacccagactgtcctcttttactgcaggcttagagtgccgttttatagtggaaactgttgtactgaattcctagtagggaaggacccatttgcacttaaaattagttttcatttaacctgttaatggaagcattttttaaaaagaatatctttcatttttcagatagtgagtcactttcttaaaatgtgtttgtttgtttattatagaagcagtacatgcttgtaacaggttgaaacaataaaaaatttttaaaaaaggattgccatccctcaccctaattctatccatagagaataaggatgatgtactggtccatagagaataaggatggtgtacgtgtatatctgtctgtacagctttgtacaacatatatatgtgtgtgtacatacatgtacatacatgtacacacatatatatgtgcttatgtactttacaacagctataacaatacatatataatcatttaataaaaatgagatcaatacaacttttgtttctgttgacatacattgtaaacatcttttaatatcagaacctacagatcggccacattttcaggaatattctttatatggatgcaccttaattcatctatgcatctccctactgatgaacacttaggttccccagacttttgataattagtatcagtgctgcattaacacctttaactctgaagtcagacagagttagttcaggttctagatactcaattacttactttagcaagttatttaaactctctgtgcctcaatttcctgatttgttaaatgggaataaaattgttctcacagtgttcctattaaaaaaggctaaatgaaggaatacatataaaggcacctaacattataataatgatagctaacatttattgactacttactatcagccaggtactgtgtgtaaacaaataccaactgttttatgctttagtcttataacatatttttttaatacctgtaaaggcatcatcaccattaaaatggcattagctatttctatgcatttactcctccaataaattttaaaatcaactttccacctacctctcatcaatatgacaagtttttttttttaatccagttggaattctaaagggtatctccacttctgaaggttgccagagtagaaagacccttaagcttgagtcagagagaactgagtgttcttatggtgtccctccaaagccacgtgaccataagcagttcatttaaactctctgagcaattgcactttccctacctgtaaatgggagggtcaatccttacagaagtgggggggatagtataagaaagctggaacgatgtctgacaataaatacttaataagtgtgcttgcttctgaggcaagtgtttttaatttatcttctggtcctttgtcttcagcaccattttcagtggcagctctaaggtgatctttagggaaaagagtttgagagtgagagcagcggtgaacatgcaggatgaagtttaaggcccccacttcctctgcaaggcaagctgaacatttacaaccagtgaagattagccaagagggaggaaagggaattgggacaaacatagactgttccattgtgcaggcatgtgccaccaaccgtggagtggacttcctgctgcaggacacagctgacctttggagagtcactgtctgagtgaggctgccctttagcaggacagaacacagctgttgtttggatgtcagaggctagttaataactgtgtttggcaatcagcttgggatgttaacagcttctaggtttaaggaaggccagaagaatagtatgaaggaaatctttgtgttaccaacaggttctttggtaatctttctttgaacaaaaattaacacttcacagcagctttaaaaagtattaagagaactcataaaagtcagagcagatgtgctggagatcacacttccagagctctctggggaactatttctggactaacaagtccaacaaatgtgttaattcaggttgagatttctaatgcaaatattgactcaatctcaacctttgcagttaattctccaactcgaatgtgtcctttcaggataccttgcctgttttctttctttatgcctaatcatttgcctacccttcattttgaaggtggttagcaggtggttgtttagtggtcagttctacattctttctctaggtctcgataatgtttagaggaataagtataaatattccttgattttcttagtggtataattgcggaaaaggaggaagaagagatagccagggcggtatagaccagtataaatgattctcagtcttagagcagattacagaaaagtaacttcttgcacactattcagtattaaagaaaaaatgggtgacagattgttttgttgatttttccccccagcccacatgatatttttaattactcttaatttttaaatgtgttttgaagtttgtatgaattggtatgcaaactgctacgtggctaaccattagtataaaataaaaagttttgactaaaagataatgtaaaggtaatgtaaacttaatgtaaagttcaccttcatacttgaaggatattttcactggatatagaattctgggatgaagttctgttttgttttaagagaaaagatctcacggtgtcacccaggctggagtatatagtagcacaatcgtagctcactgcagccttgaactcctgggctcaagtgattcacctgcctcagcctctcgagtagctcggactacaggcacacaccaccttatccagctaactttaaaaaaagttattttttttttttgtagagacgagagtctcgctagagtctcgctatattgcccaggccgatctcaaactcttagcctcaagcaattctcccacctccgcctcccaaagcactgggattacaggcgtgaaccaccaggcccagccaagtttttttttccaaatgctgttataacgatctcctggcatccttggtttctgattcaaagtgagtggtcactggaattattgttacttttatgtaatgtataattttcctttggctactttcaagattttctactctttatctttggctttctttatgtttatcttgcttagactttattgaacttcttaaatctgtaaatttaaagactttgcagccattaaaaaaatatgttttttctgtcccattctctctctctttgccttctgggactatggttaaacctatggtagacctttcaatgttgtcctacaggtctgaggctctgttcatttattttcaatcttttttcctttctgttcttcagattggataatttctatgaatctatcttcaagttcactgaccttttctgttatcactattctgttaagctcatccagtgatttttaaaatttttcacatattatattttaaattctagaactttcagttggttctctcttatactttctctgccaaggtttcctatatatttcatatattgctttatgccattgagcacaattataatagctattttaaaaaatcttatctgctaattgcaccgtctaggttatcttggattctctattgactgtcttttttcttgaggatgggttgcattttcctatttatttgtatgttaaataattttggattgtattttggacattgtgcatattacattgtggagactctggattctattatattcctctgtacaggttttccgggaagtgaggggtcgttgtttattattgtttcttttgttttttgccattgccaacattcagcttggttgagctaaaaccacaaactctgtctctgaatcgaggcactacctcaattctcggcttagttattttatccttagctaggttgcttagcgtctgccccatgcatgcatagttcagtggtcagccaaagatttgggcagtttttacatagaatttggggctctccctttctggctctgtactttctggattctcccctttcactttgtagtggctgtgattgtcccaaagtctgtcacccaagcactacatgctgtctattggagttttagccatgcagcatggcactggtggcagcctgacaccaggctgaaagccataaaactgaaaaacatatctagatctttttccattttccaagtgtcattctccccgctctgaaatctgcttactgtctatctttttacagtgcttccaggtagttattttttatattttgttaatagtttatagttttctccaggagaatcagtctaggatggaaaacctagtctatggtagaggaaaaataatcaaaacagtagtttcctatagagaagtaagagtttttacccaggtatatatatttgtcaagactcagtgaatgtacacttaagatttgggcacttcactgaatgtaaatttcacctcaaaaaaaactaatagtgaactgtagttaatgacaggcgtatgtttgaacatttacaaaataaaatattgagaagaaaaagtgaagtaaaattgtactttttgattccatgtacacagaattcctgaaatgcagttggttgaggcttcattgggatctgcttttataaacagacaagaaaaatgtgttatgaacacatttgttctcagtttcttgagcgctcctataaacaaagggctgtggaataatcaatcagtaagaatcagatgttttccctgccttctggaaacttgcagcctaacgaaggatatgatacaaacatacaaatgattgaatgcagaatttgatacatcctctaagagaggtacagacgtgctggggtgttgttcagtagaataagcgcatattaggtttgaggagccacggaggctgcatgaaagaggggtatcttaaaacagcaggacagagggcatcaccaagggggcggaaggatatccaaggtgcaggagtctgtgtagatgtttagagtgatgtgaaaaagagctagaaaggtaggaccagggccttgaaaaccaattttgggttttattcaatagataggtaggagacatcatgtctttcagtgaggtgggaagtgaatgctttaacattgtgttattttgttatttttaattgtttttgagacagagtcttgctttgttgcccaggctggagtgcagtggtgtgatcacagcttactgtaactttgacctcccgggctcaagggttcttcccacctcagcaccccctgagtagctggaactacagtcacataccaccacacctagctaattttaaaatttcctgtagaggcagagcctcactttgtttcccaggctggtcttgaactcctgggctcaagcaatcctcccacctcgacctccccaagtgttgggattacaggcgtgagtcaccatgcctggccaacattcagttattcgtgtgatacttagaaatgcaggactttcaggtgggaccctgccccctcagcctcctctccccttcactgtgaggctttatttcagacacatcctcttggtagagggcccaggctggcactttaatttgaaggagttagactagaggctctccacagttctttcagctcagcattctatgatctgatggctgcttgaaagagttgtttcttgcacagattaaatatttcctcttgcagtattattttgctctgttagccaactcttcttcataaagtctggattgtactgtaagatatacagtaatacagattcgatattcagagtgtcagaactcatgagctgttgctgtgtggtgatgttgtttttcacagctgtaacattttaagctattgaactttcacgttatgaaaaaaatgactgtgctgttaagctagatgggggctatagggggaagcttaccaagtttctcatgaagacctagtagttctgcacatgtcgcaggtaagtctggataatcccaatttattttacttattgatttttttcccaatttaaaatgatactcttcacagaatgcttacgtcattctgctaatttccaaatgcaagtaggatgttaaaattttatgggacagtataatttcatttcttgaaaagaaaatctcttactgtatgagtttttagccatctttctattatctctgatgtagtaagtgtgttaatctttgtctcagaaataaaaatcccaaacaatgtattgaaccattgggtgagcggtgaaaagttaacttttcatctctaaacatccaggcctagatggacatctgcttgtgtgaagagtgaaggcaggatgctggaaaattgttattttcagaccactagggtcaagcatcagaagtgagaaaggactgataagctgaaaaagttgtacgatatgggaatgcaaactttttgtgagaaaaacagaaagaaaagtagcacagagcactgccattagtaagtttgccattgccgttgtgtgtgataactggcttagacttagttccggaaatccaagtgtgattatttttggagtgccggttatacactagagagctctgtcatagagaaaatgtgtttatcttttattcacttttcatcttattagggagaaaccatgccctgacctcataaaaagcatttgaacacaaagccacaactcttcaagtgcctcgtatatttgtcatctgagaactgggcaaagatggtcaatattcacatttattgccggaatgagtccagagtaatttcagaagcaccagggtgttttacaaagaaggtcttctgtcagggaaccccagaatgaaagatctcagatcagagctgcttcaaagaggtaaggatgtacccctaggcccaggccccagtgagaggagaaaggtacttcttcgtgttagctggaaaatgaagagtgctgcatcagagactttcttccattttaagaatactgtactgaaatgtatgctttctggctgttagcagacagcatgtttaaaagccacatatcatgtccaaataatagcaatattaggttggaccacgttaagttgctgttttgcaggtaaagagagttcaaatattagcaatatcacatggtttaacctagcaatagtaataataatattactagtgccatctattgagtgcttactacgagccccgtgccaagagctttacacacatgatctcatgtattccatttataaaatgttttttgttgcttgcttgactcacattctatttggtcactcagcagatatttactgaggacctgctaatgtgccaagtaacatacaacaatgatatacaacagagttcttgccctcatatgctttactatgtagtgaggagggcaggcaatcacaagtgaaccaaaaaattaattaattacagattatgtaggtctaggaaagctataaatagagaactgtgatagaaaatatcagggtgggcctagttttatgtgtggtcagagaagcctcatatcttatggggagagataccattaaggagcattctaggcaaagaaaacagcaggtgccaaagccctgcaacaggaaaatgcttggcatgatccaggagtcaacaggatcccagtgagtgaatgaggaggaaagaaacttgagataaacttggaaaagtaagcaggatcaggtcatatatggagagccataccagcccttctgttttggaaaaatagagtttgcaatgtctgtgggacttccagggagaagtgctaagtaggcagtgataccctgggctggaacccagaagagcagtcttggctggagatgtaaacttgagacctacaagcatatagatgatatttaaactcatgggaatggaggagctcacctagggagagagactaaacattcctgaggaatgccatcttttaaattgtaaagtgacttttcatgccttcagtaactagcccatcctaaagccagagatcataggaaatctattcctgtgggccaaggggccatgctgcagtctgtagcacataaccactcttacccaccacaagggtctggttcaaggaaagccccatgtgcaggagctgccaactcatagcctgaattacgaccatcctgtgggcagaggcaaaaaacaggagccaatcaggctgcttcctctagagtttggcgttgagaaactgagagactgatgatgtggtggcaagtgagaattctgagcttagaaagtcagaagacacgctcaaactgaaggcatgaggatcagagaagatagcagagaagaaagtgaggaggccaggacattgcagatgctctcaaaaaagcaaggactcagagggagccttgagtcccaaagactcttcaattgcattcacaggctatgtaggcagttgcaatggagtattgcaaagtaggtgtagttgttaaaagaatgggctctgtaattatactttttgaactccttagctttgctgcttatctctaaataaccttagatgaattagttaacttctctgggtctcagtttcctcatctgtaaaatggagataataatggtacctacaagattatacttgttaaaagcttggatcagtggggagaccatgaagtaggtcatgtcattccattttccctgtgagaagactgagactctgagaggttaaacaacttgcctggggcctttaatcacaatgaaatattgcctcccatgaaaatgagaatttttgttgcctttgagctttatcactgaattacaccttgggttagaaccaaggaaggaagttcatgtcatcgtcaccattcttgagaggaaggcttgagtgtgagcggggagggaatggagctggagatagtgtagctgaggatgttacacatctactcaaattgtgaaaattgtttggccggacataaggcaatagaattaggctgagggaatatctaatacgaaacatgtatacaacccctgaactgacattattcacaactagaactagcaattcttcaaatcagctttcaagttttaggataatatttataggagttagtaagggtcacattttgacagtgaagaaaatgtttggcttctattgatacaaagatttgaagaaagaaagggaaagtgtgacaggttgtgatattgtttgaaaaacttatttataaggacttatggttattaaaggaactgtagaaatcttatgaaatatagaaaacgataaagataagtcatccataatattgttaaccatcattggctttttaagagctttcttgccttttaatttcttatatatgtatatggataaatatcatgaggagaccatggaacctatctcacatatatagcttaatatgccagctgttttttaaggtaccatgagaatttttacatgtcattaaaagtccttagagaacataatacttatttttattattattattatttttttagacgaagtctcgctctgttgcccaggctggagtgcagtggcacaatctcggcttactgcaacctccgtctcccaattcaagcaattctcctgcctcagtctctctagtagccaggattacaggcacatatcaccacgccggctaatttttgtatttatagtagagacggggtttcaccatgttggccaggctggtctcaaactcctgacctcaggtgatctgcctgcctcagcctcccaaagtgctgggattacaggtgtgagccaccacgtacagcctgagaacatcatatttaatgactacagaatattagtaatcattagtagtctgggcaggaagagaaatgtgtgagtttgccagagtgcctgatgctcccagctggacctgctcagcccccatctcagggcctctgcctttctgtgtatgctccaaagggacctgggtccaggtcaagaacaggaagggagaactcagatccactgatcatgccagggttcactctggcctctgtgtctgtgctgttcttcccagggggacaggcagctctctgggaatggtagtccatctcattacacaacccctctgctcccagtcactccataaaccaaaaaacctagcccttcctcattctcccttcctcagaaacagagacacctctttgtgagttcccaaattttctctattgtctaaggcactaaaacagatgagcaattagtggcttagacctaataatagtaatacttgacctaaataacaatggctcatatttattgtgcatttactatgatatgtcatgtgctttacctgcagcatcttgttactttgcagacctcttgctttgagagcaggaggtggtaccatccaatggaaatatgcagagaaggctctagagttgaacagaccttggttagatctgcagctctgccatttaccagcaactctgtgacttaggcaggtgtatgcaaccagaaaggtattgagctacacaaaaatcagaaaacccaaccacaagtagcttaaatatgtaggtagttatctttctgacatagtgagaattctggatggaatcagtccaggctgatatggtgacatcagggactcatctcttatcttcctgcctatactatccttggtatgtggctttcatcttcgtggttgcgagatggctgctgcattctgaggcctctcctctgaggggtccaagcaggaggaaaaagtagagaaggaggaaggagcaattcctatttcagaagagcaaatgctgttcttgaaactctcagcttatatgtcaggccaggactatgtctcatcgtcacctatctgtaagccagggaaaagctttaggtgggcacattgccatccctaaggaatcagagttctattaggaagggagaagagtgcgtgtttgatgggtcagtggccatcagtgtctatgccagcaagtcattgcatttctttgaagctcagtttcctctggtaataatatctccctattctagtcaggctctttcaacctgcaagaggttacctagtttgccccaggggatgggagctccttgtgaagatctctaaggacatagggaaacttggtatgggtcacagcaacaaatagtccgttttccatgggtctctgtacttcccagcaggcctgtgggcacctcattgttcaggatgtgccaggagtcttcctaggtacctcccatcatgccatcattttagaattgggcatccatggctcccctccctagggattcctccagatgtggaaagctaatctctttgcccgcttcttcctcttgtttctccttctctgtctgtattctcaccccaactgctgtctctgctgcttctgctgcatctcacattcaaaccccccacaaggaggcaacatcttgggtgggtcagtggcctcccactgaacaacactgcagttagacagagtcttacaccagcctgccccaggggtcaccggtcacccgttaactacaggacacattgtggctgctttcctcaacacaggcctgtggctgtggcaagtgctcactggatcccacatcctctccaatacgttactcagagagtttcagatgcacagtattgcacaactctagggggcaacatctacagtgaaaggtatgtgagctgtgctccaagaaacaccgttctgaagttgaataacatggtggtgctggtcccaggtgggcttcagttgtttgagactgtttgaggctctttgagatggtggtgggcttctcattatctggcagctagagagccaagcacaggccttggcctactggtatactaagccaagggtaagggcacagtggagagtatgcgttctatgaaaagatggaggagaggacttgggaaggggcagccggtccgattgctggaattcctgaggcagactttgttgttagaaaaggaggctgctgttagctacacctctcattcctagctagtaagaggtgaaggacagttgtcaggacaaatgagggaatatgtatgcacatactttgaaacagcgatccatttgagaggccttcttgttgctgttattacagctgctgctgcagcaaaacagctttgaaccctgaggtatgaggctgattttggaagctggggcagggggtgggagagattctggtaacacaggatgtgtgaacttatgttcattgaccaggacctgagcaggactgatgaataagggtcttctgtctcctcagtagtggctttaggttattgtgtaattcttgggaccttagggtcaaacaaggatgtccttgctatcacaagggttatcacaaacatgtccaggcagacagtcagcaaaggatgtaccgcacctgccacacccctgccagactcctctcaatttgagctgtgaggtgacttcatagtaacaggcacaagctcagagcttcttggggacaaaagcccaggagtccctcttcttgtccaccttgcatttctactcttccccagagaagctacaatgggtcaagcgactaccactgtcaggacagggttcctgccaagtccatgtgcagttgcttctggctggtaccaggtcaccaggccagcctttactgccgctgccaccaggttactgacttattcaagcagttcatgcagtggctattacagtgtaagcagaaaataaccaagatggcactcccctcctcacaggatccctgctgcacactcttgtggcttcaggacttctccttcaacctgtccaaggctggaaggcaggatagtaaatcgtaacatgaagaattctataggataaagttggctctgtgggctggctgcctgtcagactgccagcagaacagagcagcctttcactgaaactttgaacttaattatgtgacatttgcacctgaagcagagaagcaagccagattgctgagaagagccaagctggttagggttcttttcttggctatttagcaccagttccctttgaggaagggtctgcacttggccccttcttaggcatccaggagaaggaggagtggggcactctatcaggcattgaggaaaggacccgcccagtggatggaagaccctagggtactgatctcacctgagatgagaaagaacttcacagtgtgaagagctgtacaagggagaactggctcaccaggaggtggtgacccattggatgataaatgggggcacctgtcaagggcaagaggtccccttcctactccctggctagagaactagcccaccccgggctcccaaagatcagtatctgtgagtgccagactgagactagaccctgggaatggcatagctcaccagagccttggtgttcagcctgtggctctctgctcagccccctttttatagagaaaacgtatgagtggccaggagtccctttcttcccacatggccaggatatatctccctgttgcatcagacagacctgatccaaatctctgctacttccttctctgatctgggaaagtcattttgctgcccatccttgcctcttaaatgcaatattacagcagcctcctaactggatttcctgcctctaggtctcctcatcatcaccctgtccatctttccaagtaactagccaaaacatgactcagtctaatcactcctctggaagccttcagtgcctcctcactgcctacaagaaacagaaggtgggagaaccttcctttgtgatttgaccccccgctgcctctccgagtcttgttacactttgtactgcccacagcttcaaacacggggactcagaaaacatttaaagatggaatgaatgaatataaaaagtaaaaagctgagcaaaaatgctctagtgtttttaattttgtagttacagagctatcatgctaatatctacataagattaatcattggtagtgttttcacagtttccctgatacaagcctgttatccaaagaattgggaagcctgccttacttcataaagggggcaaggtttatagaatatataaaggaaattaagagtcaaataacgttttgatctttgattttgaatttgtctcagataatgcctacaaaaaggatctcaatgattcattctttttttagccagccagttctccagtcaagttttaaaagacttggaagaacatgtgatttttaaaatatcctggagtttttttccaggcctgggcaactcgtgggtcaatgcacagctatttctgtatgtaagtaggctgggagaatactctgtcagttcacaaaggccaggggcctgactgcctgagctaggcttccttccccccctccctccttgtgccacagctgggcactgcagaagtgcagacatgttctccagacctacttgtgtttgcatacctatacctgctgcaaggtgttttattctgagttgtggtttctttagattgtgagaaccttggctcccatgtccaaggtgtaacacacaggtctgaacaacataggctttgggaactgtaccatggagaagtagctttggaatacaccatttataaaagagaaataaacaaattccagctgatttgaaagcctgatatttttccaggttttagtcatgcttataggagaagatactctcaaatccaatgaagaggagagaagagtatggactggcacccagggattgagttctcagctcagctctgcaaatcgcccattgatttttctgggccaggcctttcccctgcagaggcgcagtacctttcaagtcaggagggttgggttagttagttcttgtgccggatgttttctgtttgccctccacatctactctctgtcctaccctgtgccctggaagccgaccagtggggactctatgaatgggcttctttgcttcctggcccctattgtgtgctttgcccagtggggagcactaacaggagatcggaggaagtattgatttctcctggctccaccctgtggcatcaccaaaggtctgggctcctggcaggcagccttctccacagggcgctctgtctcaggggtccagcagcctctccttcctcacccttttgggcctaggcatgtaaatgtgcgactgttactggtcccagaccactgcacttcggtccgttctataaatgcttcccttattaaagtctcctcagattactcattttgagagtgccatctgtttcctgccagaaccctgctggataaagttcctaagatcttttccagctctgaaaaaagatgaccacaagcagggaggagccagccctttggagctcctgtttttcactggtgcctccctgaatggttccccaaggtcatgggaaggaggaactggtagcagtatgatctccagggcacagagtcccttaggacaagagccactgatgccctggtagacacagactgttaggaacctgattcccaaagagtgtaaagtgtgctgctgtgctgcccactctagtagtggggagagggtaagggacaatcccaccaactgaggctggactgtcactgccactcctttctgcctttgtgactaagaaagtcacttcgccctctgagcctttccttccctcctaaaccaaagctgagaatacccactctggcccacacacagtggttatgaggtacaaacgaaggcgtctgtgttcaaactgctttgttgaatgtaaaatgcaggactaaagagagttacagtcataaacagcttttattgtggtaggggtcacagctagggcacagagcccagtagggacattacccctgctcctgtccctgccaaaaacccccacttccttttgttctttcctggtatgtgcacttgctgagacatatatggctcttcgagtgtcaattttaggatcaaagcatgacctaagtgataccaaattacaaaatcatgccatcaaactgcagcagccgccttctgacatctctggaatttagattctgaccttgagggtcttaggtggccatttatggccttctaaaagcagctgcttcaaaataggtctaagggaggagaatgaaggaaattaagggcatttttaaacctatacattcttaattattaaagttatcacagagacttcttgaaatacatgaaaaatacattcttgaaaactacaaatgtcaagtgcaattttctctctaaggaaaaaattaagagacttaaagaacttgagtcttgttcatttgacactgttgatattgttcacccatatgcatatagagcacatgtgcaggatgagtggaggaggtgaaggagaaaggatgaaagagtgacaggctgggagaggacagagcattaaatgccctgggtgggggtgtaccacagtgtatttatcacacagcagttaggaactgtacgtgtatcagtgtgggggaatgttaagaacgtagagcttagtggaaaaaataagaatgagatgcacagactaatatttctataagttaaaaataagtgctcagaaaagtacaatgcacatttttctagcactcctgtaaacacaaagatatactttaagcatgttagaaagtttgcctgtgggttgaggggagtggaggtgggctgtgaggataaagggaaataaaaaagcatgtatacatacagcgcatttgcctagatacggctagtggtgtgccaggaactatcacacatggtaaatgcgaccctatgctcctgagatgcaaaacaaacagaaagtctgcagggttttgtttttaagaagtctgaaagcttctacagttcagtttgcatgggcttccccataaccctcagtgtagcagctaaaccacaagtggttaatggaacaaaagtaccctttgtagggtcagaacagaaacacagcacaaacgctgcctagaaaccacatgaaagaagggatgctgtgagccgcccttcaggctcacttttggaaactcaccacctggtagcccccgccaagtgggcgaatgtccatcacagcaggcaagagtattccaaatgtgtttctgtttttaaaaaatctcctaatagaaagtggaaggtatggcaaatgcatgttaagcctgtaagaagagactgcatacagtattttgattgatataccctctataacattttaatatctttatctcaattattctttcctaatgttgcagttaactgtattttttcattttgctacgtagactctgtcatcattatttttaatggctgggtaatattttattgactaaatgtaccaacatttattagccattccctctttgtatgacatttaggctgctttctgcttatgccacttataagcagtgcagagaggaaggtatctatgctgcatgtatagcttcttcatattttaaattaatccctgacgatagacaggaaattgaattactgggtaaaggagtgtacaaacacatctatgactcttggtgcaaattactaaattgctttccagaaggatagtaacaatttacacttccactagcagtgtgttcttggaccggcattgtgttctataagttcttaattgccaatttaagagccagtgtacattgtttttatttttgcatttctttgattaatagtgaggttgaaaattgtccaagtttgttagagattggtatttctgttcatattgctgttggagtggtcttgggttattcttttccgtatatatgtagcctttactcaatatcgatatttagtctttgtcgtaattactacaactattttgttttcccttttagaattcgaaattttacataaagtgtttttctttaaataaaccgataccaattaattggtctttctctttattttgttgggctaaataaaaatgaagatacccttttggctaaattcaagaaagaaatttcacagcatggcatgatgaaaaatgcatcaaattgaaggctttgaaggtagacaaagccaggttccagtccctgcccctgtggtgtcctggctgagcaaatcactgaagctctccaagccttgccgaattcatttctgccatggaaatgatacccaacttcatttgtgggactgggatcatgaacaaacactggcatagcagatgcccaataaacctgggtgctcttcccagatcctagggctgagcaggtctttcagggtggccaagtggctatttcagagaaatgggcttcagggctcaccccagactgcctgtggcctgccccgcactgccctggagctggtcatttccttccaggcaggaggcccagggacatggcagtgactgtgcttcttgttagtagctctgaacagtggagctgttgttctggcatatctggtaaccaacttcctgtttttcccagtgtggtgatgttcctttagtcaacagcaggagggaaagaaatagtcctggatgggtaacctcggttttctaatccttttgctggaagaaattctggccctttccaccatggactctgtgatcacgaggctgtgtgaccttgagctctgggccataaggccaagtcccacatttggggagggaatgaggagacagcgagtcactattgcttgtaattcaggattgtggtgcccatgaactaatgctaatgtaaaggtgtgttgattaaacattaaacatttatttcccacaaagtgaatggtatcacacattcctgttctcacattctaggaagaatgattaggacatgatcactggggccagactgcctgaattcaaatcccagctccatcatttttagcgatatgactttaggcaagtgacttaacttctatgcttcaattttctcatctgtaaaatgaggagaataatagtacctccctcagagggttgttgtaaggattcagtgaggtaatgtgagtaaagtattagcagtgttctaggccacatagtaaccacataatagttagtataaagtctgaatattttggcctggcgcagtggcttacacctgtaatcccagcactttgagaagccaaggcgggtgggtcacctgaggttaggagttcgaaaccagcctggccaacattgtgaaacctcgtctctaataataatacaaaaaatcagccgggcatggtagtgggcacctgtaatcccagctactcaggaggccaaggcaggagaattacttgaacctgggaggcagaggttgcagtgagccaagatggcgccattgcactccagcctgggcaacaagaacaaaactctatctcagaacaacaacaacaaaaaaacaaaaaacaaaaaaaaccagtctgaatattttacttgctaaactccagttgaattcatggtaaaggtaatttggtaaaatttctcagttcattagaagtagacagtatttatgaataatctgcatggagtgtatatttaaatatatttcttaaaagttagctataaaatattataaaatcaagcttttctttttatctgctttgattctaaaattcagggctgtattctcatgaaaaaagtttgcttcccactgaaataaatgcctctttgtcccagggaaacacatagagtctgaattactccattctacagggtgggtgccatggggtgatggagagaggtgtgagctcaccacatgtgaatgtggtccctgctgtctgggggaggtaagaccctgggttacagcccttcccaagctctagtggttccaaggttgaggcttctgcttcccctgctgtgggaaggcaggcgtctgcccctggtttatgactgtaaatggatttgctggaggatgttgtcctgtatttcaggggtgctaacagaaaggtagaccttacaaaaaacaaacaaaaagaaatgcagaccgtagagtgtgcacatgcggtcatttaagtcacttaatgcccttgcttccttcaaaacagttctcataaaagattgacttggtttattgctgtactcaggaaatcaaagcagagggcaagccccagatgggattacagtggctgctgcattagcttttccacagagtggtggtttgtcaaggtgaccgagctctaagttaagaggatagtactcttcaggttttacaaactagagaagctcacacctttaagtaacaattttcattgcctttggaacttcagaactgagtcaaggctgcagagtggtgacttcccttttgttactctgcgaaaactgggagaaaattaagagcagggcctgcaagatgtgggagctcagagccttgagggaagcagagccgtggagcttacacagagaaggctgaggggtgagggaataatgaaggcttctttatctgaattagctatagagtagctatttctaattccactgaacccccaacatgaacctttggcaaataacagggatttttgttggagaaaaatgtttgtctggttgaacgttttagtgggtttccatttcagattctctttctgagaagggcaagaagacgagtggcagaagaatcagaaagttgtctacacacctgggtggcaggtgtaaccctcgctaaagagagaaggaggacagccaggcgcggtggttcacgcctataatcccagcactttgggaggccaaggtgggtggatcacttgagttcgggggtttgagaccaacctgggcaacatggtgaaagctcgtctctactaaaatacaaaaatgtattagctgggcgtggtggcgggcgcctgcagtcccagctactcgggaggctgaggcaggagaactgcttgaacctgggaggcagaggttgctgtgagccaagtttgcaccactgaactccagcctggtcctgatacacttagaagtcaaaaaccgtcattaggaaaacctcttcagttaactacagttctgcatattcatctgtgactctaaaagcatcctgatttatgttgtctttggagggagtgaggggacctaacctcctttcacagccccgcaagtggggtccacccaggagtgagtaagagtggcatggcttccccctagtggaggggaggccggttctttcctgcactcagccccggccactcctaccttccaggcatgtgtttacaggccagaaatgttaaggtctgaagtaacaggatttgtagtacccagcctcttgctgcttttgaaatcttttctttataggccattttgaattaaggaatctctgggtgagggagaggcttagtaaacaaactaggtgttaggcaggctgcaagccacccaggcacaagatgaccacacgaggctgaggcacccctgtgtattcaggatgggaaagaagggaagtgatgctagccgaggccagctgtgtgttggggggtatgcggtactggggacgtgggagtgagttctgtcttcagtaataacaagggcaaaaatgcactggaatccagttattttgaagggaacttggcactataaacaagcggaccttgactcttaaggattttgtgagagcctggcaagttagtaacttgcctattccattaatatttattgagcatcagccacacattaagcactatgtgttaaaccctcacaagtctagtttgctgtttctgtcatcctgtcttctcatcatcatagcccaacaaagctctagtatattgccagcaatggcttccatttattaaataattgctatgtgctagatactgtcctaagtgtattacaagcattattccatttaatcttcacaaaaattttcctttcacatataaggaaactgaggctcagagatcttagatagtttgattagaagtagtttgatgagtgtataaatgaaaaacagtatttggccagatgtggcagctcacacctgtaattccagcgctttgggaggctgaggcaggcaaatcgctagagcccaggagtttgagaccagcctgggcaacatggcaaaaccccatctctacaaaaacgcgtaaattagccaggtgtggtggcatgtacctgtagtcctagctactcaggaggctgaggtgggaggatcgcttgagcccaggaggtggaggttgcagtgagctgagattgtgccactgcactccagcctgggtgacagagtgagactctgtctcaaaaaagaaaaagaaaaacagtattttaaaacctagttctacctgatttatccactccttacatgccttctaaatgagcaaacagagcaagactctggccatgacctctatattcaggctggctggaatattttggactaaaatcagtaggtagcaagacacagtgcctaaatccctgcctttttaacctggaaaacagagggggaatgttgtttgatttccttagaagattgtcttgcttttgagtagaaatgagaattggggagacctgcagtctggaaggatttattaatctgtttattctcatttcatatcagaatttgggtgacgtagtctatctgcctcatgttatagatgaagaaattgaggtccaaaaaggggaagaacttctctgggattacacagagagtgaggatattgctccaggaacctaccagcgttggtttccgtctggtgaacatatatgtgcctgagtttctgggctttctattccattacactgctcttttgccaaaatgacactttcttaattactgttgctgtataataagtttcagtatccggtgggacaagtctattattggtcttttgcatttccatgtagattttaaaatcagtttatctgtttccagttcctacaaaatgaataaacaaaaactgctatggttttcattgagattgtgtggaatctgtaggcgagtttggcagaattgacgtcttcacagtatagaatctttaaaaccatgaacatagtatatccctccatttatttatgggctttaaaaatttctccaaataacattttagaattttctgtgtagaggtcttgttacatatttttatttactcctatttattttatattttggttttattgtaaattgcaactgaaaatttttccttttccaaatgtttattatattttcaagctatatatctcccaactgtttagtttaggaatttatctgcagattgttttggattttctacacataccattaaaattctgtgaattattctccttttccctatatattttttccctgtttgatgttaaatagaggtagtgatgcaggcattcttgtcttatccttgatctcagcaggaagccttcagtatttcaccatcaagtattatatgtgctgtaattatttgtaaataccatatcagatttaggaaggtcctatctagtcttagtttgcaaggagttttattataaatggatgttgaatgttatcaaattatttttctgaatctatggatatgatcatttgattcacccctttattctgttaatatgatgacttgcattcctgcaataaaattaatttgctagtgacatattatcattttcatatacttttctggatttagttccctcatattttattcgaggctttgctcctaagaaggattttttactataatttcactttttgataatgtccttgtcagatttttgtgtcatggtttggttagacttgcaaaatgagttgggaagtgttttttgttgttgttgttttctggaagagtttatataagatatatatgttctttttttttttttttttttttttttagagaaagggtctcactctgttgcttaggctggattgcagtggtgtgatcaaggctcactgcagcctcaacctcctcctgccctccagcagtcctcctgccttggccttccaaagtgctgtgattacaggcatgagctgccatgcccagccagtgttattttctttcccaagagtttgtttaacattgttatttgttctttaaaagttttgacattttctcatggtattttgatgatattctagtgtcttctggcttttagtatattcattaaatgaattgttggtctaattgatactccattgatctgtttttcctcccctctggctgcttttaagattttctctttgtctttggtgctgagcagtttactatgatttgcttaggtatagttttatttttatttatctatttggggtttatccatttaagatcttgaatctgtgtttgatgtcttcagttttaaaaaattcttggctgtgtcttctactcaattctctcctctcctgtgactctaattatatatctattagtcctgctcactactcctttatcttttaccctctcatctttattttctgtccttgtgtctttctgagtttcaaactagatatttgcttttgacctatcatttagttcattaatttttcttcaagctataaagtgctattaaacccccatattgaattcttaattttagttattttgtttttaaaatctagaattactgggttttgttttgtttctagttctctgagaaacttcaattttatcttttacctctttggactctttaagcatagtttttttatttaaaaatcccatatctaataacacctttatttgtagcctttgtgaactgtttctattgcctgttgttttacttggaatataatacattcatcttgtcttatatcctcatatacctagttattttttattaagtgtcagacataataggtgaaaacttctagaaataatctgaggcctttgatgatgttatctttccttagggagaatttatacttgtctctggcaggcatctggggcactatgaatctggtatgactgtgatttcattttcagagattgagatggcctctgagaacgagtccacttcttgtggtttacctttaggcttgggtatagcccttggagaatggaactccaatttcagcccacctcactcacaagctgtccaaagtgctgctcagcttctcagactctttcagaagtggcaggtatcccaacaggaagagtgtccctaaatcccaggcggacctctctggatttctctcttcaccagaatcttggccccattattcctcactacctgctaattctccataacttgaagcagaatttttaaagtatttttctagctttagagttagtccgagctaacattatttcaggtgttttttttactgtggtgcttttattctcatggtacttgttgactgaatcttgtcctccaaaaagatatgttgaagtcctagcccctagtacttcaaaatgttaccttatttggaaataggtcgttgcaaatgtaagtagttaaggtaaggtcgtactggaggagggtggacccttaatccagtatgactgctgcccttataagaagagaagaaaagagacacagacacacatagggagaagatgatagaggcagagattagagtgatgcatctacaagctaagcaacaccaaggattgctggcaaacaccagagaccgggagaggcaaggaagaggcatggccctcctgacagcttgatttcacacttccagccttcagaattgagagacaataaatttctgttgttttaagctatcctgcttgtggtactttgatatagcagccctagaaaactaatacagtgctttataatgtacagagtactttcccataatccccttgtttgttctgcacaaccctcctggcagggaagcaggaggacaggtgatgctatatgggatcagagaaactgaggcctagagaggaggcatcaacaatctgggtgccatgagtcactggcagtttgggtagtacctgggtgtcctgctgctttctgctccactgacatgctgcaggttttctccagcttcttcacatctttctagtgtcgtaggtataaggaaattccaagtgaccctgtactgatgcctgttgctttataggtgaaaaggacagaatattttattgaatgggcagtacacatattcgtctgttcattcatttgttcagcagacacttaactgagcactgacgtcctacacctgggtaagggtgggagcacagtacggacagagacaaacacaagagggacaaagcaaggactcagtcccctccctcagtagctcacagtccagtggtagagaggatacatgttcacacgtacatgtttatagtagaatttagcagggtatgaataatcttgctaatgtaaagtgagctttcttcctggtttatatacaaatgaaaactaagaaagcatttgtatgtgctgtttaatatttatggcacatctttttccctaaagtgttaggcactttcgttgtaattatttagaaaattgtctgctgataaattgtcctaaattatatcccaatatagatgaataaatttagaccttattaggtcgatgtaatctagttggaaatgtagccttacagcaaatgccagaccataatgtgctgatatagttttactattaaacgtttccatttagtacacagtatcactcagtcatcaaatttttatttagaactttcagagggatataaaggaagcatcaggcagctgctgccctcagccacaaactatcagcaatgaaacattcattctttaattccttcaaccttaatttgagtatccaggcactgcggatatgagcatacatgtgttgaataatatataaataaataaagtgtaaaatttattgtgattgtgtttgacagcagatatcggagaaaattgctggatgagccaaggaccccaagggcgtagcaggatttagggaggagaagtatgggttaaagttttcgcaaagaatttccaagtttcgtagaactattaatagttcataaaagataagaacaagtaggggataaaggaagatctgaggggattctaagtgaggggagatggggagcagaggcaaggaggaaataggaaacatacagaaggctgccccaggaggggcatatgctaaataaacccagttacgtgcatgcttgctcactgaataagataacacacctcaggacctgggcctaaggtacagtcttctctctgcctctaaccagccaactctgatattgtgcaggtcacttcatttctctgcaactttattaaagaactcaaaaatctatctagtatcaggaaattctgcaaagtctaatttgtgcatctccttctgtacccactcagcctgtccccattgcctgtctcatccagccaaggcctttgccagctttggaagtctctgtgtctgctccagaaagctggggtccttgtggcctcatgtgaaatatttcccatgccttcttgcattttctttatttcttggagctctctagcctataaatgtggtctgcctctagaattgtcatctgggctggcatttctagagaactctttcattctatccttcaatcaccttctatgttcatattaatcggttctcacaatagttcttccattacatgttctcttgatttaatatgataacagacttcatctgggtaaagcaaaactgatatttccttacagtaactctaagggattgtattctttaattgtggtagagttttgttttgtgcttgtttgcatctgatacaggcttaaataaaggacagtgcctggagcttggaaacaatttgattccttcacccaacaaacattcaaactgtatgtgatctgggccccctgctgagaacactgttctctactccaggactcccactctaggaggggaaacaggccctgcagcataagaaaacactaagggacattgtggggagccgtgtttgcctttaattgtaatagaatttgtggcaatgggattatttatcatgaaaaaaattatatgtaatataataaataagttctgtgtaatagtggttgttaaatgactctgaaaatctctcgttggctgaatggattccatgcagttcttcctgacccctagtcgctaccagggccttccccctaccccccaccaagcagctcttttcagtttgtgttttatattaactgtccttataagaattactgtttaaaaaggctatccattgatattttaaagtttggaaactatactatagaagatgcttcatcatagactcctggactctcttgagaagctgcattttgggatcttgtgagcagaggattttccttctcaagaagctgctctgagatgggacccctctccttggaatatttagaacagtttccagcatagaatttacagctttcccttctcagaaaaacagtattggaattttgcctcaagttgattattaacacaacatgacagaaagacaggttctctgaatatattttcacctccaactttttttaaaaagtgaagtgtaaggtagaaaccagaataggaaataggtgaggcaggtgttgagggccatttccagaaaggattacttaatagtagtaggagttttctaatccaaaaccaggtcctggagaagttgaggaattggtggaaggctgcagtttcaagagctggagaactggttagcgggaagaagcctacagcggaggaaggatcagcagagatggaatgggaaagggggccagggtttcccttcctcaggatagtggagtctccatcagcatctgttcctggggcctctcctggattccaggagttgtgcttcgctgggccctgggggaaacagagaagaaagttgagtttgcctgagtaagccaagtgaaaagcccacaggatagctggagaagggaaatggctagaaggtcaggagcccagagagctaattttaaaggatagggaattatggaagccctggggatgttttcttctcttagtctctgatgggggcttgtatttgcttcctatatatgctataaaaaaccaccacaaactcagtggcttttaaaacaatacaaatttattctcttgcagttctagagggtggaaataaaaaaaaaacagtctcaatgggttaaagtcaagatattgtcaggactggttccttctggaggctctgaaattgttcagaggaacaattgctagatgaaggcagggattcacgatctccacttgaagcctttgaggatatgctcagatactttgtcttgagggcagaaccagcctggactgttgccggaggtgagatccccagaccttcctttcagcagatggaatgtgccctggtgtgcaccaggtcttggtgagactgagcactgttggggcagcctctccagagttgacttgtctggtgctggaagcaggaatgtgagctgctgcgactgcattaggaggaaacagttctcctccttttaattggcagctttggtagttctgtagctttactgcaccacagatcagctgtgtttccccaggccaccatctgccctgatggtttaacatcagggtgggaggctgcagaggccctgccaggtgccctaagggaggcatgtgagagtttcctgctcttcctcacttgagcctacagatggtaaagagccaggcactaatgatattttcagtctgcgaacatccttctaaaaagtaggattttcaaaaagtgaccttttgttagggaagaacagtgtctggcttaagcgcatacttccaccttcacccatagtagtgctttcagtagctctaggggatgtaatgtggatgcatttcacttgctgtatagcatgaggcaaatggcttggtctgatttgctcactcaggtctaagaggatctaataattcatcccagttctggttcttccctgctctcaaaccacctgtgagacctgcttcccctgtactcctcagccctatgggccagggtccagcccatcccaagccctttctatcacctgtaggtttgaacccgggtcttttgggcctctgtgagcctcaataggtcagcgcattcatgacaagggagagaaagaggggagtccagagaggaagagcagagaaacagtcctcccctgcctctgcccatgacagttttcctagtactttcttatgcatcgttttatcttttcctcacatcttctggcagcgggcagcacagggccattttccccccaggtaacagagtctagcttctgactggctaaatgacttgccagaggaaaaggatgttggagactggatggtgtcccagatctttccactgccccatctaaagagcaggccttggctgtgcctggctggccttcacagcagcggcccctgtctcctccacagtcaggacaaggagccaaaggatgtaagggacaagtgtctgctctgccagacttgttcgacccatgtcatagccatcttcaactttagagactgtattgcaggtcgtcggaggtgtatctgtctcctccccctagtttgagagttccctgaggacaggaacagttcctttttccttatgtaactgtttttttctcccagtacctagttcagcacctggaagatggtcgatataagaaacaaccctaactaccacacacacacacacacacacacacacacacacacactcacacaaacacaaacagtatatgcagcttttgtgctgatattgaactattatgactctttgaggtctatgaggcttcatccctgtggtaaggggccagaccacctgtaaggaagtggtgttcccactgctggtcatcctggggcaaggctggagaactgtttcttctcttggttcctgttgtcttgggccttgcctctgcagaataagatgcacttgaagactttttcccaggtcatggggaatgaagacttctccttgcagggaggaggaataactgggacagcccccaaagagtacccacatagggccaggcgcggtggctcacgcctctcatcccagcactttgggaggccgaggcagacagatcacgaggtcaggagttcgagaccagcctggccaacatggtgaaaccccatctctactaaaaatacaaaaagtagccaggcatggtagtgctgcatgcctataatcccagctactcaggaggctgaggcaggagaatcacttgaacctgggaggtggaggttgcagtgagccgagatcacaccattgcactccagcctgggcaacagagcaagactctgtctcaaggaaaaaaaaaaagagtacccacacagaggagcctgagggcagccacctctagcagcccctataagttactctctgagttggactcctgaatgctgtcctcaaacagaaggcttgcagtgctgtggagtatgaaggcagggcctgtcccaagactgagcctgtgtgacctgggaagcagtacgctgaggcccccaattgagggacaggagtgaccagtaagattcctaatgggaagatagatgtcaggacaacaattgggccaggatctcctattgctccactccatggggagattctcccttctcagctcagagtgtctttttattaaagcagctagcaggcttccttacattagatgccagataagtctttactaaacagaccaccattctttttccttgcaaatgtggctctgttgaggtatggattaaatcagcccttatgggctagcatgggcactttgtcactccttattacatgatatttgtgggaaatagcattccaggttccaaacaagggattggcaagggaagcttgggaacacagctgagtcaccaacaagggccttgccactcctggtctgaagcactaagtgtgtttctgtgtgagggctaccttcaaggctgcagtccagcacaggctcagagcccacaggcttggcattctggcctgtggatgtttgacaagcagggcagtgtttccactggggacagtaaggggtgagttcaccaagcttccttcactaccctgtgttaccttatcttgtgtaacatgacaagaacccagtctgagccatgtagagctaccgaggggctgtaagcaggaagggggcctaaccacatctgcatttcagaaaagatcgttctaggggaggagaaacctgtaatcagactgttgcaaaggttctgtggagggagggacagtggcgtgggacaggatgactgctgagcatatggggagaagagcctgggcctggcagctggctggctgtaggagatgcaggaggaaaagctgagggtggtatccacatttctggtgttcttggagtgacattgaagtagtcagctggagagaggagccttgagctcttcttttgggaaaccctgaaaatgctgtgaagacttccacagaactgccatcccaactgatagttcaaatgcgttcttaaaatatctgatcttggcagagtggaactctgtgtaggaagaatcacatggtacttcttattccatgttcagtccccagcgtgtggtgtctattttgaaatatgtggtttatgcaattttatcaagagaggtttcttagggtcatttgttaatatttttccatttataaagttattatataccctataaaattccaggttaaggaacaaataactttagagcatttcttaaacatatcttataaagccgtatactgttgtgggaattcaaattgtacagctaaaaactataggctgtcagcaatgacattttaacgtgcatatttccatctgaatgattaactgtcagttgatacaaagaagctttctaagtattccttgcttttctctgttttttttttttaatgaaacaacacacttataaaccaatgcaaaattcacacagtattaaatcactcatttaggctatcagagccatgatagcaggaagggaacaacacaaacatacaattggatgacatcttcacaattaatcccaaaacatctgtgagtatgcatgagagctgatgcctgtttgaagcagaatgttgcaagcagaaactcttctattttactcttctcattaaaacaaaacgaaacagagaagagtttctatgtttgaaaactgggagtgaggacaacaggcctcttgccgtatggcattcaacccggtccaaggtgagagtttcttcgtcctaaaactcttgagataagaattccgtttatgatgattcaaactaaggctgttaacattattcggcctaaagagagaagagtattgtgtgtcctgtttatatgatgaaaataaatttttctagggctgccatttgcttttctcttcattatggttactgtcccacaattggaagactttttttttatccacgtgtacaaggaaatcgaagggttatgaagtccagagttgatatttgagaaactgaaaaacaatgatgtgtgataaaaatgccaaaagcttttacttttactgggagacttccttgttttataattgccagcttttccaacaatggtgtacaagagggcaccctaagaaattatctttgtgaggaacatgtaaaatgtcctgaggtccatattgatcttccttcctccacaacgagaaaataacaaaagtaaatatttggggccacgtttattttggtaagataagttccagtctggtttctaaaattagggattctgtggaatgcacgtggtttggggcatcctgccggagaactttgtctcagggatatgtagtttcttatgtgttgttgcttgcttggaaatgtgcatctaaaccttccctcacgtctgctcatctgtgcagacccagtgccgatggtaggaaagctctacccagctaattttggtaggctctcgctgtcctgccctcaccagcatgacctctccttagatgctgctctgagcctgctgtctgtccttcatacaccaccagacaggtcttccaagagcacagctctcatcctgtccctgtttctcctcaaagcattcactgaccaccccctccctcaactgctttcaggctagaggcccttccccactctggtctcacctagtgatacatcctctgccaccagccaaactgtcctccttattgcctcctgtaactttccatttctccctcataaacatccttccctgtcccctctgtccatccttccttgctcagttgtagttgcccccatcctctctccccacaacagaagtctgccctgcccagggaagccttgtttgacccctctgaatatttgcctgcaccatccatcactgtctctttccctcaatgtctagtgcaaaggaggtactcaggagacatttctgtgtagccctcccttttggcatcaggtttcccccttctagaagctgttcttttcctgtaaaaggcataccctccaagcattggttcctgggcttgtctttctcctctacccggactcattgagctttctgtagaatgtagcagtggcagcagctacccttctcctcccgctggggcttgttggaggctgtggggcctgcattcacagggccttgccttcacctatcatcttgggtagaataggaacaagcagggctgtcttcctgggcttgcaacgtatgccctgcagaggcctcaaacttgttttaatactctgctgttaccatcctgaccttcttactttttgaacaaaggccctgcattttgaacaaaggggctcacaaagtatatacccaaacctgggaacagagcagataagcagaagggatgcttgttggggtacatgtggaagccagtggagggtgtgtgacagagaatgggaaaaggaggaatggaagagatgcactagttgtgaagcacttttctcgcacgggtgacagttctccagtacacacagacacacacacacacacacacacaccactctttaacctcttccctgctttgctttgatccacaatacttaacactgtgtgacgtactctatattttacatgtttatttattgtgtctctcttcccgctggaatctaagctcaataagggcaggaattttttaagttttgttcacttatctattccacagtagctgacatatagtaaatgccaaataagcaagtgttggatgaattcactaccctttaggggctggcattcctgctacatggggtgatctgtggtagctggggagaggtctgtgaggccatgggaaagtcacagaggagatggcaggccagctgacaaagggaaattaaaaggtaccacacaattaagtggggcaaatactagcagagcccaagtgagcagagcagcaggagctagtcagagatcttcatcaaagccatgccagggaactgagggcaacagctaaggtagatggtaagatcgtaggtttccagcccacatgagaaacaccgttatttttttcattcctgccccaaccatgggccatgggtcagtgctagcaaataaattacttattaaggaattatttttctttttggcctaggtgatgtcagtcctttgaaaaggattattgaggactcttgaggcattcttggaggtgattattcctttattcagttgtgaaccagtttttggtgtcagtggtttgagagcagactgtagatatggttacattttcattgcaaaactaatgtggaatattctggatgaactggcttactactttaacaaatcattctaattaaacatcatgggaagaagtttgatacaattatggcagattttagaggaattgtatcactgaattgtggcttttgtccatagataagtataagaagcaaatgcatttattatctggaggaggcttgcagtgttcagtgttaggcaatagtgatagtgagccaggagtgaacaagctcctccacttgggtcactcacagtccagagcgggtgggaaagatatcccacaggacgatgatcataatgacagaaggcagaaaactataagctttgcagtccaacaaacctgagttcaaattccagttctactacttagtgcatcattgggcgaagtctgggtacttcacttcttggtcacatcttggccagtaaaatgggggtaatggtacaggctgagtatccctaatccaaagtccaattactctaaaatccaaatctttttgaatgctgatatgaagccacaagtggaaaattccacacctgacctcatgatgggcatttgtaaccattgaagaatagaaaaaataaaaattaaaaatgggcaaagggcttgaatagatatttctccaaagacatacaggtgaccaacaggtatatgaaaaggtgctcaaagatggtgggtcaaagtcaaaactttgtttcatgcacaaaatcattaaacatattgtgtaaaattaccttcaggctatgtgtttaaggtatatatgaaatataaatgaattttatgtttagatttgggtcctatcccccagataactcattatgtatgtgcaaatattccaaaatccgaaaaaatttgaacaccaaaacacttctggtcccaagcattttggataagggatcttcagggtaccatgtgtgatgaagattgcataaggttggcatgtgagccactggcatgagtacagcaggcattccgtcagcagtaattgtggcttctcccaaggccagtctttttttgtttaattgtggttaaaagaaaaatatatgtgtgtgtgtgtgtgtgtgtgtgtgtgtgtgtgtgtgtgtgtatgtgtatatatatatatatatatataaaaaatgaaatctaccctcttaagtttttaagtgaacagtacagtcttatctatattgtacattgttgtacagcaaatctctagaatttttttatttcattgactgaaactctagactcattgaacagtaactcctcatttccccctcctcccagcccttggcagccaccattctactttatgcttctgtgagtttgcctgcattaaatacctcatgtaagtggaatcatacagtatttgttctgtgactggcttatttctctttgtataatatcctttatctatgctgtggcacatgtcacaatttccttcctttttaaggctgaataatattcctccatctatgctgtggcacgtgtcaaaatttatttcctttttgaggctgaataatattccattgtatgcatggaccactttttctttatccattcatccgttaatggacgtttcagttgtttattgtaaatagtgctgcagtgaacatggagtacaaatagctcttcaggattctgttttcagttattttgcataaatacctagaagtggaattgctggattacatggtagttctacttttaactttttgcagaaactccatactgttttccacagcagctataccattttacattttcactaacaatgcacaagcatttcagttcctccacatcctaggcaaaacttatttttctttttctgtttttgatggtggccagcctaataggtgtgaagtgatatcccattgtggttttgaattgcatttccctgatggtcagtgatgtcgtgcaccttcttatatacctgttgaccacttgtatgtctttagagaaatatctatgccagtcctttgcccatgttttattttttctgtacttcagtggttgcaaatgaccgttttttaatcaggttatttgggttgtggtttggtttttgttgtcgttctgcattgtaagggttctttatatttttttggatactcttttattggatatattgtttgcatatactttctcccatgctttaggttgccttttcactgtgctgtttcttttgctgcatagaagctatttagtttgatgtagtgccacttgtctatttttgccttcattacctgtggttttagtgtcatatccaagaaatcattgctaagaccaatgttatgaagtttttcccctgtgttttcttctgggctttttatagtttcaggtcttatgctgaagtctttaatccattttgagttgacttttgtgtagggcataaaataaaggtccaacttcattcttttgcatgtggatatcattttgccagcaccatgtcttgaaaagactatcctttccccattgtgcagtcttggcatccttgtcaaagatcatttgaccgtacatgcataggtttatttctgcactctctattctgttccattggtctatgtgtctgtctttatgccagtaccatactattttaattaccatagctttgtaatttgttttgaagtcaggaagtgtgaggcctccagctttgttgttctttatcatgattgttttggctattaagggtcttttgtggctccatatgaattttaggattgtttttcctgtttctgcaacaaaaacaaaagccgtttggattttgatagggattgcattgaatctgtagattgctttgggtaatacagacatttttacaatattaggtcttccactccatgaacacagatgtctttccatttattagatcttctttagtttcttccagcaatgtttcgtagttttcagtgtacacatttttcacccccttagttaagtttattcctaagtattttattctttttaatgctattgtaaatgagattgttttcttaatttcctttttggtttattcatcgtcagtgtatagaagcagatctgtcttttgcatgttgatttttgtcttgcaacttggctgaattcattgattagttctaacagcttttctgtggactctttagggtttctacatataagatcatgtcgctgtgatatttttacttcttcctttctgatttgtatgccttttatatctttttcctgtctaattgccctgactagaatttcccataatgtgtacagtagaaatggcaagagtggcatggtggctcacgcctgtaatcccagcactttgggaggctgatgcaggtggatcacttgaggtcaggagttcaagactagcctgaccaacatgatgaaaccctgtctcaactaaaaatacaaaaattagctgggcatggtggtgcgtcctgtaatcccagctattcaggaggctgaggcaggagaatagcttgaaccgggaaggtggaggttgcagtgagctgagatcgcaccactgcactccagcctgggtgacagagtgagactccgtctcaaaaaaaaagaaaaaaaaaaaaagaagaagggtatggtgtttaccttccatgtatttgtgaattttccagttttccttctgtagatttctagtttcatttcatggtcagaaaagatacttggtatgatttcagtcttttaaaattttaatttttattttaaatttatttttagatacagggtttcactctgtcacccaggctggagtgcagcagtgtaatcatagttcacagcaccctcagcctcccaggctcaggcagtcctcatgcctccagcctcccaactagctgggactacaggagcacaccaccatgcccagctaattttttcttttcctttttctttattattatgattattattactactactactactattattattgagatgaggtcttgctgtgtttcccaggcttggtctcgaactctgggcctcaagcaatcctctcacttcagcctcccaaaaagttgggattacaggcatgagccaccacacttagataattagtctcttcctaaattcttaaagacttgtattgtgacttaacatgtgatctatcctggagagtattttgcatatttgagaagaatgcatattctactgctgttggatggaatattctgtgtctcttaggtccatttggtctatagtgttattcaggtcttctgtttccttgttgaccattgttgaaatctactattattgtgttgctgtctatttctctcttcatttctatcggtgcttgcttcatgtatttgggtgctctgatgttatatcttcctggtgaacatataactcctttttatcattatgtaatatctttgtttgtctcttgtgacagctttttgacttaaagtctttttggtctgatataagtatggctacttttgctctcttttttttccgtttacatggaatatctttttccatcctttcactttcagcctatgtgtgtctttaaatctaaagtgagtctcttttagtcagtgtataattgggtcttgcttttctccccctctattcagctcctctttgtctttttttttttttttccttcgagacaaggtttcactgtgtcattcaggctggagtgcagtggtgcactcacagcttattgcagccttgaactcctgggctcaagcaatcctcccacctcagcctttcagatagctgggactacaggtgcactccacttcaactagccaacttttttagtttttttaaaagatggggtctcactgtgtttcccaggctgatctcaaactcctggcctcaagtgagcctcttgcctcagcctcagcctcccaaagcactgggattatagatgtgagccatcacacccagccccctctgtgtcttctctgtgtcttttgattggggagtttaatccatttgtgcttaattatgataggaaaggacttactattgccattttgttaactgttttctatttatcttacagttcttttgttcttctttcctctctttctgccttcctttgtggttcattaattttttgtagtgacatgctttgattcctttctcattttcttttatctcctataggtattttctttgtggttactatagtgcttacatgaaacattttgtagtaataataatcaattttcagctgataaacagggccaatcttaatcttggaacagtttttaggtctaagctataacaatttttttttttactttttcattttaacttttatttaactgctttaaaaaagaattaaactagaattagtaaatgtgtgttccacaagttgatagaactaagttccaatggtatgttttagggcttgataaagtgactctaacattcatttgtaagtgtaaagtgttagactagccaagaaatttttggaaaaaaaagtaaaagggagactagtactattaaacataaaacaataaatctacagtagcaaagctgtgttttactggcacaagcaggagaatggaatggaagagaacaggatagatttgaacaggataaccaaatcactgtatgaggataaattgttcagtaaatatttggatatttgattaatcttttggaggaaaagggcagattcatacatcctactgtataccaggacaaaccccaaacagttaaatgtttactttaaaagatatttactagaagagaatataagtgaatagtatatcgtattagaatgagaaggaaccatttttaaaaaagatttttagatgtgacttcctaaaagcttaaaacttctgcagatccgtaacaactataaacaaaagtaaaaggcctaaaacaaactgagacaacagttccaacatacagaacagtcaagggattatgttgctgatatatgacaaaggaactcttataaatcaaagaaaaaatagaaaaatgggcaaaaaaagtatataagcagagttctcaaaagaagaaatagaaatgaccaaaatgcacaaaagagatgtagaactgggatggcagtcaaagaaatgcaaattaaaacaacacggagttgctgtttttacctttcagactggcaaaggccattaagtctctgtcttggcatcagtgcttctattggcacagctttagtggaacaccccatgggtgggagtgtacactagcactgccttcctaggtggcagattgtccataggtatcaagaggcttgacattttttcagactttggtcccagccattacatgtctagaaatttcttctaaggggataatctgacatggacataaagattatgtgcactggctgggcgcagtggctcacgcctgtaatcccagcatcttgggaggccgaggcatgtggattagttgaggtcaggagttcgagaccagcctggccaacatggtgaaaccctgtctctactaaaaatacaaaaattagccaggcatggtggtgggcacgtgtaatcccagctactcaggagactgaggcaggagaatcgcttgaacctgggaggtggaggttgtggtgagtcaagaccgctccactacactccagcctgggtaacagagcaagacactctgtctcaagaaaaaaaaaaaaaaaaaagattatgttcactgatgctcagtgcagtattatttttggagtttaaaataatgcatgatacagaattattattttaatacatgatataaaattcaaaagatacaaaagggattagagggaaaaatcattctcctctcccttccagttctgtcttctattttcccgatttctctcccaggggacaaccagttagttataaatatttccagagatactctttacccatataagattgtacatatacatgtgttttaaaattttatttaattttgtatttagaggttaatggtagcatgctacatggacctagcaagctactgtatgcaccttgcttttctcatttactgtctcttggagtatgctccattctcagtaggcaatatagtgcagagattgagagcacagaccactgggtttgaacaaactccactctttactagctaagtcatcttgggcaagttttctaacttctctgggccttaagttcttcatctataaaatggatataatagtccctacctcataggcatagaatgactgtaagtattaaatgagtcaagatacatgaagtatatagagcttggcacattttacataattattaactattacgaatacatatggagctgcatccttctttttaacacctgtataatattctacactggatgtattatatattttattttgtctgaccagtctcatattgatggacaactagattgttcctagtattactgttgcaaacaaattgcagcatttgctgtgatgtatatttttaaaggaaacaacataaatgtccaaagttagtttaattatggcacagtatatgtccatatgatggaataaatcagaataagattgtagctaggtgtggtgctcaggtctgttatcccaatattttgggaacccaaagtgggagtacttcttgaagccaggagttagaaaacagtctgggcaacatatggaaaccctctctctacaaaaaaaaaattcaaaatattagccaggaacagtgtcatatgcctgtagtcccagctattcaggaggctgaggtgagaagatggcttgagcccaggaagtcaagactacagtgagccatgattgcaccacacactccagcctgggcaacagagcgagaccctctctcttaaaaaaaaaaaagaaagaaagaaagaaaagatggtacaatgatatctcatgatatgtgaaaatgtttacattttattaagtagaaacaaacacttttgaattcttactagatttttcccataataaacatgatatagattgtacgaatttagaaataatagaaaagtataatcaccttagccccgtgatccagaaatagccacactcaacatgttggtatattttacataatctctccttctgaaaacttacactaattattttatgggaagcaagagttaccatctttgctaaaagtagcagggagctgtgaattgggttccccaaatagggggttggccatatgtggatggcgtaggttaaaactacttggaggagggaggcttgcagtagacaagagggattcctgggaaagtggcgctctttgagctatctctggaaggataacaggagctattccttttgaatatatcagtcattctcattgttctgtgtttccgtccatatagtcattcactcagtaaacatctattattagaggcctattttataccaacgtgtttctaggtcctaggggactcagatatgaacaagataggtaaggtccctgtacccctggagcctaccctccagagcttgtacagacattcattaccgacttacagacatagggtatgtgtgcatgtgcctgagatgcttcatctcatactgaccacagacacttccccgcatgtcttcataatgatcatctcttgtggctacacagtgttccctccagttgctatgtgctgattttattaactattcctactctgttggacattcatattgtttgcatgaatacttcatagtctttggcacgttactcaactgcttttcaagtgaattgtcccagtttacagagcaaccagcaacatgtgagtgaatgggcctgtgccatgaaaatctcaccaccatcgtctatatgtttttatcatttctattcatttaataggttaaaaaaaaaacggggccttgttgtttaaacttcttttatttgattattgttaaattttaacctttacttcctcttaagtgcattatctgttcacatcctttgttctgttacttattttggctctaaatgttataaacagactctgtgcagtgatggctaagggctcagattctagactcatacaaatctggtttatgtccagccctgctacttagaagctatgtgaccttggtcacaggggtttagggaagtgctgaggcaaggaagggcatttccagcagaggagctcttctgagaagcagaattagtgagaggttggtggcctgggtacatttaaggtgtggtgggaccttgtctggcatcatctaataaggctaccaggagtattatgggtttgttctggagtagttttcaaacgtggcatttggagtgaaggcaggcagcattgggcctcagattcagagtttctctatggaaattagatcaaaacctacaagagtcccagggaaaggtagggaggggcaagtgggaaagctgggagccctggagtcaggttgttctggctttgaaccccagcaatcccgatgcatagttgagaataggtactttgagtctctgttttctcatcggaaaatgggttggtcatgtcagtattgcatactgtgaagaccagaaacgatttatgtcaggggctttgcacacacaaataaggcactcaacaaatgtgggttgttatgaacccacagtggatggggaaacacatctgcctttgtggaagatgagagcagaatccctcctgaccattgttaagccatcagccttgctccttcccttggtttgtcactgctggagggactactgccagtactgcagtgggaaaatgagctttcaaaggtacgtttcttttatagagtgtccggtaggaattccctggggacatttatctcatggaaataggagaaggactgactgggtatctcaaaaggtgactcttagtgactgagtctcttttctagaagaaaaggatgtttggattctcagcagccacatctgcttttgaactctgtgcggtttgtgccctggcctcttaccactcccaacactcccccttttattcaaacagaggacagttgtgtttgttgaccactctttcagggtgggaaaggaatgtaatgtatgcatagactgcccagaatttcctgttagacacccattccaaaccacggccctgggatgcattccagagattacggcccaattctcaaagagaagaaatggcgcattcatttaaatgtccctggccttcagaaagagttcctcctctccccagttaaaaaaaaaaaaaaaaaaaaaaaaggtgtttagcttattccgtaataatgtagttgtgaattcaactctatgatttctttaaggttgtaatggctctgaccttcccacatgtgaagaaatagccttcacttgggcaatttcagtgttcagttttgtagcattaacagcattgatgtccccactgatgcttggtacagagcatatgtttaatgttctgctataaatacttgaacaatgtaaatctgcgatggattaccttcttagttctgctcttgtgatgagaaagaagctagtttgagggcaggcttttggtgctttgaatcattagcagtacatttggtgtgttgtcagagaaaaccagacctgggcagtagttaaagcagcaaaagcagattttattgaaaactgttgcagtagaaggaaagagacatcagtccaaaaccaggctcaattctgaatacagcatggacaagtgagtactcacagccaaggagtaggatgggagtcagtggatagaaaactgctaagaagaaacatcagaggtaggggggcttgtggcttatctgactgctatggtttagacgtggtttgtccccaccaaagctcatattggggtgccgttgccattgtagtggtgttgggaggtggaacctaatgggagctgtctgagtcccagggacagatccctcatgagtaagtaaataccatctggcctgagtgagttcttgctcttatgggactggattagttaccttgagagtaggttgttataaagaaaggctcctcctcacgtttgccctccctccttctatgcataccccctccactttgtgctttccaccataagttgaagcagcgcgagaccctcgccagctgggctacccagtcttggacttttcaacctccagaattgtgagccaaataaacttcttttctttataaattacccagtttcaagtattctgttacaccagtgctaaatggaatgaggcactgaactaacaggattcttgatgaagacaagccagggtagatcagtcatcacctgggagatggtggagggtgaggaaaccaattatgtatcaagagcagtcagatatggaggatggaggattcttgctaaactgatttagcagggatgttgctaaatttggattttacaaggaagtatgcaggtggacctaggagtttaggagtctgactgaagtttggtcaagcaaagaatctttgtcagtgttaagtcagttttcttctgaaaattttatcatgctgggtcttcagggatccggcccctgtgccagcacatttatattgtgagaggctggctcggcaccatagaaatgaaaggcaagcctttgttttctgtagctaccaagttgtagtttcttcacttgaggagaaacttgaatgttgagggatggattcatagtgagtagcaaacatttccacctacattccagctactctgatcttgtcctgaactcctttgattgtgtagaggtgtgtggggtgctgggagttttaggtcagatcacagataggagagatggaagctgtgtatgggtgtgggtgggtatgctcaggaatgtgagtatgtgaagctctgaatcggtgcagacctcagaggtttgggtcctgaagccaggggttaaggatggttccaaagcctcccccgtcttgaatctaaaccagatcagaatgaaagaattataaaaagtcactggttatatggcatgggcagatatcacactaattaagaaatgctggctatttggggtcaacatttcaacttctggatactgaagggaaccagttaggtcaggaagtacaagagaaatgcaccctcagcctatgatatgagctggatgtggacccagttgtgcctccatctgttggcataaacataaacatctgttgggtagctctttagaccagtcttcttgggccactgaaggaccaagccccactgtcagcttcagtggactttgccctgaacatttcatgttttttgtttttttgtgggttttttttttgttttttttgaaatggagtcttgctctgttgcccaggctggagtgcagtggcgtgatctcggctcactgcaacctccgcctcctgggttcaaacgattctcctccctcagcctcccgagtagctgggactacagatgcatgccaccatttcatgtttttaattacaacactttctttctaaccatatttaatatgagatttcatagaaaagacctgagtcctaaggtttgttttaagccccacatgtggagctgcttttttgtttgtttagtttctatcatcattactgttattattatacagagaaaactttactggataggaggtaaagttttaaagagctacttaatgttctaagtttagacttcacataaccaaaaacaaaatggatctgcctacatgttttttcataaagccaggctgtttttgtgaggaccgttgtctggatacaagctaaattctccatgttcacagtgagaccctgcactgtacctaaaccagtcacaattttttgttatgtttgaagctgctggtagattttctctcttacacaaacatacatgttttcactgtgcccatacaatagtcctgtggggtagggattatcattcctgtattattgttgctacggaggtaggtgaggtcacacgggctaacaagtggcagggctgggacttgaacctaaatgtaattccaaagcctgtgttctttccatgtaacttatatttaaagtcaatttctgaataaaaaatttcactctaggctcttaaatggcaacctgtgtaatttgcagatatcctggatcttggctgcattggtcataatttaaagtttaaactcagtagttttaattacagagctaagacagtgacattcatggtacaaatctgatcccgtcactccccttttccataacatcaaatccaaactcatctccatggcttgcaaggcccttgctgtcattactcctatctcatactccttgctactcctttgatttcttaaatgttttgtgctttctctcacaccaggccttttacacattgctgtttcacctgctcctcccaccacaaaaaaattaatgaaactttcagcccagcttctttcaagaaggcatttctgggctgggcacggtggttcacgcctataatccccgcactttggaaggccaaggcagatggatcacaaggtcaggagttcaagaccagcctggccaatatggtgaaaccccgtctctactaaaaatacaaaaattagccgggcttggtggcaggcgcctgtagtcccagctactcaggagggtgaggcaggagaatcacttgaacccgggaggcagaggttgcagtgtgccgagatcgcaccactgtactctagcctgggtgacagagcaagactccgtctcaaaaaaaaaagctatttctatacccctcgctactcatagtccccagtctgggctatgtgctcttctttgggcaccaagagtgctctgcactttcccatcctaacaagactcattgtataccagaagtacatattcaaatgtctctcctgctagatgtgggcttcatgaggtctgacccctgcctatgttgttggtcaatgcttctgtaccacctagcatcagagcttacattttgagagacaatcctttccatttcaaatcacataaacccaattatattggcttaggagcaaaagagaatttgtttacttacataactgaaaattccagaagggtctggttttaataaaaccaagtcctcagacagtgtcgtcagaaatctgtccttctttgtaacccagctccttttttctcagttttggcttcatgctcaggtaggtatttcttacgaggtgcaaagatgactaccaattgctccaggcttacatcctgccatgttaagaaacccagcaaaaggcaaatatcccttccaatagggcttgcatgaatccttgcagagtctttggtccagggtgggtcacgtgcccatccctaagccagtcatgtggctcagattggccagcccttgataaaggacagaacattggtagggtgagagtggttccccagaggaaaatagaggaacttttaccagaaagaagggtaatggattctggcaggcaaaaaatgtcagatgtccactacactccccatctgtaactggtgctttgaagatacgggttcttgctgctgggccagcactctgcctagaagaccagggaagcatttggaaggcttcctgtcttgtctttagagaggaaggcagttgtctatatgtgtactttaagctgccccattcatagaccctctgtaagcctattgctggcagataggaggtccccagcccatgggaggggcaagggagaaatgtgtatgagtgggaaacagggtcttaatttgctgggctgcagtgacaccagggccaggggcctaggcagaagcattagctctaagggcatatccaggaaaacagagccacatgctaccctgttcctccagtggatacacagggaccatgccccacatctccagctcttcacaaccctctccagggtttctactccacccgagtttgtgcacagaaatggagaaagttaagtctttaacttctctacctcatctacctctatcaaggatttccctttactctccctgtggggtatctgtgcccatggcatctttgtgtgctgggaccggctatgggcatgctttctttctatctttttttcttttttttttttttgagacagagtctcaccctgtcacccaggctggagtgtggtggcgttatgtcagctcactgcaacttgtgcctcggcctcctgagtagctgggattacaggggcccgccaccacactccgctaatttttgtattcttagtagaaacagggtttcgccatgttgtccaggctggtctcaaacttctggcctcaggtgatctgcccgccttggcctccccaagtgctgggatacaggaatgagccaccgcatttgggccgggcatgttttcattgacagggataaggaggagaaagagggtggtccttcaaagcaggcctgccccgggctgagccttgggaaaatggcagcatgttgtagcctattgggggacccggcaggggagactgctgggtcagctagccacctctgtggtcctccttgcatggtcctcctcaatgctcctttctgatgtacagcttgagataagaagtccctggaaccagatgcagacccagcaggcagaatgctctgcagaagagagctaagcttcagccccagagggaattaagtaaggggattggggagggagagtgtatgcttcctgacctccacttgaaagcattgttcttttcctaagggaaaacagcccccagcagagctcactgggacatgcaacccctcccttttccttccccatgtctatatctaatttttagagcaattgattaaaatcacttcctgagatttttctagttttgctttctgaattacagtttatgtaaccaagatctgttatagtgagttgtttctcctagttgtcagatagcagagaaaaaaatgtacgcccgcagaatccagcctttgatccagcgttcctggagaaccctcactcatttatgaagcgaaagcttttatgagactataataataaaagctaaaatgtatatagcctgggtgtggtgcctcacaactgtaagcccagcacttcgggaggccgaggcaagcagatcacttgagctcaggagtttgagacctgcctgagtagcatgacaagaccctgtctctactaaaaatagaaaaattggctgggcgtggtggcacatgcctatagtcccagctacttgggagactgaggtgggaggatgtcttgagccccgggggtagaggttgcagtgagccaagactgtaccactgtactccagcctgggtgacagagtgagaccctgtctttaaaaaacaaacaaaaattatggagtgcttgctctatgctaggcactgttataagaactcatttaattctcacaacaaaccctaagatgggtatttattatccccattttacagataaagaaactgaggcacaaagaagtcacacaacttgcccaggtcctgtactgttgctggttgagccagatttcgcacctaggcaagttggcattggagcccacattcctaaccaccacacatttttctaacttgatgggctttacctgtcatgtcaagaattaattgtgggatgcaaaatcaacagcagagagacaagtcaaaaagcaactgtagtggacctgagccaggatagggcagggacaaggagttgctaaggatatatttaagaatcgattaggatgtcagaaccaacaacttaatgagggaaaaggacagatgtctagcttaggatattggtaccctgagtgaagaggggagtggtgagccccatttagatatgctgagtcgaggcatccagaggagatgtccagcagacaggtggatgaactggcctggcccaaagacacagctcagtcagacacacgttcatttgggagtttagtggccaaagaacaaatgatctccatggggcggttggcgaaggcttcctgggtgaggttggctttgagccaggctctgaagagcaggatgctctgagaagtggggaaatggggggaggaggagtgggagaagggatgtcagtgtgatgaggagtctaccatggaggaagctagggagtaaggtgggcaggtgctgggtttggataagggaggttatcagggaaaagtgacagaaaactttggaatgacttttgatgactccttcctcctaagtctgatttttaaaaatgaaaatcgttacggaatattttagactgacgttcatagttgctactccctcctttgctcttccaaagtaatttcttaaaaccaatgttatggggagatgtatgcattcaactatctttaatatcctaaaagaccttgttcttggatacctgggccaccaggagacctctcatgtgtcttatcagtggaaacgtaaagggggcaagcgaggaaaggtggtgagaggtaaagtcttggtcaaagcagagaagcaacaagaccccttttgtgtgtacaaggaggatgagcggtggagctggatgccagatgagaaagccagcaggagcgttctactgggaaaaggacacttctttggtaccttcttttcacatgggcctcctccggttttgagtttggtgggtatgttcattcttgttgatatcatagaccaggagtggctgtgggccgtgacagtagccacattgcttctgcaaggctgagaacactgctgttgcctggtttgtgtcataggcttggagtgtagaagcgtacgaattaggctgaaggttgagaattagaaggaggatatggtttagaaatagcacaaagttgccaaaagacagtttaacaagactgtttactccccccccattattagagcaatacataattaccagaaaacatttggaaaatgtggaagaaatgtaaacacttatggtctgacaattaattactgttaaccttttgacatatttcttgcaaatcttttctcaattataatcttttttagtttgctttgcttagttatgatcaagtcagatatacaataatatatattaactttttcacctaatgttatgacgtcaacatttgtccattaaactgaatttttatttcatgtgtcaaccaaaactctcttaccagtttatgagcaaatcaaggaccttctggatgatagctgggggagagaagtagcagctggggctggaaggcagtagggtcattagtccagagcacccacgtctggagccctattcaggaacaagtgaatgctgagggtgggtgaggccagtgctgatactgaggaaatccttccatttacccttcccacttctcctattctgagagttctagaccaatccaagagtgattagaaaattagccactgagcctccaagaggttcctgcaggccctagaactaaccttatttgaaaggaagaatcctggaacctcccacagctgtgaaaatgaaaccactttggctgcttcactctttatacagagaaggaaagacctgggtaagctccctttccctgtctggaggcacgatggcctcccaggtgttcagataactaatttactgactccgttagcagtgtgtagcttctgtacagtaagtaatcatgtggtagaaattatgaatagtgtactggttccaagtttatgaattttttagtatgtaagttcatttgttaattagttagttagttagttatggggaaagttcgtgtgatccaaggatgaaaataggacctgggaaggtgctttctgcagactgctcagtgtctctgagacatgaacaaatagcttgtttacttgcagaggaatgtgctatcagccagggaaaagatttttttttccccctgactaaattatctgggtgtggcataaaaattaaaacacccagagtaacaatgaaatggtttaacgaatcatttatattaaatacaagtttattgcaatgcttttctctccctatttggcatgttccaccttcttaatctaacctaagttgtttcaagattgtattcagcatggcacatggggaaatcacacactttggaaacaggcccacttgggtttgaatctggcaaaggaaccgacacaatcctgctgtattttctcaatagttgtattttctcagcagtaaggtggaagcagtaaacctatctccttaggagtatgtgagatgaggtttgtgaactatcgggacctacagggttggcccttggtaaacagtgattattatctcttcccacactgccacttaggtggcccgcatgcctggcggtcccaatggcctggtctggcctgacctgcctttgaaatgagacgcctgaaatgagatggctggtactctatgacaggcacccaaggatccttgaggaagataaaaacagccagctttctcagagatttatggttctgaagctcatctttagtaagtgtggatcttaaattcatacttactgggccatttgcccaaacctagggtagaaaccattcatatctgtggagttgctggaataacagcttttcagtcccttttcagaatttccatctgaatgcacttagttttgctgctggcagaagagcacccccaaaacattcagcaaaggttttgtgatctcttgggaggaactaggtgttacacaaatcactcgtaagtgcacaaaaagaggaattgtgccagaattgctttttgggagaagagataagctccaacagttatcatgtggacttaaatcatttcctgctctggcaattttcccattaatcctaagcatggtcccttgcctgcggcctcttctcagtgcaccactgatccgcccaggcatggcatgtggtgggacagtcccggctgcattcccaggcaaatactcctgcccctcaaagttgtcagtcctcccctgaggggtgtttttcatctatactaattttcaccttttattcctgacttgtggcagcttgtcgtgagccttggataaacagaaaggatgtgtcactccctccagtgccttagttcagagcaggccagggcacagtattgccctggatctcgtgaagatgggctttgccctggctggccctacttgggcaggaacatgtgttctccatccaacatctcctgctgtttatgttttttaagtgtaaaggaagccttcagccctaagctctgtggatccaggcccccaccaacttcttgacaaactcttggcgagtttaagcaggcggttcttttgtgcctttacatatctcatttcttaacccacgaagttagtcatttccatagtgagcaggggatgtccaagaacctagattcaaagtgattatttgttggtatccataatggagagatgcttcccagggagtgtcaagtcgatttgtgcctgagaagatgtttgttttgaagtagtgcttggtgcagggtgggaatacttcatctgctaggttcaggaatgcagatggggactgaccctgtgggtgggtcagttaataagcaggcagcccctgctgggctgaggtcaaagggatcctgtccagccagagggattggactccatcaactagctggctcctgggattctcacatttgattcacagttctttagagtaacttccaggagcccctcatcttctcctgctgagcaggccctcagggctggaatctggggtctggggggcaactgcacactcagatttttgcattatattacaactatcagtacatgctgcagttggccatagtgtgctctgtttctgtttccagcctcccagtgcaacgtcagcttaaagaagcagaggagccgcagcatccttagctccttcttctgctgcttccgtgattacaatgtggaggcccctccacccagcagccccagtgtgcttccgccactggtggaggagaatggtgggcttcagaaggtcagtactggtgaggaactgtgccctccataaaactgcagcagtggcatctctgtcccatccttgatgaatatccttaagaagaatatgcagagccaggcgtggtggctcacgtctgtaatatcagcactgaggtcaggagtttgagaccagcctggccaatatagtgaaaccccatctctactaaaaatacaaaaaattagctgggcgtggtggcaggcgcctgtaatcccagctactagggaggctgaggcaggagaatcgcttgaacctgggaggcggaggttgcagtgagccaagatcccgccattgcactctagcctgggcaataagagcgaaactatgtctcaaaaacaaaaaacaaaaagaaaagaatatgtgatagtatgtgtacagccatttacttaaagatttgaaattaccaagaaaagtaaccttttttgataaaggatatctcatttagcaactaaggattatatttgatgggagttacattagtcacttcacatttttataacattctctcttgggaagttgaatgcatgaaacagttaaacaaccagtagcagactcacaaatagataaaaagagaaacagacatagagaagagctagcaataaaataattgagtgtaactaccttgtttaataacaaacatgttatatattcttttgtatgtatcaaataaaatatgtcagattgtcacaataggtcaaaaaccaaaatctacccacatgctaacacagatctgaaacaaagttactcagaacagttagaagtataaggatgaggccaggcatggtggctcacgcctgtaatcccagcactttgggaggccaaggcgggcagatcacctgaggtcaggagttagagaccagcctggccaacatggcgaaaccccttctgtagcaaaaatacaaaaattagccaggcatggtggtgggcacctgtaatcccagctactcgggaggctgaggctggagaatcgcttgaacctgggagacggaggttgcagtgagccaagatcacgccactgcactccagcctgagtgacaagactgaaactccatctcaaaaaaaaaaatatatgtatatatgtataaggaataaggatgagcgaagagacctcatacaaatataaattaaaagaaaacaagggttacaatattaatctcagtcaaaatggaatttcaggaaaaatcactgaaagaagattattcattatgaagatagttgacatttgaggacacaaaagtcataaaactttatgttccaaataacatgagcaaaggacacaaacaggtaattcacaaaataagaaatatggttcagtcttgttgatatcatagaccaggagtggctgtgggcggtggcagtagccacattgcttctgcaaggctgagaacactactgttgcctggtttgtctcacaggcttggagtgtagaagcataggaattaggctgaaggttttcatatggtcaaacatacgaaaaaataagaaaaatgttgcacatataaatacatgaaaaatatttaacatgtttaataatggaagaaatgcaaactaaataatgagagaccattttccagctttctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcagcctcccaaagtgctgggattacaggcgtgagccaccgcgcccggccattttccagctttctacttatcaaagatatttttaaacacaatatttggttttagcatggagtggtaggagggaggatagagaatgtaaataagttgctggtaacaatgttaattgatgacacctttctggaggaaaatttggcaatatcatcttaaagccttaaaaatatccctatttgttgatgcaggcagttcccctttatggacataattatgaatgtgcaaagatttaaccatgaggtaccatccagcatagattataataccgaaaaattataagcaacccgatgttcaacaacaggcagttggttaaaaaaactatagaataaatatgcaatcaaatagcatacagcccttcaaaatgatatgtcgtaaatattgctgatataaagaaatggatagagtgtctctcttgttctctcacacacatacacatacaagcatttataagactagaaggatggatgccgaaatatgaagaggttatctcctattgctcacactggtggaattatagctaggattttctccttccctctgtacttccctcagttttcataaaatcagcttaaattacttttatgatttaaaaaattattttaaaaccacatgtggatgtatagaagggaattctgggaagatgacagcctgagcagatggctctattaaaattccctcccaggataaacccaggtgggcctgctggtggagcctggaaagtgcattaaggcccccagttttcctgacaccttcagggtagagagcaggcacaggatttattctctctggtactcagtaagaagcagggaaccgccaacagaggaaaatgcttacgtgtccctgagtccttggacaaacactcgaatgtatagtcccatgaggtcaactagccagaaggagctggcggatcgccttggaaagagctcgcactgcccacacaatgtgtgtggtccttggaggggctgccctggtgagctggattgcttccagtgcttgtgccttggaggagccagtagtataggggctttcttagtctctgaggtttgttaacttgggctctgctgggccatgaaaacagcactccttgctgggccttgcagtactccctcatttgccacttcccagagagcctcatagactgacctgcacagacactaagggaacacacaacctggtgcaagcaaagaaaaatgcagcctccactgagaaagtccaagttggaaaaactgtaatgagactcccactgaggtaaaactaatggaagagatggaagagaactgtaacggacaactcaggaaatgaagtataagtacaaaagtaacatttggaacttaaaaactcatgatttctaaatataaaaattcagtaaacaggagaatggtcactgctgggaactgaattcatgttctggaaaagcaagtggaagaagaaatatcttacaattcagaccagaaacacagagatggtaattgtgagagagaacagcaggcatctaggagatggaacatgcaaatgttaagagttctagaaagagaaaaagtagtagaagaaaattttcttgagctgaaaacaaagcttgaatctgtggattgaaggagcttaccaagtcgacagcaggattagtagaggagcacatgcctagatgtatctgttgaaattctgaagtttaaggacaaagagaaagtcttacaagctactagaataagttattttcaaggaaaacaattatattagtatcagacttctcatcagcaacactaaaagccagaagactatgaaaaaatgtttataggctactgagagaaaaaaatggaaagcaaaaattctgtatgtgaccaagatatcatttatctattgagataaaagtttcttagatatgtaatgattcagagagggaacaaaaaataaaaatctgggtgagattgatattcagttatgatacaattattaaaaatgttagaaatgggctgggtgcaatggctcattcccgtaatcccagcactttgggaggccgaggtgggcagatcacgaggtcaggagatcgagaccatcctggctaacacagtgaaactccgtctctactaaaaaatacaaaaaattagctgggcatggtggcgggcacctgtagtcccagctacttgggaggctgaggcaggagaatggtgtgaacccaggaggtggagcttgcattgagccgagatcgccacactgcactccagcctgggcgaaagagcaagactcagtctcaaaaaaaaagaaaaatgttagaaataggctgggtgcagtgactcattcctgtaatcccagcactttgggaggctaaggcaggaggatcacttcagcccagaagtttgagaccagcctgggcaacatagggaaacccccatctctacaaaaaataaaaataaaaaatcagctaggtgtggaggtgtgcatttatagtccagctactctggagactgaagtgggaggattgcttgaacccaggaggtcgaggctgcagtgggccatgatcgcaccactcccctccagcctgggtgacagagcaagatcctgtctcaaaaagcaatgtagaaataaatattattattaggaatagaactaataatagaactgtaacaagtggcacaattagaaaatagatctttaaaattcacagagggagtaaaggagaagtaaacaaattgaacaagccatcaaaattaaggaaagggaaaaagaacaaataacagataataaatagcaaacataacataaataatagtcataaaacctagtttgatgaactagattcttccaacaaagaccaagactacatcagattggtttgacaaattcagctgtatgatatttccaagaatatacctgtcatcaaataggaatgattttgtcagtaagtaaaagaaaactgctgggcacggtggctaatgtctataatccctgcactttgacaggctgaggcaggaggatcacttgaggcctggaggttgaggctgcagtgagccttaatcactccactgccctccagcctgggtgctagagcaagatcctgtcttgaaagaaagaaaaaaagaaacagaaagaaggaatgaaaggagagagagagagaaagtgagaaagaaagaaaagaaaaggaagaaagctgacaaataatagcttagacaaataggggattatttttctcacataaaaagcctgagtcaggtagttggtgggatttggatttctgatgatgccatcaagaatctgttcttctgtctttctgctcccctatccttggtatgtttgccttcatcctcatgcttgctatttatgatctcaaagtcgcaagcttcagatattgtttccacatttaaaggaagaagataggaaggggtggcactggccatgtcagtcccttttatggaaagtaaatgctttcacagaaaaacccaggagacttctgcttatgtcttattggcctgacacagtgcctggcagatttcttttacttactgccaaaatcatttctatctgatgacaggtatattcttggaaatagcatacagttgacttagtcaaaccaattgggtatagccatttgtcacatggctatccaatagcaacaggggaggaatttagcccagcatattcctgctctcaacaaaatcaggacaagggaggaatgactcataagtagatacactagtcagtatgggtttgtttatgcttcagtaacaacctcaaaacctcagaggtttaaacaataaaagtctatttttcactcatgctacttctttataatgggttggctgaggctgagccttttgttctgtggcactatccaacagaaatataatgcgagtcacatgtatcatttaattttttccagtagccacattaatgaaaatatttttaaaacaagtgaaattaattttaataacattttatttaatcactatatccaaaatattatctcaatatgtaatcaatagaaaaaatattagtgagacaatttatattctttttatcttactaatccttcaaaatctgatgtgtattttatacttacagcacatcttaatttggaccagccacattttgtgtgcttagtagccacatgtgactagtagctaccatactggacagtataaccatcttatcctcattcacgtgcctacgccccatctctttgcttccatgactgtcacagcagaacaaaggaaatgtgataaatcacattggctcttaaagttttcactcagaaaactcagaaaaacatgccttatttcaacttacattttattggctaaagtaagtcacatgactgcatctaagttcaagggaaatggaaatgtaatccacatattcagaaagaaaactggaattatttggtggacagtgctaatgacaattacagtaggtgacagtttctgacataacatatacagataaaggaaggtagaaaataaagaaatgggcaaaatatacaaggcagatcaagcagaaagcaagagtggcaatgttaatatcagataaagcagaattcaaattcagaagcattaaacaggataattaggggcactttatgacaaatggtctaatacatgaactgtatagtagcccataaatctttatatataaaatcaacaatgctgccaaagaagaaaactatacacgataaaaagctatcttctaaaaataaacagcaaccaacacaggaaaatcaatggtaggttctggctaatggaataagccaagaaaatgagacaattggtataaacatggaaaagatacaaagttagtcttatttgcagatgacatgactgtttacatagaaaacccaaaagactccaccaaagttgattcaaatcataacagattttgatttctcatgtttatgagaaatgtgtgtgctgtttctggatagaaaggcttaagttcttctgggacaaaaaatgtcaaagaaccgagacatttttagaaagaaaataaggaagacagcttggtatctttgtagatgaaatgatatgaggaaatggcatggcagccctggaagctttcctggagtactcagccgtatctatcaggaaatagaggcctttagaggcagttcctccagcagagctgagctcacttggagttactgttcattcatgaacttccttctattaacatttgtcaagatggctttttaaagaattatgttaactttgagttaatttaataatccaaagtggggtgatacgtcatttccataacacttgactagtcaatctgggagaccagacgccaaagaaagagccctgtcagagtagggcagcgaattcccagaggaggaccctctacctcttgcaccctgcttgctcaggacatttggaacacaaagcccaggcctattagatgtggaagcagattccaggcccatttctactgctgagtccttaagtatctatgcctctcagaattcagcatgccagaggaagaaggaaggccatggacagaatgggacagatgacctctagggttccatccaccctgcatatttacttttgacctggagaaatgaggatttggagcctttgagtttccagctgcttctgcagcagcggcttgggttagcagccattgccaccatcacagccacaacctggacctacagaccagaagcctccaggggctgggaggagtcagcaccccaatggcaaagaccatggaggacctttaagggcaaggacagcgtaaaacagattgctggacactcacaaatatatgcatacctcatgctgtatacacacacatacatacatgtaagcttctagggtaattttcaagcccaaatatccttctagatcagcacctttgcttgctcatagtgggcattttttcaggcccttcagctgcattgttgtgatcttgcgcgtcgttgacatgctcatctcatcgaaagtgtgttctgaaggtgcacctgtgtgcaggggctgtctgcactctcctactagagcagagctgaagactgattgtcactagacggggagagagtgtctgctggcatctggtgagtagaggccagggatgctgttaaacatcctgcaacaaataggacatccctcacgacagagttatccagcccagaatgtcactagtgctgaggttgagaaaccctactctgaagtgacccagccaggtatggcagcacacacctatagtcccagctactcaggaggctgaggcaggaggatggcttgagccaggagtttgaggccgcagtgagccgtgatcacaccactgcattccaacctgggtgacagagcaagaccccatctgtaaagtaaaataaaataaaaataaggagacccaaataggctgtgagcttctgcttaaaatctcctccaccaaatactatgcagccgtaaaaaagaagaagtcatgtcatttgcagcaacatggttggagctggaggccattaatctaagcaaactaatgcagcaacagaaaaccaaataccgcacgttctcacttataagtgagagctaaacactgaatactcatggacaacaaagggaacaacagacactggggcctacttgagggtggaggttagaaggagggtgaggatgaaaagactatctcttgggtacagtgcgtattacctgggtgatgaaataatctgtgcactaaacccccatgacatgcgatttacctatataacaaacctgcacatgtacccctgaacctaaaataaaagtttttttaaaagtatgtcctccgccaagtatgtctgtaggggcagtgacctactcttgagtccctgtattaggaataatattatttaagagcttctgaaatgaatttatctgtgcaagttcttgaaaactttgatttatttgattgcattgtctgttggagagcagcatagctctgccttgagtgatgtcagaaggaagcttaaaatccttaagacaagccggaaatctgaaaaaggaaggaactgtggagatcatctcaagaggaaatgatacttgctcttatgctgcagaggtgatgactaggggttggagataatcaagaagttgctaaatagttcttagtgtcaaaacagagctcagaaaggtgccaggcagctgccattgcgagccatcaggtttggccccttcacgtgagacctcattatcactgtaaccctcttaataaaaatggacacatcttttcacaaatccttcagtgtacaaggcatgaagcagtgcattgccttattaggccatctaaaaaagaagaaacagaaactggaaatgctcagtggaaataaacttttttattagcatttcttaacaatgctataatgaagtgtttccatcaattaggtttggaatggctggcatttggggctgaggaatatttgaggcctttccttggggcctaggttttcttaacactccctgtgaatacagattgtgtttcccttaaaggaaagctatccccttgtctgttgcctgggagggaacttcttgtaccttgccttgtcccctctccccagtcttcccctggggagctcctggaatgaccagggggtcattgtaatctggtgaacatgtcttccattccctgcgtatgatattgacttagtctttttagggaaaaacttgcttaaaagaaaaaacaaacagtttttagagggaaccaaggattaaagtatgagtttttatttttgttttttaattaaggattgaattcctgggagtaagggaggtgctatttaaatacacaaaatggtttgtgagtctcaggagcccagcctggcttgttgggagagcaggtgtctgagagacagaaggagcctcatgccttaactgtggaaaattttcaggttcctcctgttgattaaacaccaccaaggtacagagaatggcagatcatgcagctgctgtgctcaagagggctttgaagtttcttttgagaatatgatcttctcttcgaacctgacaatgattttttttttctttttcctcagggtgaccagaggcaggtcattcccataccaagtgtatgtatatttatctaattttatttattaaaacagtcataaaatcttgtggctttgggcctacttatataaaggattttttttaatgttattgcttatggtgagtttatcatgtggtataaacagctctgttctgttaaaaagaaaactgaagctgcattttaaactgtgagcaggaagttctgtacagagacagtttcctttctcaggaacagcagggcagccagctccattaacctaattctcatttttcctttctctctgggaaggacctccaagctgaacaagctgaggttgctcagaggcctcacccacaccccactatcttagcctcaactccatagattggcgggaacattgttttgcccagacccagttctttgcagcagattcagtcccagtggaactgggctcaccaagcccacgtcccaggtgaccagactgtttctaacttatcagtggtagcatggctgtagctccgagatcagagaagtcactgtaactatattctcgggacttgcaggacccatcccacaggcctgctgtgctgccactctgccccagctgggcgctccctgaggccacccccacttctgttgtcatccctgaaatttgttccaccccagcaccgtcctgcaccagccacccctcagccatccgctgtcctggctgtcccttctcttcctcctgctctgccagcagagccacccagcctgaggccagtcagtaagaagtaaactgaagaccgactcccaaaagaaatttacagttgagatgcctgtatcaaacaagacctttcaaatagtcttatgtccttagagaaggatttaggtttcaaaatgtgtctataaattaattttttagtctgtaaagatgatcagattcagattacttgattcaaatgtgttcatctctctttccttggagtttttcacatgttttctgggaacatacaatagacacagcaatcttacatagaaaggagtagatggatttcacgtgtgcaggttgactccaaaggctttggtagtacatgtcacttacaaattgcccaaaaagtttacagtaatttcatttttctcaaaactctaactcttcattgactaatgcgttgcaagagtctgtgtagtgattctgactttgcccatgtgcctgagggttgggttttgttgagaaaactggctttgatcaaaaagattgacctggcagcacaactttttatccagagtttgaggaagatgctcagcagagttaataccagaagactctttaacctttatataaagtagtttttgacatatttttttcctgcagaggtacctacattaaatgatggcaggtagcatctctccttccaccttcaatatcactattactgttttttcttaaagctaattggcagccacgtgcaaagttaagtgcagaacaaaagcacttgtcagtataaaaaccccactgaagaaacggacccttttcccacaaatgtagattcagccatgtatagaattctggaataagataaacaagaagaaaattccttatgtaattgatcctactgatagatcaataaactgctgactgtgtcctacatgtgagatgttgggtcaggccatgtgaacctatgaactatcttgcccaaagaaacagccaagctaaaggaacttgcacttttgaatgatgacctccagaaaagcatttccactagtgagcacagtgtgatttccactgactgcttagcatataggactgatcccagtccatccgggccagctcagctctggaatcaagtcttgggagcccctgcaaaatctgcacctacctgaaaaggcgccaggttgcataagcagcgtggttctggcctttctggacctcagggggacctggtgagtgctgggagccctgagagcttagggtgccatacataggagcagaaatctgggcttgtgctgagtctccaaaccagatcccacaacctcctgaaagctttcttcaggccctgaaggtaaagaatcctctaagcctgtggtgaccagagcagctgcatctggggtccctatctgtgcctgtcacctcacccctcttttttcattcgcatgttgctctgtttgtatgtgtaggtttggtcttttaattttttactaaacagtaattcaagctcatggttaatttttaaatattgacggatttgggattaacacctgtgggaatacatacatacacacgtacgtgaagttgaaagattaaagcaaagagaaaatatctctcaatgtaatcctactgccttctaggcagtaccactttttaatatatgtcatttatccttccagaagttttccagacaaacacaaacatatttatataaatgaaattgtgttgtattcaccattctgcaaattgcttgttactttctaacaagatgccttgaacatctttccaaatattagtaggtatatatctgcctcattgttttatatttcattgatggcatttactttgtttccacttctgtgctattacaaatatttctcttaaaaatatcctcttttctgtgtgcttatggacttgtgtgatagttctttgtgatcagtttctatttgtggaaatgctaggtcaaaggatatattttacagtattggtacattaaaaccaaattatcctccaaaagcttatgctaatttacattctcatgaattatctatgagagtgcctcatacccttactgaaaatgataatcaaatgtttcaatctttgctaatctgaaaataaagaatagtatcaggccaggcgcagtggctcacacctataacccaagcacttggagaggccgaggagggcagatggcttcagctcagaagttcgcgaccagcctgggcaacatggtgaaaccccatctctataaaatatacacaaaattaactgggcatggtggccgggtgcggtggctcacacctgtaatcccactgaggccgaggtgggcggatcacctgagatcaggagttccagaccagcctgaccaacatggagaaaccccatctctactgaaaatacaaaattaggctgggcgtggtagctcacgcctggaatcccagcattttgggaggctgaggtgggcagatcacctgaggtcgggagttcaagaccagcctgaccaacttggagaaaccccatttctactaaaaatacaaaattagccgggtatggtggcacatgccagtaatcccagctactcaggaggctgaggcaggagaatcacttgaacccgggaggtggaggttgcggtgtgctgagatcatgccattgcactccagcctgggcaacaagagcaaaactctgtctcaaaaaaaaaaaaaaaaaaaaaaaaaatatatatatatatatatatatatatatatacacacacacacacacacacacacacacacacacacacacacaattagctgggtgtggtggtgcatgcctttaatcccagctaactcgggaggctgaggcaggagaatcacgtgaacccgggaggcggaggttgcagtgagccaggatggcaccactgcactccagcctgggctacagagccagaccctgtctcacaaacaaaacaaaacaaaacaaagattggtatcagtttattactttgatttgcatttctttatcaatgagtttgaacagcttttcacaagttcattggctttcttcttctctattcatttcctgtagttttttatgctgtgttgcttgtcgttttaaattttaaggaaattaatacttttccccaaatgtatgatatatcttttggccttttttgtttataattattttggccacaaggaagttttagttttatataagtaaatattaatatcatcctttatgctccttgattttatattttcttctagtattttaatagtttttaatagtttcaccattatacctttaaatctttgatccatttggaatgtatgttggtgtaaggcatgaagtaggaagctatccttttttccaagtggctactcagttgtcccagcaccatttattgagtaatcatgttttgcacgcctattggaaatgacatctttatccttaccattagtatcgttcatctcccaactatgagccaggatttagggccttccttagtgggaagcttcatgggctgtttggtgaacgtcgggtattgaagtattaggaaaagatgcagagggaacgaaagtttgaaactgctgaagtatgggtggtcatgaattgaggtgagcactcgaatgccttggccccagtgaggaacgccactgaggctgtgtcctgagtcctaccgatcccatacttttgcttaaattacacagcacacagatgctcacaaacatgaggctggcagtgtaaccgagccataaaaatgctgaaaggggagaggatttgttttctaacagctatgtttctatgctatttgcctaaggcttttaatacagcaatagtacacttctttccacgaaaacattatgaagaacatacaagcaggacagctattctaattaaaagcagtctagagttcctcttgctcccctcctgcgttaggccctgacatccacctggagctctgagggcttgaggagcacagcgtgcagaccttaagcctgagaaatcttaagtaaggaaacaataatccaatgtaccaggaagaggtactacatctgtaagatttatgagagtttgtgggatgggcactccaagaggaaataagcttagtgttaactattcatggctgccagttctctgccaaggacaggaaatttcagatttactcccaggaaaggaacaggaatgaataccattcccaaaccgtggatggcaagccgtggtcccttcctcctccacccaccccccggcaatgctctttgtgtacatttgagcaagtcattttgtataagaaagacctttcttgatgtgactggtatttctcttgttcttcagctttatgaagacttcagagaaaacttggtgcaggacatttcttagttaatgattcaagcatcacctgaacagatcaattgaagtaacaaagcactgtgtattgtcattatatagcatccttacatttccaaggatgcagctgtcccaaagaattcttacccatgggctgaagaatttgcattaatctaaagccaagctctcagggaagctgtgtgcatttaggaaacagcagaggattaatggaacctcctagcctgttgcctcccaacttggccttgttccctgcagcacaaattaaaatcaattgcttgcttaatatgagtctcacccttctccatcttttctctcttagatcgtaccatgaggggttttacttactgttaacttttctctcttagattgcaccatgaggggttttacttactgttaaagaatgcttgtaaagtgtgggttaactgtgctaagaaagtaatctttattcttgggtttggaaaatgaaccacttttggcagatctttgatgttttcagagatgctagggttagaatttctagatccttattttccaggctaacaattaaattaataagttaaaacattttagtagtttataaacgcataggaaaaggactggatagacactaatgtcaaaagggagacatagaaaagagaatgattgtgttttactctcataggtctataatctttacaatgagaatgtgttttatattaaatagttgtgtaataaaaattcaaacaaattttattctggtcacaagcatgctttctgctctgtcccagacaacaaaaatgacccacattctctctactatgttcacttagctcatcacactctgcctttttaaaaacaccttttgatagaaaactttttgcaaatttaattttttaaaaataacctgctgactcactggtttgtaatggaggacagagtcctttctagatcctcgaatttcgtgcctgtctccaaggcacatccccacatcccgtcacagtgctgcaggattagggaggattgcttccagctgaaagagatgggaggccataaaggctctttcttctggatgacgttggaaaggaagaaacatggagttagaaatgcttatgtctccacacgtagcctcttcctgggcaaccctggacagtctctgtctgccaaggtgatcattgtacttgcaaatttacctaacctgttgactgcctgtgttacatttactattgaaccagctagagttcaaaattaacttttgatcactgactttcagtttgaaccaaaaaaataaaaagaggaaagagccacgtaaaaggaaatacagcttgatttcatttttttcttgttttatttgatgaactaaattgtccattcttcaggggctcagaatagatatttccttttgttttgtatcaaatattaaagagagtttgaccttctttgcaggtcagaaaattaattagttaactctggatattgaatatgccacaaagtagactaaaatacttcagatcatttctagaatgaggcaaggcctaaagaaataaatcctctaaatcgagtgaggttggccagagatacctagcattttatggttggctgaagatacccagcattttattaactctttatgacttctttatcacgagatttgagtcacctgctactaagacacataaatagattgtttggtcaacacacaacatgtggattaaagtataactttcagaggcagagaatccaaggggtaaaaataccacatttgctcagtattctaccacagtgcggtggcacaaggtggcactgtacctggattggtcttatttctgtttcctagtgttgggggtaactctggactgcattatgctggtgggcctatagtttgtcttcaagttttttaaaaatctcagtcactaaaaaaaaaaaaaaaaaaaaaaaaaaaaaaaaaaaaatctgtagttccaacatagctctaatatctacttatgtgccacagtgaatttcaggcaaaatatgaccccacgaaacagacctccattgtgacagtacctattataattaaatactcattcttgtgtaatccattttaataataactgtagccaccaatatatgtgtgaggcaaaatgctgggcattttattgccattataactgataacaacaacctttcatggtaggtattactatcccaatttacaaccaagaaagtgacagagctgatgattgaaaccaggtttgtctggttccaaagcctaggacttcatagcagtcattcagatcgtggcaccgtatttgataaaactttagttgcaaactacttattcctattgttcttaataaaagcccattatacgcttgaccaggcatttaaatgtttgaaagtagtataatgcaatactgattggtttgtcttttacataaatgtaatactgatttatttttcccctttagccaccagctaagtaccttcttccagaggtgacggtgcttgactatggaaagaaatgtgtggtcattgatttagatgaaacattggtgcacagttcgtttaaggtaaatcaacataaaaaaaaaatccatgatctttgtgatttgataacaattgtattggaaaagggaaaacaaaaaggatgaaagcttatggtggttagtgtgtgacttcactcttcatgtagaaatcccaggagctgcttattaacccaggtgaacattaactaaagtagttgaatattaacataattagtttggaaagaaaacactaagctaccaacatcactgggacctcattcttaggaggtttgcattttccaatgctgtaaccgctgcagaaatacttttcaggtggcacaaggcactcagtgcccccaggatactgtttatatttgtcaagatgaccagagtgctatgtgttttattgggagggggaggggagtctctgttggaaactgtcaaatgacctggtatcatggagattttcccagattgatttttgaaagatgtccaactctgaagaagacttccagacttcagggcatctgaacagattcagccatttaatttgagcatcttcatgacaagaagtggctggggttttttgcaagcttcacagctaaatgagtacccaccttcaggacttccctcctgaagggtgtggaggtcagacactcttccttcctgtcaccttccctgatctccatcttcctgctggaaaaacagcagaaacggcctccatgcaggaagagctgtggcgacactgttaagaaatgagttagttaaccatttttttttgacgtgaaataaattgtataaaagaggcaaatgatgaaaagtttggaaataggagattggtgttttggggagaagaagcaggtatttaggattctggtcttgttttccttggattatttctggtaatgggactgctctatcattgtactgcattcctctttcccccaccagcctgggactccccttcactgagagacatgaaggtcaccatccatgatggggcatgtgtctcacatgaaccatagtcattccttacaagttgtaggaagcagaagagctgtcaaatgtgcccaaacacctttctaccagaaacatccttctttgttcttctcactaaacagagacctttctggtaggacaaagccagaaaattgtctttgagtcctttgaagagtggagaagagaccacactgacctctagcagtgagaaattgccttgttctggctactggggcatgcagggaccacctcattccctagcacttgaggaccagccccttccatagttggtccaggggatatggtgactttgtgtcccagcttaaccctagatagcattggaagccatttctcccccatgggcaagttgctcaggacttttccaagtctctgtgaaggaaagcccttcagagcaggggtcggttgccatcacagcatagagaactccctcccaagcaactgtgggagtgtaggcaacactggccagatcacctgatgttactgaggattcctggctccaaaggcaaggccctggtagcccccagtgtctctagcacctgctcggagagcattgatgccacaagctaatgtgaatggtgtttcctcatttcttccctcccctggcctgcctacatttgcaaccagaatattctttatggtttttaaagttctgggcatttcaaagtcctttgagaatctgaaagctgtgaaccctcttcccttcgaaaatgtacatttgtacaatgcataggttcatggatcccaagtgaagaaccctagctgtagcagagtctcctttataccagcaggagagaggagagtaagggtggtgcttgctgtaagctggggaatggtttttctctttttaatatactccgtggaatgtgattccataatctaatgccttgggagagtctcttccttcagtctttccttttgttttttagcatgattctgattttagttgtgcaattatatgatattaaactcatccttggccttccaactctgggagtaaataaacagtgatcataagctaagtgcttagtaacggtgctatgacctagcattgtccatgtttttttgttttgttttttgttttttgttttttagtttatatatcaacaaagagggtttgtgtgtactgtgatgggcttaaaagcagacttcggttcagagtctgaccagatgctgtacccctacccctgcccagaggccaccacacacaccttctccttccttctgtctctcttctcttgtccaggggtttgcaggctgatgattcagttgggcctgttcatttaagtagttttgtacctaatttgtggaattccattgagaactgtgtgtaagttcatcattgagaacgtaatgactgctgaagaatcatatttgaattttaaatgtcattaatattgtcaaagagttatttaaaatatccagaagtttgtgggtgtgctggatgttgtgttccttggagcggagcaggcatagggtgggctggctctgtacccccacccaaggcaggagctggtgccaggctacctgggagggcctgaaatcactgattctcagtactggactggggccatgggcatgcatcagacccatcacaatagctaaggaagagaggagaaactgaggtccaaggagaggaagagcctgcccaagggtgtggcctgcggcctctgactttacccccacatggccttgttactgttttgagtccgtgtggccatcttctcctgctgagcagcccatcgcagggcagccgccagttgtgggtccaagtacaaatagttttccctcaagcagcactgtcctcggagcccattacatgctcagctcctccccctggtggctagcagtgattccccatcaccccagcaagactctgggcaagagctggagttttcaggagccccatcctctagccaggcagtgccacactttttggttgaggccaggcaggtgatattggaccaagatgctgaaaatgtaatgacattcacagtggaaaataatgtgctttcctgcttgtgcttattttaaggaaccaaggcatgcttcatcatcctcctcctgaactgttttttccaataaccaaaacattggtctaggcaggcttttttcttgctaaaatttccagagtttttttgttccttcagacatattaattatagtctcttttttctctagcctattagtaatgctgattttattgttccggttgaaatcgatggaactatacatcaggtaagaaactgaagctaaatttgagtttcaattaagattttttagtacttacatttcctatgaactttatttctaaattctcatttcagtaataactttattacggaatcaaaaggaagcatactgtaataaatacaatgtttttctttttttcactccaatgaatttattttatactgagattataaggaaactatagtcgtaaatattagatgcggttgcaagttcaaatagttctttgatttgaatttcagaagtttccgtatcccccactggcctagcttgatggtctaattaacttccttgtgtaattgctttcggctactctcctagcaggcaacaggaaaatgccacaagtcacccacttatggtggactctcgggaaaaagtgtccattttcaatgccagctgctccagactgatcttatcattcctgcatcgttttctccagagaatctttagcaaatacccaccccaaaagaaaaagggggaagggtgtgagttttcggatccgcaggctgctatgaataaagatgccgtagtcagttggcatgcgtcttcgttgcttctgattttttttccttatctgcataaagctcttccggaaataacttcatttatgaacaaattgggaatgttgtaggaaaactagctttagaggttgaagctggggggcttttgtcagattttccacagggatgatctaaccatcttccttgtcaagtccaaggtcttaaagggagcgtatctggcctgatatcccaggaaggagactttcctggtacttgagccacaacgggatgtcttttcttagcaatgtcagtagtctttggttcttgagtgcaaggtgtcagaactggagaaagcttgggaatcagctggtccagctgcctcattgtctagatggagaaactgaggctccgccagggaaggggttggttaaaggtcatacgatgggaagaattaaaatgaaaattccagtctcctgcctcctggcccagggctcttttcctgatacgcaagtcccttccctcccatgtccttgctttcttgcttattctccaggacatcctgccaggaaacagtcccggggagaggcagcttttttcctagtgtttccacacttcatgcttttaaaagccatcacagagccaaaacggcaggcacttgggcatttaacatttgcaaaagcatcaactgaattaactcagcatctgagaagcagttaaggcttctgcatttatcatcttggcttgtgttacatagtgctcatgatgagacaaaggagaggctgcccaatggcatagcaagaattaggagagaaattaatcctttgtaccacgtgactgtaagcatgactggcctgcccactgctgacccattcttgcaggagctcccccaccctccatcctggctgtgctgtgatatcacaaggtcccagggctggggtcagaaattctctcccgagggaatgaagccacaggagccaagagcaggaggaccaaggccctggcgaaggccgtggcctcgttcaagtaatccaggataggctgtgcaggtcccaatgggcctattcttggttacttgcacggggacgcgggcctggacgccggcatccgggctcaggacccccctctctgccagaggcaccaacaccagagttcacaaatcagtctcctgccctttgcatgtagcaaagcttgctttccaagcaggactcccagggtgactgaggactacaggccacacccgtttgctggcaacgaggagtcttgtgggcaaagtgggagtctgcagctgttgcagccacaggccctgccctcagccctaccccagcctcccagctcctcagagctgtgttggcacccgtgctacgacatcctgttcctccagcccctcgctccaccctcagccacaaatccatgtccacctccttctttcagtcacccatgaatttcccactgagtcctggccctcctgagctcctgcttctggcaccttgaaaatgacttggttctgtatagaattcctcggccagcagcacacccagcatgtggtgcagagccctcatctcccctctgctgctcctcctgccattctcacctgctccatctgccattcaaggccctaatgtgcccactgtgacctgcctctcacttcatcttcagccacttcctctcccagaccctgctgctccggcttctctcactacctctgatggctgggcacacagcctggctactctctagcttctcaagtattctcaggcctcgggtctcaccctctactgtttcctctgcctgaaagcccacttcttctcaaccttattggcctggtgaactccttcaaggtccaggccaaatgttatcttctatgatcccctccccttgtgaggggagttaattgtccttaatttatccctctactacaactttcattatgccatgtttatttttatatgtttttgcctatgtctgttctagagtatgagctcttcaagggcaaggcctgtgttttattcatctttgcaactacatcaggctgagctcagagctgaggctcagtaaacatgctgaattgaattttaaagagtttgatttattttagtgaagtggctaatttcaaacggaatttattcaagtttgaattagttcttccctcctcccacttcctctgtcttctctcaccagctttgccttctctcccatctcccttgtttccccagattcattcaggctccctaatcaagaacctatgtatggtctgaagcctggcctcctcactgctaccccctggcctggcctggtcaaaagggtgcacagagcccagccattctagaaaaggctactctttgcacccctctgctcagagacccctcctgatggattatgtctggggtccaggaatagcgatggtttcacatcccctgaaacataccaagcccaccctttatggtgtcatagacagcttcccaagctgacaaggaagccccttcttgcagctttgctgggcctgtgcttcaaccccagaccttcctagtaagggggatgtccatccagaacagaaggtggcagccggagcaatcccagacctgctgggcaatatgctgggcctggacctctgaaaggacaacacccagaccgtggcccgtgcccacacaggtcctgaccctcagcaggtgccaagaaacacacgtgaaatgaatgagtcattacacacaaacatggtacaacccttccatttgctggccctgaatatccccaagaccctcacaccatggtcagcttctctttttcccttaggaggggcgtctgcagtgaactcagacctggagccctgtctgaggagtgccacgtctgactccatagcccctcatacagtctaggcctctgcctgctatgcatagacctgggggagggaggcaggaacctttgtagcaattcttcctacagtgggcatttgggccccaggccatccccagcaactgccacatctgaccagcctgctgtctcctgccattgcaggtgtatgtgctgaagcggccacatgtggacgagttcctccagaggatggggcagctttttgaatgtgtgctctttactgccagcttggccaaggtgagtcctgcttcccagccccacactcccagcctggtactcccagcccctccacccctacccccaatctgtcaagcagccctttgttttggtgggggaagccatttctatggtgacaggttcccaccccagatgggatggatgcaggccatgtgcatggtgccagtctgaaagccttctgggttaccatggtgacagggagcacttagaacaaatgctccatgaagttgctgtgtgcagccacctgaagctgggtgtccacagtccagagaatcacaaacaggtccagtgtaatggacaaaggatggtgtacccctcaaccattgactgtcagccaactgctagaggcccctgtgtccttgggttttgctttcacagatttgagggagaagcaagtgagagataagtgttggacactcacccacatgcttgggctgaatgagagttccaactgccctaatgagctgtatgatctgaggcaagttacttcacttctcatgtcagtttcttctataaattggggataattccagctaccttgtggctagatcacatgaaataacatatgtaaaggacttagcacagtgtctggctcacatacagcaagtattcattgagcacttgctgtgttccacatactgtgctgggcattgtcacatgataagcactcctgatgttcattattttgtgttacaattatttgttgatgatgataggccgggcgcggttgctcatgcctgtaatcccaacactttgggaggccaaggagggcgtatcacctgaggtcaggagttcaagaccaacctggccaacatggtgaaatcccgtctcaaaatacaaaaattaactgggcatggtggcgggcatctgtaatcccagctactcgggaggctgaggcacgagaattgcttgaacccagaaggcagaggttgcagtgagccaagatcatgccactgcactccaccctgggcgacagtgactccgtctcaaaaatatatatacatatatttattggtgatgataaaatcattcagacatatcttgatcctaaagcttgatatgaatctgacctaaaatctacactggctctgatcaaatagaatggtttctttgtcctctccactgtttaaggaaactagcaggttcccaagcctcccagtatggtttagtctcccccttcacaggtgtggcagggtgcctgtgctgtgtggggcaggcagggtaggccttgcttctcccaggagatctttgccttgaccatttcccaaactctgactctgatggggctgacaccatccatttgttggtagcaccacagttgtctccatgggcatctcagggaccctgagtggtcccaaagatgagttttctggggcccaggttaaccatttgcctgtctccaggacatcacacagtagcttcctccgccatgtcctgcttctggacggtgccctgatgcccatactcccttctcttcctctgcatgttccactgctttgctggcctggccattgctggttgggtccatctctgtgatgattgaggggcgggagagccccacttgcacaaatgctgccagacttatcaccaggccttagagcatgaaccagtggagtgggattcaaaatcctcgtccttatttttgcatttcaaaaagagaacaaggcctcagggaaaatagagtcttccccagtgggtaatctttcagatgagtggtaccaagattaattgttatctgtagcatcagtggctcttccaacagtgctctgggatgctgaagggcctgaagtaataaccaaagaaataaacaagaagattgcaccaatagcagtgaagtgagagctgttttttgtttgggaaaattgagaacactcttccttggcattgtccccagcatttgcttaaacatccttgttcggttactcttcctggatggctcccacctgccccaccatctgtctcttcaacccttctcttgctgctactccagccttgctgagccgaatcagctcccacgtgcagccttccaccctctttcctcgctgaggtacatgtcctgctgatgggtggtcatgcccctgtccttggctctggactcggcttccagccagcagtagtggtgcagtggacctccttgcctgctgcccaggagcccgcaggaacctcaagctgactgtcgtagcctttcagtatctgcttcattgtcattccttccttcattcacccagcaaatatttacttagtacctattgtgtgccaggcacagtactaaatactggggatatagcaaagaaaaaaagagacaaagtccctccccttgtgaagcttacattcttcacattcattctctaaggcctggaggcctcagactcagacactcttgaaagataggtgctaccacaagtgttcatgattatgaggaaatagatcatctttttccatttagagcaagcttgtccagcctgtgacccacagggcgcgtgcagcccaggacagctttagacgtggcccaacacaaattcgtaaactttcttaaaacgttaggagattttttttaaagctcatcagctattgttagtgatagtgtattttatgtgtggcccaagacaattcttcttccaatgtggcccagggaagccgaaagatgggatacccctgatctggactcagttgcctacaacccacccacgtggcccctggttagcctcaccagcagatgactgtagtgccctgagctctcacctcccttggccagtaggaaacacagctgctcctggactctgcctcctacaggatgtccttggagaggagaggatgttcccacggaatcatagctgctgcttgcagctttgcagcccacgtcccacagctgtgctggcacttgctctgcactccactactggccttcccagcgccaccagccacaggtgctctctgcctccctggcagagtcactgggtcccgctgatgcctggttgtaccccttacttggtcttggtgcaggggcctggcctcgtgtcaggcttggcaactgctcctgtttcttccaggcctagccactcagtatggcccactcttttaggtatcttcagttatgaggattttctctcagaaacccctttatttctttctccaagcctgctttgggggaaatttcctaggtcatgagagagggccaggcaggatgatccgcaactgtgagctgggctcaaactcccatccagctcctgggcttcaaggaagtggatgggcatctatgggagtggacggctgggcaccatcctgtcactcaggggctggtctggcccaagtgcccagaggacctctagggggcagtgtcatgccattcaagacacattggagccagctcattcattcagtggtgaaattcatgtttactgagcccctcttgtggtagatactctgggaggtgctagggatgtggtggtggggatgtttcaggcctgggccctgacaaggagagaggaaatcaagcaatcccacatagtactccactctgtgagggaaacaacccagaaaggaagatagatgtggctctaggtggatgggagaggaagtcaagacctgaaaaaccaggagacagatgttctgcaaagagctggggagagaatgcatgcagagggaacactggtacaaaggtcctgaccatactcaaagccagtgtggctccaggggctccagatggagctcattcagctgtgccatgtgggacgcagcagtgaggaacgtgggccttactccaagtgcggtgtgtagacagtggagagttttcagcagaggagtgacatgatggcacatatgttttccagtggccactctgacagcttctaggtgaatgggctagaaaggaggccccgtgggaaagacaggtttttcacgaggctcacacagccatcccaggccagagattcgaggcccaggctaagggtggtggcaatataaatagatgcaaatggagtcaggctatctttggagatgaaactgacaattcctgatggttggatgtgagagaaatggaagaatccagtgccatcttatgtacacggagaggaaaataaccaggatcctaagacacatctaattattaaatccatttttaaaaaacgtaatctggatcttgctgctgtagttcagggtttggggggctcttttaaacacccagccttcattgtgacacgtcttttccagtatgcagaccctgtggctgacctcctagaccgctggggtgtgttccgggcccggctcttcagagaatcatgtgtttttcatcgtgggaactacgtgaaggacctgagtcgccttgggcgggagctgagcaaagtgatcattgttgacaattcccctgcctcatacatcttccatcctgagaatgcagtaagtggccccaaagaaagaaaatgtcgtgctccatctgagccctctgtcttgccaggcaggtaccacttttgagcacctacacaagaaggtctctgggccttttcctaatgaaatcccagctctgccatttagcagttgcgtgtcattgaccaagttatttaacctcactgagcctcggttgcctcatctgtcaaatgggaattataggaatgctgatctcataggatcattggaggttgcagtgtggcaatatataaaaagcacttagaatagtgcttgagactggtaaatgctctataagcctgtatcgtcttattgacatttttagtattgttattgacaagggttctgctggcagtaacctcctggagccagctactgcgtaggacttcatgacccctgtagactaaggaggcctggttgatctctttaacagaagtatttcttaagaatgaataggccaggtgtggtggctcacacctgtaatcccaaccctttgggaggccgaggcagatcacaaggtcaggagatcgagaccatcctggccaacatggtaaaaccctgtctctactaaatacaaaaaattagccaggcgttggtggcacgcacctgtagtctcagctactcgggaggctgaggcagggcaatcacttgaacccgggaggcggaggttgcagtgagctgagatcccaccacttcactccagcctggcgacagatggagactccgtctcaaaaaaaaaaaaaaaatgaataaaacacttcaataaggtcttcaaataagactgccaagctttgctacctcatcatgatgtctaaaaagcacccattgggaacatttcattcataaagctccctggaccatggcagctctcggtgcctactcactgggtgcagcacaactctcagggcaagaaggactgccttcctgcctgctgcctgacacttccaggggaaaagaggccaaccagggcctctggtgactgctgacccctcagtctctgccacatcaggcccctagaccaggcatttttccctggagaggatgcttcctctcaagcacaggcttctcagattctacaaaagcctgcaaagtcctttccttgaatccagaactctgcagtctcgcttataaccaaaaaaaattcaaactcaattaatttggctagtgtggaatcattatttgaataaatactccaaatgtatttctatgtaaatgtgttcattttactgagtaaatcaaattcaacataatatatttggtaacgtgtctctaacagataaggattgctttttaatataatcacaagtcacggtcagatctgacaaagtaacagtttcttacattgtctaatatccagactgtgttcatattgtccctatcatctcgaagtgttgtgcatttggagtatttcaatcgggatccaaaaagatccatgcattgctttggttactatgtctcttcattcttttgcaatcttaacacgtctccctttcctccccttttctcttttatgccatttatttgttgaagaagccctggtgttttgtcttgtagaaatctcctacattctggatttgtccagctgctgtcttgtgatgatgtttaatatgttcttatagccaccttatatcctctaaacaagtaattagagctctactgcttgattagattcgattttttttttttttgcaagaatatatcatagaggccagatgcaatggctcacacctataatcccagcactttgggaggcccaggcaggtgatcacttgagcccaagagtttgagaccagcctgggcaacatggcaagaccccatctcttaaaaaaaaaaaaattagccagacggggtggcagacacctgtggttccactgtcgttccagctacttgggaggctgaggtgggaggatctcttgagcccaggaggtcgaggctgcagtgagccatgttcatgccactgcacttcagcctgagtgacagagcaagaccctatcccaaaaaaaagaagaaaaaaataatacatcatgggtattatacgcttatgaagatatcatatcaaggaggcataaaatgtcaggttagcccacttttaaagatttaaaattcatcattgggttcaggtggtgttagcctgatccatctattataaaattctcccatgaacctttcacctcataattttagcagttgttggtgatcattgtctacacccactatttcatgaggaattgcaaaatggcaatttctattttcagactaatgagttggtgttctagcggcctccaaaagtagccaataatttttttttagtatcattatgaactcatggatttgttgtagtttcagtccatttattattcttttgcatgctctaattttcacctttggctatggacactaataacaagtctttgatataggttgaatattctttatctaaaatgcttggtaccagaagtgtcttggattttggattttttaggattttggaatatttgcatatacataattggatatcttggggatggaaccaagtctaaacatgaaattcatttctgttttatgtacagcttatacacatagcctaaaggtaattttatacaatattttttataatttggggacactaaataaactgtgtatcatgtgcctgtgttttcactaccacctggcacacgaggtcaagtgtagaattttccacttgtggtgccattgctcaaaaaattttggattttgaggcatttcgggactcagatttttcagattagggatgctcaacctgtagcttccttactttcttaaacaacaagatgttccaggctcatgatgaacatttcttgcctcagccctggaaccagccatttttgtatggtgcctggtccctattagtggaagtggtatttagagaccacagtttaggtggattttcattgctaatgggatatactttacttctagcccatactacagggcagagctaaaaatgacatatttttagaaagaaaactaaatcataagttcatactggtttttccaatacaacgttacgtttttatgtaacttctttgcttgttttgtttttgtatccctttctcttatgctgcaactcttgatttctaaagatattaacataattatataattgatctgtagtgtatgtttaataatttcagtagcggtactaaattatggctaataataagacaactctatgcagtttaggaatttttagagagatgtacagttataacaccatgttttaaaatcacttgaatgccaggcttggtggcttacctggctgcttgcaatcccagcactttgggaggctgaggagggaggattacttgagcttaggagtttgaaaccagcctggacaacaaagcaagatcctgtcgctactaaaaaaaaaagaaaaaaaaaaggctggggtggtggctcatgcctgtaatcctagcactttgggaggccgaggtgggtggatcacctgaggtcaggatttcaagaccagcctgaccaacatggtgaaaccctgtctctactaaaatacaaaaactagctgggcatggcggcaggtgcctgtaatcccagctactcaggaggctgaggcaggagaacccaggagttggaggttgcagtgagctaagatcacaccattgcactccagcctgggcaacaagagcaaaactccatctcaaaaaaagaaaagaaaaaaaattagccaagcgtggtgccacatgcctatagtcccagctacttgggaggctgaggtggaaggatcacttgagcccaggaggtcaaggctacagagctatgattgccactgcactcaagcctgggtgacagagtgtgacgctgtgtcacacacacacacacaaatcacttgaagtaattgtgtggttgtgtcaccaattttatatacacttagattcacttttattgctttttttcttaatggtttaattgtattttaattatataacacatttacatggttccgacatcaaaactataaataaagacagagaagtgtgtccatttctgccctctcctccactctctccccatcccctaggcgtagtcatttctttattagtccttactttatttttcaaagttacgtaataaatgtctatgtttctaagctatctttagatttgtaaaagggctaaaatgttacttttaaacatgtttggtttattcaaatttgtttataaatctctcctttgtacccctggctaccacccctccccactcctctgcctaaaactaagggaaaatcctgtctttgcccatagcttcagaatgttctgcaattttagacttttacttttaactgatcactgttaagcaagggaggaaatttaccacttctctttgtgatgtaatattgcacagtgaccctaagtggaagccttcctgtgtcctggatgtgagctccgcgctgtcagtggttggcttgtaagctctggctccaagtgttctgaggtgcaaggaaccgatcttgtgcagtagaaagagcttttggaagttggcaagtagcaaggctagttctcatacattctatgctctggccacctttttctgtggcaggaaaacaaaacaggcaaatgcacacaaactgggtacatttaactttgcctccctgagccatctcccaagccatttagctttggattggcctcaatttgaacaagggaacaaacaaaatcatgatgataacgatgatgacaccagtcgtccttactaaagaaagtgctcaaagtccgggtacccggttaggttaggagcagcccccagcgctagatgcagtcctgctgcctcctccatgcactgtcttccaggtgcctgtgcagtcctggttcgatgacatgacggacacggagctgctggacctcatccccttctttgagggcctgagccgggaggacgacgtgtacagcatgctgcacagactctgcaataggtagccctggcctctgcctgcctcccgcctgtgcactctggaacctctggcctcaggggacctgcctgtcctcagctccctgggagctgaaagtgaggatactccgtgctccaggccacagggtgaatgtggccatgcctacctgttttgtttttttaagaacagaaacaactattttaaaagaactcttttaagaaatttcataaagggacatgcattttactgggtttgcttttcttaaaacataccaaaaaagaaaaaaatagaaaaaaaaaaaaaaaaagcttgatctctatcagacttcctttcaactgtcctcccctccaagcagaccacctgtccccttctatcccagctcagagcagctgacccaactcagaatctctttcctacaggatgaagtgccttttgaatgttattttaagccgagagttaatttttctacacaacatatttccagacatcttttagtcttttattgtcttagatactataagaagatgaacatgacaattttctagaacctggtagcgtgtgtgtgtgtggcggggggtgctgagggaggggagtgagtcacaggagcctgtcccccaacaggtgtgactgctctgacaacctgtggcatgctgcagggtcaggctcctgataggaggatttcatgactatgtcattgtctccactcatttttgacccagtttggaatgtatctgcaattgtgtggctcaacactttaggaaacaatagattattttatattattatttctgatggtgacaagtttgtcttgaggtcacattttctccttgaaaagtgacatcctgtcacttctgctctcacactactgccatacatttgtgttttttgttgttattgtttgggtagagcagttacaagaaaccctaaaacccttggatataaaagaaatctgtttattgatttttaaatctttcctttccaaaagctggatacacatggagctgtttgggaattttccttgctgctaccgcgctgccaccaaatggaattgaccagcggctgttacactgttctttgccactgtgcctatgctcagaatatgctcactgctaagctacaaactcggacagggtcagaaacagaggtgtcccatcccattgcagcctccaccacctgtaaccccttcctggcattggccactgaagggtacaaaggcaaaaggaccacagcaccacttaggtgtagcatggattttaaactgcagtcagtatcagatcctgtttgataaataagctgactgttctctcttgagaacctgtggcctcaaccagccaccaagctgatgtggcccaagtccatctcttggtcttctcctttgaagcacagcctatttctgagccaagggttggggaagcctgtctagatgtgggactcattgccccaaaccagggagaggaagagctcccacagggagagcccaggctctctttgcagcctttcccagtttggtgtttaagcagtgccatgttccttgtttgacaacaagacagtctgtaaagtattgctcttaaaaacaattaaaaagaaccctttcatattggcaccattgccttagtcctctgtgggttggtcttcagccagcattctggtgggagtgactggcattaacaagactggaaatcgggggtcaaagtaaaatatctttgttttgctttcattcacaaagtaatgaagccagctgccaattacatcctcccaacagcactttggtctgtggactgctgtgtgaatattcagaagggaagtaagtattcagggggtaaacaggtctcccagcattctgagtgttccaaaccagtaatccacatgccaattcaaatagaacagccccttgctagatattaccacagataatgacagttacatggtagaactgcccatgccacaaatatttatttggaaaagtagtcattaaatgaacccactgccttaaatgtcttgaatgttgcagtcaagtgtctgtcatgtgttgatatccacacagaattaggccctaatgagagccttagaccctcaaccatgcccccttcgttggcatcacagggccttatttggaagagcgggcaaagaggatggaaatcataaaatatttcatgggaatcgaacctagggatagtgctccacttctgacgatggagtgaagacacttggcagacttgagccagacacttcacctagtagttcctgaaactgtgagcaccactgcactaagccagtgcggagctgttagggacgggcccagctcctgcaccacggacacagaatgtctggagagggccagcaggccctctgagggttctggaatctgtgcaccttatttgaccacactccaaaattctgtttttattttaacccttgaatctgctttatgtacataatcaaaatatctatatctatatctatatctatatctatatatttttaatcatctacatgtaaatgaagcaatagaattctaacataaggccaagaaatgagacgaatgtttggggtttatgttttttaaggtaaatacgggtattgtttttaattattaccatgtattaaattgtgggctttgaaacctaatgaaacctgttagccacttctctgtgccatatacttcccatgttaccaaaatacccccaactctttagccaaaagagaaccctgacctcctgagtttccatgctcctttctgtaccaggtttaaatgtagtcttctggagaagtatttttgacattgagctctgggacaggacaccttgggtttgtggactgcagcccactatgatgttattacttctctggccaggcctccagtggaagtgcacaggcactcccaatgttgttaatgctctgtcttccatttgttctggaatcctacgtgttggtctgtggttccatgcattagctgtttgtaaataatgcatttgcatactgaaaaaggaatgccacctgccacagttgatggtgaggaagctcctttgacgtggtgcaattttgatgagatgtctctggggacacgaggatgccctaatgatgctgacttgtcatggttgcagcatttgaacttttggtgttaaaaaaaaaaacctgtaagtctgtaacctggcaacattttacaaccctgtatttttaaagatggctttctaataaaaaatccagaaccacacagccctatggtcaaacaatcctacgtttgtgcctctgcttttaaaggtgctgtgctggacagttggcatgccagggttcgagaagagtgaatggcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgca

SEQ ID NO: 36013 - DNA, 25339 bp, Homo sapiens
cagagtttcgccatggtaagaccgatagttcctaactcctagtatatctgcctccatcatttgaaaaagggccgttctaccttggcgatgtttcacttttcggtcgcccctacttggtgggtgggaatgctgctggtgctgcttcaggaaacccgatttggagaggggaggtctgagaagagtgtgtctcgttgtgctcggtctgggggccgtcacgtgagtccatccttgacgcagcccggcagtggctttttacccggattagcttattttcacacgttgaagcagcctcagattcgcttggagagcactgtggacgctctcttgacggatgctagggagacccgccaagttttcaaaggtctgtgctttgcgtggtctcttctggggtctggcaggaagtaatatttgttcaaaacggggcttgagtatgggctgggcgatcttttctccttgagtcaggtattacccgttagcagttcctacagctgaagatgagggcatttcactgtcagcggaaactaatttctctgagtttcgtgtccttttcaggcccggggccccaagaagcacttaaagcgtgttgcagcgccgaagcattggatgcttgacaaactaacgggtgtatttgtgagtataactttgttttttgtggtttttttttgttttttttagtcaagagtgcatgctaaatacctgtggctcggtatttcttgggggcggcgtttgcttgtttgttatgtgggattttcgttggtaaagacttcccgcaccctgaacttgtccttgcacttttctgtgcaacaaagggccaggatgtcacgtcccgatggtttcctttgctcttttagctcgccacttcagagggcacttcctgagcccagagctgggtgggttaatgaatgtgtccaattccacataagaaaggagttcagtgacagtccgctgagtcccccattaataatcaaatgcgtttaatttaaagttaccccttgttttagagggtggagtagctgctttttacgttgagcccgagttactggtttaatagtaaaggctacaggagcccacgaaacaagggcaagaagttgtgtgagaaagtctggaggctcttgaacccaaccttgaagacctggcaggatgagggcagtatactcagaggcacagtaggcaagcatctcacaaggagactaggcaatttccacattgatggtgtggtcacactaggagagagtggttaaaactgtaaagtcttggtcttctgagacagagaggagccagtgtgaagaagacagaatcgaggcgcttaagatgccaagggttttttgagcaggaataaatgtggtaagagactatatttagctctgagggtctccatttaggaggcacttagtaactaacttgatttggcctcttcttggtacagtttgaactctgaacactgagtagtagaaacttgtcttccttgttctgatattttcagagagaacataggcagtgtgttggctggggacctggatttgcaacctgtccctgtcagtttctgcttccaagtgctacctctgctactgtcacctactatttgacctccctggatgggccattgttttctctattgttaagtggatgagcaaggcactctttaagaagacttgctgggaacttggtcccttagtcttgtgggttcctctccttttccctgtgacattgatgaaagtgtgtggttaatgatcgcgagtccgttttaagagagacaaagctagagagggatctgtagaagcagcttgaacggtctccattggaagagattcttgtgtgatccaaacttaaaaggtaattggggagtggtgttcaagacagaccttgagacttttatatgtactggtagcagatatcctaaggacagtataacaccaaaactgcgagagtataggttacaggatttgttgcggtgtgaatttgatgacacttaagccggcaagcagccaagagaggaggaacgcacattgggtattacagggtggtcctgcaacatcggcagggcttgtgtggaactttgaagcctggcatggtgagagagtagtagaatatgtcttcataaggttttgggtaaagcgtaagctacacttgagatacatgggatgtagtgttgtgttcaagggaggtttgaagaaggagtatgagtggcagtggtgcttggggcagggcaaaatggggagatggttgtgaggctagatttggggaaggaaggggcacaaaatgagatttccatggttggggatatgaccttcctaacaagacagacctctaaactaataaaataattgccctcttgtattcctcttccccacaacaagttaagttcagctgaacttatgcagaactaaagtacgtcatctgctcaatctggttacataaggagtggatcttcttagattaggttacctttccttgtcttctacaggcacctcgtccatcgacaggtccccacaagctgagggaatgtcttcctctgatcgtcttcctcaggaatagactcaagtatgcgttgactggagatgaggtaaagaagatatgtatgcaacgtttcatcaaaattgatggcaaggttcgagtggatgtcacataccctgctggattcatgggtaaggaaagagttctttgttttgttttgaagaaggaacaggttgagagaaggacaagatgtagggctctcatgttgccagtgataaaactggacactgaacttcagatttctgcagaagttactgctggtcctttcagaaggagaatgagggatagggagaggagtggcaaggctcaagtgaaaagctggaaaggggttgataatgtaaatgggatgaggccagcagtggctgcatgctggcggattatcaaagttaggctcctaccttcccggcagagactgggagacagaggagctgtccttaggtgttggctggaacaaacagtaaattcttttggcagccttgagttttctcaggcaggcattttgaggcagactgggctcatcttgagcttttagaagctgtgttagtgttgaggtcttcataggtcaaggttgaagcttagccaagaagagggctcagaggaaactggctaacgattggtcaaggagagaatctttgtcagtgaacagggttttggctctgtcttcccacttcgttgatgacttaactattctggatctccaaggatggatttgcagctttttttggcggggagggtggaggaggggcagaagggtcacacacctctagggaaaaagtgtaccaagagggaaggtagggaaaggtaaggaattctgacctagtgctttgttcacccttttcatggtgaaaggctcagtacagctttttagcctagcattgtccagaaagcagggggatgattactttgtcaggtgtggatgctaccgagtggatggggttccaggccggacattcctaggatccagccactgagttagaaaagacagaccttccttttcttactttccttccttcctcttttttttttttagcattttgctttgtttctcaaaaccccaaatcctgagtgaggcaggactcctgataagcgaagtcatggagggcgtaaatggggccaggacattgattgggcagcctgctgagcctggagccttgcttgcttaaatgtgaggtctgcttgttcatttggtttcctggtatttgtgggtgtgctcatgtatgttttctcctcaggatcctgagtgcgttaacccagcacacagtctcaagcagctattgcacaagaacataggaagcaatagagcagccataaatgtattcactttcttttgttggatgacatgtattgggagaggagcaggggttggttggtttcattcaagcacctccgccaagccctggggactcctaggctgctaaaacgttctcaggttcaacctggcatagagtgttcctgctgtgcaggcaaaagaaactttgtgtttgtgttaacgatgttccttatacccttttgtgatcagatgtcatcagcatcgagaagacaggtgaacatttccgcctggtctatgacaccaagggccgttttgctgttcaccgcatcacagtggaagaggcaaaggtatgttgcacaagtcaagtgagctttgtaatttccagacagataggtcggttgctaagtttgtcagagggtgtttaagccagattccgggaatatttcctatctctacttgtttgtctggttgtttaatccaggcatgtaggtgcacactgatagaaagtaatggattttccacacaagactgttttagaaacgggattacaagtaaggagttctctgaaggacaagatatttctgtacaggaaagatctgtgatattgaccaggaaggcctgggtagaaatccagatttcttgtcattgattaattgtgtaactgcaggcaacagtacatagaaccttttttgagtctttgttttccttgtaaatggtgataatatgctttcctgccaggtttctgtgactatgttagtagtagtgctgccttgcacttgctagacatagaagatgattgactgcctgatgtctgcctctgcccttaaaactccctcttccctccccagatttaatggctgaagtttcaaggaaactttcaagggagttgctttctgtgtggacagcaccttccatttttctgtgtagggaagacctctttggaaaccaggatcacccttcagtcatccattcctcttttccctggatttagggtcatggggtgactttgtttttcacatgacccaatcacttacagtgaccagatgccatctgaatatgagatgcattctgtaagtgaatcacaacgtttcattggatgttgtttctacttagtttaaccagcttgcctttttctctgttatttctctgggggaaacacattagagtccctaaaggaattgacaaatatcggttgtttggttgtttctgacttatttggtcgtgtcccttgatgcagggtccattctgtttttgtggattcgcccacaggaggtactttgttttagatgataggaactaggccttgaatcatgcagtgtgttcagtcgcgtagggtgttggattcttttgtacctaaaaggtagaaagcacagaggaaatcaaatctgatgactggtttctgcttttgtatggaatttggatctcaagagacaatgcagattggtagtccctgtgaatttttaagtagggggagatggagtgggacaaggagatactggagtgttgttaatacctagtactggccctaccagattggccagccagggtgtaaaaaccttgtgtccaggagactatcgcatagtagcgagaagtgccaaatggttgccctgggttacggtattggccttatccttgtgtaacaggtgagagacttgggaagttttgattgagcttatttgtttgctggttgtttctttgggcagctggaagggagcattccctgtcacaaaccccacccagtttagcttggcttgagccaaggacacagcgagttcagagtggagaatcagaggctcctgggacgtcagttatgtcagggacacaccagggagccttttcatagtttattaatccaccaggtagcataggttagtggagagacagaacatccaaacagccctccacccttgaaaataagactagaaaagtggtattttgtgggtcttgggaaaacagcctgatggatttcagacataatatttccccgtaacaacttggtattagttgttgaagaccaaggaaatggaagtcactggatttaagaatgggagattaggtctgtttttgtgggtgattgccattacagtggatgggagaaaaagaaagagtttgggtgagcccatgatgaacttgcacacgagtaatgggaactaaggcagtgcctgttcccattgtgagtgggggtagagagcacaagtatcacctggaagatggcaaagaagacaggggtttagaatatacatccccagctgtggtgtggaggaagcacatgtggaacagggtgattgaatatttggtggtaggataaggagatggtagctgcagatcttggtgaaatacatggatgcttgagagagttgtggatggaaggacagtaccttaatgctttgggttcagcttgccttgcaacttgcaaatagatgataagacagaagtaagtgctgactgaaatagaggactgaaacactgctcaaaagagttacagtagatgctgtctgaatagttggcacagaaacctcattgatactgggcagcttgtgttcagtgataggtgtgtatggggagagggagatttcatattgcagaaggtttatgaacagggtctaggtggtgcaggttctgtttcctgaaaagtagaaaatactggttaaagaaatcaaaaagagaaaatcagagtaaccaaccaaacagagacttgggtttatggattaccattcttgaacgttgagaagactgaatctcataaaggtgacagttattctcaaagtagaagatacgggacagtgactagaaagaggcagaaagagggattttcttttgagatagtgggtgatgtttgcccatttgttttagagaattggagactggtgcaaaaggagatgatcaagaccatgagtggggagactagtgcctttttggtgggcaaggaagaagacaggtggagggaataggcagttgaagtttaagtttcagaaaagatggaacctgggcagttagatctgtttctgagggaggccagctgggaaagatttcatactagtttgtgtaggtgttgtacaaagggcagtggaaacttgaagcgaagagtttatctgtggtttgagagggacagcgtagaatgctctcaggggagcctcacatttgacattcattttggagaatgacaggaggcttcaccttgcagtcaagattgtatggaaagggtgtcaatggggcaggcatgttgtagtaggtggtgatgtaattacaaattatgactggtcaagactgctgagcagacagatggtagagttgaggttttcttgtggtagagtgctattcaacagttaagaataaactttttctctgtagttcttctattaaaataaatctgaaaaaattcagtaatttttttggatacaggtgttttttgggttacatggatgaattatccagtggtgagttctgagattgtagtgcacccatcaccttagtagtgtacattgaacataatgtgtagttatttttatccctggccccctcccaacctccctcatctgggtctctggccccctcccaacctccctcgtctgagtctctgaagcccgttatatcactctgtatgcctttgcatactcatagcaagataggggttttggttttccactcctgtgttatttcactttgaataatggcttccaggtccatccatgttgttgcaaaaggcattattttgttcctttcaatggctgtttttctccaaacttctgtctctgagagtgctcagaaactgacacattctggaggctaccctgtctaagcattttgcttagatatgcgtggcttacatatacctaggctcagctaccttttatttccgtggctcccaaccctctccttttctctcagacatttccttttgtctcagacattttattataagcagttggtttggcatccttcagctcatactgttttgttttcatccattgtatccttgcctttgtggctttgagcctgcctacttgcaggactcaatccgaactctgattcctttaccacatagaggctgagccccatactaggaactaaggattgaactcagagcagtctcctgtctgctgtcattgttgtgcctttctcacttgccagtggtgactcagagggccctacagtctttgggagtcttggggctggaggacagaaggtgatggggtgtcacatctttaaaatctgaagacagtcttttcagctgtgggacagaggaaaaataattggttttctgcagatgttgaggctacccctgtggtaagaggtttagctcaactggaagttcccctcatgatatggccagtcttacccttagtgaacctctagtttcctggcaggatgggcctctactaagcgagaggacccaagatctaaatcctgagctgttttggccacatgaaggtgcataggtaataaaagtcgtctgaggtggatgtgaggaaagcctgctaaagttggcttttgcaggagcactcccactaataaaagtgttcaaaagtttttagcctgccttagtcctggtcttgaagcactggagacctggtcagtcagctctgtatagaggttagacacagaactgttacccgttaatgtgctagcatgcttacaggcatttcactcacttatagatagttgctaagtgtaatctgtatttcacagtcatctgtggatgcttaaaggaccgacacgcatcgtgaagcttgggttaacagttccagacggaactatctcacaggatggagggaggccacttggaactggaggcacctttaaagaaagaggccatgtcttttttcagagggtgtttcacatgtgcagttaaaggccgaggacctttgggcacaaggcttcaagtttgatgttgtgatatagcagtgaactgcatggtgctgttgctatccatgcagaaactgttggttagtgaaaggatctgtggaggatataggagaagaaaaagtttttacttgttttgtttttgctgtctttctcctgactgtcagcagtacctgctaactattttgactcccttagcactgttctcagctcagctgagagagtacactggacaggatgtacatgaaaagtggagggcagcaggtaggctttgaggtgtgaataggccttctatgagttcacagtcatagaacttgcttggacctgtcttacctgggctatttggagctaatgagccagggtggaaaagggacaagattaactttcactggaaatgttttagaatcacccaagtaggttcaggatgtcacatacaaaaaatgtggaggacagttgggtgataggaatgcattcagcaggccgtgatgcaaagacttgcttcatgaagttggaggggcagaggtagagagcttgcatttcagagttctttctctggttatcagggacagagggtttctttctttttttttttttttttttttgagacggagtctcgctctgtcgcccaggctggagtgcagtggcgggatctcggctcactgcaagctccgcctcccaggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcccagagggtttcttatatctagcgtggagtagagctggagagattgaaaatgcccactagtagccctaggttggttaaagtaacactgcattagtaagtggtcactggattggtactgatgattggatagcacattttaaaggtaaagtgcaagttactcttttaaatgaggatggaagagtgaagttgacagattgtttttaagtctggctccactggttgcagaatgtatactgagtggtgtaatctttcttatggtttggtcccagggcttcgggaggtataaggggaaaatgtgttttctctgtctgcttactcagcacctctagccttacttaccgtagactcaaacaaacctggaatcttagcccactgctttggtgcttatggactatagcttcgtacttttccactttagattagagggcaaagagaagaatgggctttgataggcatattataccccatccacatgtattcaccctgaggttgggcaggttagtatccctctgtgcccttgttatatcatttattgtctgaggcagttctgcttggctgcttagtgaacctcctttcagtaccctggacactctgtgtctgtgtccatattctccctctgcctcatctcacgtaagtattttgcctactgtagcaccacagcttgatgattttctgttctggtacataaccttatctgctgaatttggttgcatattggatctgtcttctcttatggggatgtttatacctgattggaaggaatgtgccaagttgtattcagtgtcttaatgacagcaccccctaccctgcctctgcacacattcacattaccttcattacacttgtttatggatggccaagtacttacatcgctgggtggtggggccattcctatagtcaccttggtttgcactgtgtttggtttgctctccttctgccaccattcactccctccaagttccatccaaactttcaaagggcttctgtcctgctgtgccttactatgacaggcagtagaacaaaagttttacacactgtggcctttttgtttgtatgcaagcaggtttctgatgtattgtcctttagggccaagttctggacccaaaggcattcctaaagttaatttgggggtggtacacacagtggcagggcagccggaaaggaggatgtggttttccttttccttttggaagaaaagggctcagtcagcctaattgtcccttgaagtgcttccaacttttcttttaagagctttaattggtatgtttgcatgcagcatctgggagtttcttcaatttctacatttatgtttgacttctgaattatagtctctgaagttttcagttggttggtccagtaggcagttctgatcagggaacttacgcagctttcaattctttgcttaactcactggccaggaaagctggaaatgatcttgagtttctattagtagtggtggtaaatatgaggtggtggtggcaaacaaactgaacactcattggagaatgcctggaggggtgtgtcaactgtgaagttttgatttgaagagcgtgctctcattagattgactgcataggatccaggccttaacatggataagtgggcttggatatgccaggctgatgaattccagatttaccttaactggggagttaatgtggcctaagttccacatgtggaataggagcctttgtcacctttttggactgctggcttatattaaatggcctcacatctccatagcaccttgaatggtgttaaatctatagtagcagcagaaataatattagctgacatttactgctttgccaggtcctttatgttccattatctcataaatttataagatgtagtagtgtgcaataattattcccatcttgcacctctgaagcttaaggggacagtatttcaacttcggccttttttataggagaatgagccaagctctggttactttacttactgtgtctctttccacacctcctaggcaggttaaaagcagtgataagagagaagctggcaaacctagttagtcctgagagcccaaagatacgggagagaggaaatgcagcagctgattaaaaaacaaaaaagtggctcctcgagttcatttattgtacagtttctggagtatttctgtcatcttttcagggagtttttctgtcatctggcactctgtttgtccttgtcattttcatatttacccagaatttgtcctgagacttcagaggactgtactcagtttaaatgtggagtttttaatatcttttaacttttataagctttttctcccaacaaagctgaaagaaaacccactttgtcacttctgagcggtgacagtccatggggagcctgtggtatgtaggatgggcattggcaaccataaatggattatgtttgtttgagattacatagtgtaccatttgaatctcctgaaaattgcttctggaacaaaatggggcttggataactcttgggctgatacatgtacttggtatgagacattttgaactcctcctgctgatagatgtcacgagcaacaccagagtggtaagtgttaaacaaggaataaagcaagtagttaatgggttgtgccatttaaaaatgagatgaggaagagcagcattgtgtacagaaagcatgtagctggccgagacagctgttttacctaacctggtcataaaagcctcatgattttttttttttttgagacagagtttcactcttgttgcccaggctggagtgcagtggtgcaatctcggttcactgcaacctgcaccttccgggttcaagcgactttcctgcctcagcctcccgagtaggtgggattacaggcatgtgccaccacccgggctaattttgtatttttggtagagacggggtttctccatgttggtcaggctggtcttgaactcccgacctcaggtgatctgcctgctttggcctcccaaagtattgagattacaggcatgagccaccgcacccggcaaaagccacatgttcttagcagttcttagtagtggtagagttaagtttgtctctggggctctttgttaccaccgctccagagttgcccattgaggactatcaattggaaatatgtccctgaggaaaaaatgatataccagttgattgtgtgttaccactcagatacacaggcaacaggcttttagcctgtgataaaggaccagaggttagttcagctgagcactcttccagcagccaccagagggttctgaaacagattcccccttggcaaggtttcccaaatgtctaaattactaaatcagtatgggagatcatcagctctgtgactggttaatatagtttttcccaagagcactccttctctgaccgaggaaatgctggaaatcgatgggataagtaatgtctgggtgactgctttaggctggctttgtgtttacatattgaattgattttccttgctgtgtttatagtacaagttgtgcaaagtgaggaagattactgtgggagtgaagggaatccctcacctggtgactcatgatgctcgaaccatccgctacccagatcctgtcatcaaggtgaacgatactgtgcagattgatttagggactggcaagataatcaactttatcaaatttgatacaggtaagttttttttttcccttgtgttgtctgccacctccctctttgtcttttctttttctttctattttattcttctgttttgtctgtacacccattatgattagagagaactaaaacacatttggttttctctaagagcatattgtgtcatggtctcttgggtttgcagtgggttcttgatgttgagtagaggtgtgatgtccctttgggctatctccagtagcccagcctcattcaagaatgtaaaccatagctatgtaaactctgtgtccattctgtttgtcagaagaggggaactttgttttaaatgcgataaagtttagctgtgttccttgaggtgaagggctgaagttgtccagataatcttaagctagtgatgagaaaaagatgtgtctacagctttgtttctcctccctacacctcaggctctgactcctgacaggtttatacccaagtgcttgctaatacctgatcagctaaggaagtaaaatattttgcctgacttgttttaacagaaatttttagacatgcagaaacactgaaagaataggtcagggacaacaaacaatggcaactccttttgtgccattcttcagtgactttttttctgttgctttttttgattttgttctgttgcttatctgccctccctgtttacctgcttatggcacccccgcagtcctcacttggactctgatttaagacctagccaaagtcctcagttgccttggtgtttgaacctaggctggctgtcttgagttgagtactccacaggctagggttgtctgattgtttgaccactatgaccttgtacctgtgctgcctgcacttctgttatttactgttgacctgaaaattttagccaagaatgtttgtttcttcgctgtgaaagttgagagggcttcccattaggggaaaatattgagaggggatattaaacaggatgtgtcatgcttgtgatacctaaacctgttgtttgatttcagtgtgaccacagagataaccagatatcatgcacctcctagtaatagcaggaagtaatagcaggaatacttacattcaggaagtattcttgtcaaagaatgaagacaaacttgggtaaagggacaaaggaaaaaatgtatatattggaacacacttaagaaacatttgcggagttacttagattttcgagtggcttgtgagaatatttcaggttctaatgatttggtactggccatttgtttctaagtgatccagcgcaggactgcataggtaaagatgaatcaaagctggccaggagtttaaaaatgttacgaagctggagagtgggtaggtaggagcatcttatgcttgtctctcaaacgtttgcatacctttgagaataattttttttttaattttttgagatagagtcttgctctgtcgcccaggctggagtgcagtggcacgatcttggctcactgcaagctccacctcacaggtttgcgccgttttccttcctcagcctcccaggtagctgggactgcaggtgcctgccaccatgcccggctaatttttgtatttttagtaaagacggggtttcaccatgttagccaggatggtcttgatctcttgaccttgtgatccgcccaccttggcgccccaaagtgctggaattacaggcgtgagccaccgtgcccagccgagaataatttttaaaatggatgtggacttcttatctccaatgaaatgatatgttgtatctcatttgtttattaaatcaaattcccagttaaaattcaacagatttttttttctcccccacctaacttgtttgtttttgttttgttttgtttttgggggagttttgtttcattttgctttcagacagtcttgctctgttgaccaggctggtgtgcagtggtacagtctcggctcactgcaacctccgcttcctgggttcaagtgattctactgcctcagcctcccaagtagagacagggtttcaccatgttggtcaggctggtttcaaacttctgacctcaggtgatccacctgcatcggcctcccacagtgctgggattacaggtgtgagcgaccgccctggccctaactttatttgaaatatatatccctttgtcttacacaaacatgcttggtattaatttttttgcttatttgtttattacttactagtttacttagtttagtcctgggagtgtacataaaataatctcagaatgacaaagccaatattcctagtaacaagaaacccactgagtgagggcaaaggtttttttgtagttcttggtttgtttggttttaaatgcttaaataatttttaattgtggtttcaaaaaaaaaaagatacgtcagagatttaccaccttaaccatttttaagtgtacagttcgttagtgttgttaactatattcacattcttatgtggcagatctccagaactctttcatcttgttaaactgaaactatgtgctttaaccaactttgccactttctcctttctacaacctctgacaaccaccataccactctgcttctgtgaatttgactcttttgggtggtgtcttaataagtggaattgatagtgtttgtccttttcgactagttaactttgcttggcgtcatgtcctcagggttcatccatgttgtggcatgtgaaagtatttctttcctctttttttgaaagagtttcactcttgtcgcccaggctggagtgcagtgactttatctccgctcactgcaacctccatctcctggtttcgagtgattctcctacctcagcctcctgagtagctaagatttctggcacccatcaccacactcagctgatttttgtatttttagtagagatggggtttcgccatgttggccaggctggagtcaaaacccttgacctcaggtgatccaccctctttggcctcccaaagtgctgggattacaggcgtgagccaccgcacttggccagtatttccttcctctttctaaggcagagtaatactcagttgggtgtgtataccacattttgtttatccattcctctgtggatggacatttgggttgtctccacctcttggctactgtgagtaatgctgctggggacacagcggtgcagacaactcttccagatcctgctggatgtttttgtatacacacttagaagtggcattgctggatgagatagttttgaaatttttgagaaaccattgtgcggtttttttatagcagccttgccattttacattcttaccaacagtgtagaagaatttcagtttcttcacattccttcccacactttgctgttgtttgctttttatatattttctttttttttttctcgtggctatcctggtaggtatgaggtcatatctcattattatttttttaaatttggagttctgtgatgagtagagatgttgaacatctttttgagtgtttgtatgtctttggagaaaggttttattcatgtcctttgtccagtatttagctaggttgtttctggtattgtggagttgtaggacatctttagatagtatcagatgtaagatttgtggatgttttttcccattccataggttgccttttcacccttactgattgtttcttttggttggcaggcatttttaaatttgtcaggttttgcttttggtgtcatgtccaggaaattatatctcttatgtcatgaagcttgtggtctctgtgtttgtctttggagctttacagttcaaggccttacgtttaatctgtttagagctggtttttgtatatggtgtaatgtaaggtattctcatgttgtttctttacatggggacgtagatttaccagcaccacttgttgaagtgactgtcttttctccattgagaggtctgggcacccttgttgaagatcatttggccatatatgcttgggtttatttctgggctctattttcttcctttggtctgtttgcctgtcttttatgccagtatcacactgttgaattactgtcattttgtattttgttttcaaattaggaagtgtgttatccaagtgagtcaaccatgctcaacttcggttttgtcagtttttgttaatctgttttaaaatatcaacccttagttttttttcttttttcttactgtttttttcttttatgtctgctctggtcttatttaattttcttccttctgccaaccttgggtttattctgtttttctagttccttgtaatgtagttaggctattcatttgaggtctttcttctgttgtaacataagcatttttgagctgccttgtcttgtgtgacaatttttgacttatagtctattttgtctgacccaagtttggtcacccctgctctcttttgcttactatttgcctggaacatcaacttcagcacttcactttcagcctgtgtgtgtcgttaaatctgaaaccggtcttttgttaacagcatatagttgtaacttgactggttggttggctggttttattcatttagctagtctgtgtccttagattggggtgaggagttaatctgttttacagtcaaaatagttgctgttaaggaaggcattagttagtatagctctgttgttaattattttcagtatgttctgtagctattttatacctattttttctcccttattacctgcctttttgtgctctgctgctctttactttttatagtgacaaaaaataaaagaacactttgaatcctttctgattttgtgtgtcttccatggttattttctttgtggttaccaaggggattacataaattatcttaaagtgaaaacagtctgttttcaactgttaccttcagttgcatctccatatcccctcagacaaattttgttattgatggcacacatgaatgtttttctattgtgtatccttttaccattggtttatggttattgatgtgcttttgtgttttaagttctataccagacttaaaagtgatttatacacctttgtgatctaggattctctatttgtctgtatatttacctttatcagaaagctttatattttctttctttctttctttttttcatatggttttgtgtctgacatccttttgtttcatcctgaagtgcttttcttcagcatttctcgtaaggccagcctagtggcttttgcttaccttggaaggtcttattttttctttcattttgaaagttatggtattcttgtgaggactaaaccctgatgattatcttacccaaatccctatctaagggatctggagagttacgccctacaaatgagcatgactcatcatcagatgggttttatttaaccctatatttcatgacttactttccagtctgactctgggataacattacgagacaatgaagaaaataaaaatattttaccccaaaacatgtttgccatattttgaaatggacttgcaaagctgctcttcgtgggagtggaggagaaatctgcatctgtaaagaatctctattaaaatagataaatctttttcttccagaccctcccaatcctaaagagataaactaaaatctgaataagaaacattggtcatttattgtctctaagggcaaccacttccctaagacttcagaagaacttcagtctccatcatcttttatcttaacctgagcattccctttcccttcttaccaatcccaggcaaactcaaccgtcaaccagaaaatgtttaaattcaccaatagactggacctgataaccccccaaccctgccctttcttgaccaaaccagtgtatttcttaaatgtatttgattgatgcctcatgcctctctaaaatgtataaaaccaagctgtgccctgaccaccttggttacatgttctcagggcctcctcttgagggttgtgtcatgggccatggtcgctcatatttggctcttttatagttagactcttcgttgtcacttggtttaagcactttgaatatgtcatcccactgtcttctggattgcagagttatagcttatctagcaagagctcccttgtaaatgatgagtcactttttacttgctgcttccaagattctttctttgtgactcttgagagtttgattatattgtctcttgatgctttgggcttatcctagttggagttcagcttcttgaatttgtatgtccatcttctttcacacaactggggagtttgggccattattctcttctagtaggctttttgcccctccctgtctttcccccaaatcctgttctcattttctctgtttctgtcttttctccttctaggactcttgtagtttgtatattgttcctcttgatggtgtctgctactccctctcttaggctcacctttatttttcttttttcctttttgcgcctctgacttgttaatttcagtggcctgtcttcaagtttgcagattctttctggacctgtgatttttaaattctgttcaattgtattcagttccagagtttgatccttttttgtgggtttcctttacattgttgataattctcatgttgtttatgggttgtttttctgattttgtttgtagctgtttccttagtttgatatgcatctttaagatggttagcttgaattttttgtctggtaactcatacatcatcgtttctttaggcttatttttctaaagaaaaacagccatctcttccagtcttccctatgtatcttcatacagggagtatgaccttcaccagtcagccaggctagaggttttgggaatctcatctcagggcttgcatgtgtactttcttggctgtgcttctctgaagcccctaacctcttgctttgcctgatgcctgtctgtggtactatggcctctctgctgttgtaacaactgtctcatataccctgctccacccccatccctgtatgtctttttttttttttttttttttttttgagctggagtttcattcttgttgcctaggctggactgcagtggtgacatctctgctcactgcaacctctgccttttggattgaagcgattttcctgcctcatcctccgagtagctggggttacaggcatgtgccaccatgcccggctaattttgtacttttagtagagacgggatttctccatgttggtcaggctggtcttgaactcccaacctcaggtgatcctcccacctcagcctcccaaagtgatgggattacaggcataagccacagtgcctggcaatttttgtaatttttcgtagagacagggttgtctcatcatgttagccaggctagtgttgaattcctgacctcaggtgatctgcctgccttggcctccaaaaatgcaaggattactggcatgagccaccgtgcctggcatttttttttttttttttccaagacaagagtcttgctttgtcacccaggctggagtgcagtggcatgatttcggctcacggcaacccctgtctctgaggtttaagcattctcttgcttcagcctcccaagtagctgggattataggtgtgtgccaccatgcctagctgtgatccactgcagtagaaaattttgttttcacatactgctttgtccataaccttcctctcacttcagtttttgggacttggatttaagttgtattagagcttttcacagtagacctacttgtccagtcttctccatttttcatccttttgtctttccatggtgcatcatgagcagttactttcagcaccttctatttttctgattctctcttcaactaactatagacatgtttcattaaacccattcctttccattcttaattttggtaaccgcatttttcattatttgtttgattttcaaatccgctaggttactctgcaaaggtgggcttcttgttgatttacattagttttgttatgttttgtgttttcttttatccttgtacacccttttaaggcagttccaagttctgcatttggtttgtgctatgttgagggtggtggtctttatcatggtgtcttagttccttccatgctagacactacatgtaaagtactgttagtaagaatactatgcgatcaagatgattctgccttccttctgtctggcatctgggctgtcttagcagcgtgagatcaccttgatcaagacttgagattcccttgctggctgtccagagagggtgaatttcagattttaagttattaggaagaaggattgttttgggctcaggtgtttgtgagggttttgcctttggggtccagctaattatgggaagcgtctgctgttttcacctggagactgaacccggagctttgatttctattctattgtccctgtgagaccatcaaaaagaaaggagtgtcccacaacaaaagtcaacattagtttgcactcagtctgttttcctgggagttgtctgatagacgtaaagaatagagctgacacattcaagaattataaaatagtgattcatgggaagggtctccgctttcaacctccatttactaatgtgcccgtagtaggcaccattctaaatgtcaggggctttttactggaacttaacacatcttgaaagaatcaatgttttcatcaatttgtagcctttcttcacttttagaagcagtgacaaacaagtgaagtgaaggaactattattaacaatttgaattttaccataattagctctgtttttttccctatgcatactaagtccatagtgttcccacatgagggttctggagaatgaactaaaaaaaaacttggtgcaccttttaattgacataagcattgcaaggcatttctgctactcttgcctaagtactgattttctcttaaaggaggctctgcaattcagtcttgagcaaaatagtaagttttcattgacatttcatcttaccgctttttcgggattatcttctgcttaccagctagctcaagccctgcattttgttactgagcaggtgcttctatccaaaccttccttaactccaaacctaacttaactttaatgtaaagtatagtataagaaagttctttgtaactgaggttgttaggggctgctcgtttactgtcttagtagttgccacaaggaccctaaaggactggccaagtacactgacttaagaaacaaaatcttgggccttttatgtgattttgttatctttcagatacaggtctgtgggtactttcttgtgactttagtgggtatccataccatcttacacaaaattactttcaaatcatttctctaactctccagtacagttgctaatgttgaggcaaaacctttggtccttttaattcctatggcttctcaccatgtcaaaacacatataagcagctggccttgggtttctgttaaaaatctgcatgttggatcaaccaatgtatttgtggtagaaagggtcaaactgcagaaatctgtttgatcattgtcagaccaagcaatttttaccttagagataattgtaattttcttgcatcctagagcctcatctttaagatgctcagattgagttgggttcttctgtttcccatcagtttttgagagatcaataagtgtaatatgtttgtgccattgattcataggttataatttcaaatttatcctggagttttttaggctaggttacttgtttgtgttttgttttgttagtattaagacagggctttattctctggctttggtggtgtgtcttctttaaaaaaagaggatgtgtcctttttccttttttttttaaatgtgtcttcacataaaaaagaggacttgtggctgagtctttattagcagtggtttgagggaaagtttttcttaaaacatgtttattctgtgataggtagaacttccttgacaaggtagcctgtgtcctagatagtatacttatattagatggttatgtcccgcaaaaataactctagatgtctgaaacaaatgtattcctccaggggtcccctgagagcccttaaaagattccccattgaaagactggattagctagccatccagttaaaggcctttctttattgtctagtgtctttctcatagcctgaatttctccagttctccctccctctcagtcatcctccttatctctctacccatccaccctacccagtgctgttccatgccatctttgtcaaccccaaaatgattattcaacctttgaagaattattgttggacaaacaatgcagggaaagcttatgatttgaaaaatcatcaggggcctgcctttaaatgctgactgcaatctaattcacaaatagcattcgtttacagtgacaagagttcttgaaattacaattttgggatgatgctccatttttttttttcctggtgagcccgtgtgtgttaatttgttttaaaggcaacaggcccgtctggttttaaaatgactcctctcctgtttattttcctttccctctaggcaatttgtgtatggtgattggtggagccaacctcggtcgtgttggtgtgatcaccaacagggaaagacatcctggttcttttgatgtggtgcatgtgaaggatgccaatggcaacagctttgccacgaggctttccaacatttttgtcattggcaatgtaagacttacactctctttacttctttctaagaagactcatcctaaaaagcataaagacctgcatccactactggtgtttgtctgtttgttctttttccagtgttaaggttcacagagtgcagcaagctctctatttagagcctctgagaagaaacaagattagatctagagccttacacctgcctcttcaggtggtctgtgtgagatgccagcagtgtcattcagtaaattaagttaaactcagccttgcaacttttgcagggctacatcactggtatgggctggattaaggtcactggctccaatcctggtagtgctgtgcccccttaattttgtaagtgagtctgctaaacccctctgagactccatcttacagttcatcagtgaacatggagttgatggagattgatgcaagggggctatgagtgagttgctaatttgagaataagggcatttacaaggcacgtaacacttgttagtttacttgttcaagatgatcttgctctgggatcttttgagaccttttcagtgaaggagcacctctgaaatcatgcagtatccttacatgggagtcacttgccccaagacttaaggaaagggcaacggacataattgaaaaggctttttatttttatttatttatttattttttgagacggaattttgctctgttgcccaggctggagtgcagtggcacgatctcagctcactgcaagctctgcctcccgggttcacgccattttcctgcctcagcctcccgagtagctgggactaaggcgcccgccaccagacctggctaatttctttttgtatttttagtagagacggggtttcaccgtgttagccaggatggtttcgatctcctgacctggtgatcacccaacttggcctcccaaagtgcagggattacagatgtgggccacgacgcctggccaactgaaaagcttttcatcaagctattcagccccgggagcagcatctttcacttgtaccctggcagtccttaggatatttgagagaagtggtacagaggcgaagcctgctgttgtttttttggctgtgccactcagaagctctatagttgggccattcttcttctcagtattgaattatgaaacctcagtttatacctttgaaagcaggggatcagggaagtgagtaaatgcatgtaaaagttctgtaaagctgatgatagggtgctgacagtacacaacttcaaaactatgagaacctgaagttagtggccttgcctttaaagatgcttatgaaaaacttgttggctgattgcttcacataaaatagaagcaggaagacctttatttagcagctcagcagtgaggagtgggagggactgtgagaggcagataacctctcaggagacatgtataaggaagtgtttattttgttttagattttgttgggtggtggtctgttagctggctattaatgtgaaggaaggtatgaggcatgtgtgttttggtgggatgttgtttttctctcctccctttctttctgtacttacttttatctcctcttctattgcagggcaataaaccttggatttccctgcccaggggaaagggcattcgacttactgttgctgaagagagagataagaggctggccaccaaacagagcagtggctaaattgcagtagcagcatatctttttttctttgcacaaataaacagtgaattctcgttt

SEQ ID NO: 36014 - DNA, 43274 bp, Homo sapiens
ctcacacacacgaggaggagggttgagctgccgccgccgccgcctctgtcgtcgtcgcgagtgtggagtcgggactggagctgctgccgcggcgacgccggggatctttgtcgctagctcccggcccttctgccccgccgccttccctcagtcagcgttgcccactcctctccggccgggcgcccctgcctccatttcccgctctctgtccaccacacacacggcccccccgatcatggatccgggcagtggcggcggcggcggcggcggcggcggcggcgggagcagcagcggcagcagcagcagcgactcggcgcctgactgctgggaccaggcggacatggaagcccccgggccgggcccttgcggcggcggcggctccctggcggcggcggccgaggcccagcgggagaacctcagcgcggccttcagccggcaactcaacgtcaacgccaagcccttcgtgcccaacgtccacgccgccgagttcgtgccgtccttcctgcggggcccggcagcgccgccacccccagttggcggcgccgccaataaccacggagccggcagcggcgcgggaggccgtgcgggtaaaggcccgggacgcgggaggaagtccggccgggcgccggagcccacatggcgtaggggtgcggtccgggggcgcgcggccctggggcccggtcggcacgtggggcgctgacagtggcgccgtctgcctgggtggggcgccccgagcccgggagccggccttcgcggggcggcccgcggcggtggccgggcggggagcggacagcgggcagcgcgcccaaagacccggacccgagtgccgcccctccgcgcccctgccctgctctggagtccgcagttacccacttgagatgggaaccgtatggaacggagtgggggccgcggcggatccctgccacgaggcgcagaatgaggacagatggagccaggagtcatttgggtgggcgtttagagatcccaggagttggggaggacgaatggccgagttttcctttcaccttaggcccagccgagagagcgtcttctgctgcgttttctactattgaaactgtaattacggtttaaactgtccgtggcccccaaccgtcctgaaggaatcccaagatgcattgcagccttgtgatcgggcagaaacttggctatcaataccaagatctgttttacccttagcattgtgtacgcttctaaagtttacaaagtgccacaaagttaggattcctcacttaatgtgtgataggagactatattgatttgtgtctttttaaagtgaagcttacacttttatcctttgtcagcgacacgtttagagaattttcattgctgtaaaatcgttgaccttattcagattgcttggaataactcactgtgttcgtgcatcagtagttcagtctatttcttcagacacttgagcatttgttataatttaatagttctcacgtgtctttctgaccgtagctagtagacatacattttctaatccataaaatttcgagttaactttggtttttaaacatcttcccgtacttaggggttgcttaagtcgtaggtagcatgcttgcaggtgctgacgttgtaggaatatccggtgagtgaacttatgtattctcataatggtgcttattttgtggtaggtagcttgctttcaggtactgattttgtgggaatgtcaaatgagtgaacttaagtattctcttcctaatggtgcttattttaggaactatcagtgtttccttaaagagaaaatgaaaaaggaaggaaaaggctgaacgtcctttcatcatttagccaggacgttagtggggtgggtcatgacatccagcgcattttaagtgagaacatattgttgatttctctctttaaagttctgtattgtggtggttcttagataagtggacattataaaagtgctccaggagtttggtttctacagaaacttttgtcaccgtttgctctttcgtggtaaagggatagtgtctggagaaacactctgatgacgtatgtacgtcagcacggttgatttggtggttttgttgacagtggcatttatttgtgtgggtggttgatgttttcttttgaggagatcgagcactttcagggtggtacggctctagacaatgttttcctcttgaataaggaagcttagcttgtaattcttgacttacatcaagccattttgactgcctaacctagttcacttctcagctcctaaaagtgcccattccctaccttactttgcagattccgtttatccagccattttctttcttggctcttcctcctttctgtggagccaccagcaccactctgactagactcaggactccatttacagcctgtccagcgagtcatccggggataaccaaccttggtctagaatggtcactgttggtgactaggtattacctcttatgcgggctttctctcttcctgatagttgctaatttgtagttacacctaatctttttctctttgacagtgctagaaattggagatgcgaaaacctgtagggaagtagctgtcagtaagagaatccgtacagcatggtcaactttcttgtttttaatcaaaaaactattttggtgttaccgactttaccaattgcttgtaccaaaatgccagttcatgtttttaaaaaattatcctatgtaggatgtctatttggaaaagaactgattttctaagttgaggtccagggttatattgagactgttggattgcatgttccagactattaagtccataaaaagccagcatcggagaacaatcagtgcttataaaaagcagggggataaataggaaataacacctggattggaacttacaaagggggaaccaaaaagtttgcaaggtttttttgatagcgaggaagtggacaatagggctagcatgttctgttctttagttaagccatagccgaaatttgtgctgggtgtgtttttaaactgcatgccgggaaagctgttgaaggagcctggagagtcagaccttgggattcagtattgaccttggatctctttgaaaactaaagaatataggttccttaagaaataattaagtggaacccatttaagtgtaattaagtgtaattcatttaagcacagttctctagagccaagtaaattggccaagagattctccttaaaaagtgaggtccccaagtgaataaaaatatagaagacaaggcttaatgtatattagaacaagcattttatctgataggatgtatttaagttgcaatttgcacctagttttttttattgttagataagaaactggtttagtaattttagggttacttgaactttttagaacagccagagcttctaaagtaatgatgtggtgttctttgcatcatcccacctttaatgcttctcagaactcactgccattaagaaacaagcatggaataaaaccagcagccctcagtacttacttggaggaggcactgtctccaaaacttagcagattgtattgtggaacttgaattttaaagagaaacattctgttttgtagtgttccgtatttgctgaatgccttatttattggaagaggaggttttttttttgtttttttttttttttgagacggagtcttgctctgttgcccaggctggagtgcaatggcacgatctcggctgactacaacctcctcctcccaggttcaagcaattctcctgcctcagcctcccgagtagctgggattacaggcacctgccatcatgcccagctattttgtgtgtgtgtgtttttgcagggatggggtttcaccatgttggctaggctggtcttgaactcttgacctcaggtgatctgcccgccttggcctcccaaagtgccgggattacaggtgtgaccgcgcctggccttttttttttttttttttaaatgattgacatttaacttacacactgtaaaattcacccttttcaactgtacaagctgggcgcattggctcacacttataaacccaacactctgggaggctgaggtgagaggattgcctgaggcctccataaaacatagtgagactgagaccctgtctccacaaaaaaaaaaaaaaaaaaaaaaaaaaaaatacagctgggtgcagtggctcatgcctgtaatcccagcactttgggaggccgaggtggacggatcacctgaggtcaggagttcgagaccagcctggccaacgtggcgaaacctgtctctattaaaaatataaaaattagccaggcatggtggtgcgcgcccgtagtcccagctactggggaggctgaggcaggagaatcacttgaatctgggaggcggaggttgcagtgagccgagatcacaccactgcactctagcctgggcgacattgacactctgtctcaaaaaaaaaaaaaaaaaaaaatagctgggtgtggtggcacaaacctgtagtcccagctacttgggaggttgaggtgggaggatctcttgagcccaggagctggaggctgcagtgagctatgatggcaccattgcactcagcctgggtgaccaaatgagacactgtccaaaaagaaaagtaaagtgtacatacagttcagtggcttttaatatatttgtaaggttatgcaaccatcaccacttggcagatgctttttagaatattctcagttttaagctggaacatctcagaagtgacctcttcagggccaccagagtagagaggattccaaatcaaagtaatggttgtttaatccagaaaggcccttacactttattaatatgttaaattctatctgttgaggtagataataggtaagattctgtatttgagaatgtgtttttgagactgaagtgcctgcaagaacagtgctcatataaaggtgtttttaggcttcagtgggacagcagatggggtagaggagaggccccacagtatccctggagtatcacagtagtaaacactgcctttcgttacttctcctgccatggctgacctttttgtctcttgtttcatggttttacacgtatgaatggcttgagactgaggatttagggaagaagcgaaggcatcatctagggctgtgctgtgccaagttgagcagttgtttaaactgttagaatttttgactggtgtaaaaaccctctttggagcaggtattacgtagtgctgtcagtacatatcttattgcattcttctgttctttattttttaccttttctgaagttgcacagcgtgaaaagacagcaatttcagtttgaacaagttaaggaagtaatgtagacgacaaagtttaagccttgatttgcttgctttggtttgctggggaagaaatgtctgaaagtgttcagatagtattttctttctggttgaagagaaaggaatgaaaaagagatttgataaccttctgggttgagttagcagtattggaatggaatttttttccagaaatgcgaatttctggttttgctcagatatatgtactagcgactcattaacaaacatttaccagtccactgaatgaaagatgctatgctaggcacttgaaataacaccaagatgaataaattgtggtcctgaaggaatctagaaagggatcagatgcccagtgtactctagtggaagtcacagtgtggtaagtgagccctgcagagagtgtagagaaggctttcaaagccgagaacagcaatcccttacgtaaaacctctcagtcttgtcactctcataaaactaaagatttatctattatctgctcactgttctttgcgaatgccttgtgtgtatttttttttctggcctcctgggccagagttgcagccaaagcctgatcaccaaggttgtgtgtattttaaaaaactttttacttattattttttagagacgggatcttactttgtcacccaagctggagtataattgtgtgattatagctcatcgtaacttcaaatccctgggctcaagtgatctttcacctcagcttcctgagtagctaggactataggcacccaccatgacgcctggctaagtttttttgtttgtttttgttttttgagatggagtttcgctctgtcacaggctggagtgcagtggccctaactcggctcaccgtaacctctgcctccccaggttcaagcgattgttctgcctcagcttcccaagtagctgagattacaggtgcccgccaccacgcccagctaatttttgtatttttagtagagatgaggtttcaccatgttgcccaggctggtctcgaactcttgacctcaagtgatccacccgtctcggcctcccaaaatgctgggattacaggcgagagccactgtgcctggccaagttttgtatttttaagtttgtcgagagtgctgaaggtagagcactggttatctttttacagtacttgtctatttcgtattaaacagcagtgagttcagttactatgagtctggctagtgtgtctattggggcatgtttagaatttcatcattctacccttggttttaaaatatcttcgggagacaagaatttggctactagttgaaggatctgaggtcctcagaacaatcaagaaaactgacagtttttagctgttgattgttgattcatttcaaggcttagaagtttctgccttgttttcagtagagtttaacaaagtgagccgagactgtagatttatatggctccttcgtaaatggctttgttctaaggaaacctagttgttacagtactctaagttgaaccagtttcccatcataattctactttcaaagagagaagaacacttaataaggctttcccgagcacctgacctaacagtggtgacactcacttccaaaccacattcccactaggtaattgtatgtcgcttcacttgaaaaaaaaaaagcgcattctgcagaatgtcactgggtaatttcctggttgaatatttctgtagaactccagtatgttaccatactacttgtccattgcctttaggtggttaattttggtagcagaaaaatgtttcggttatttttttatttttgacatggagtctccctttgttgccccggctgcagtgcaatggcgtgatctcggctcactgcaacctccacctcccgggttcaagcgattctcctgcctcagtctcctgagtagctgggatgacaggtgcgcaccgccatgcctggctaatttttgtatttttttttttttttttttttttttttttttttgagacggagtctcgctctgtcgcccaggctggagtgcagtggcgggatctcggctcactgcaagctccgcctcccgggttcacgccattctcccgcctcagtctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaatttttgtatttttagtagagacagggtttcaccatgttggccaggatggtcttggtggctactgacctcaagtgagccacccacctcggcctcccaaagtgctgggattacaggtgtgagccaccgcacccggctgtttctgttatttttgtacttttttgagggtatctgaaatggttttggtttgtgtattttaaatgttatttaaatggttttttgtttcttttttgtttttgagatgaatctctctatgtcgcccaggctggagtgcactggcacgatcttggctcactgcaacctctgccttcctggttcaagcgattctcctgcctcagcctcccaggtagctgggattacacgtgtgcaccaccatccccagctaatttttgtatttttagtagagacggggctttgccatgctggccaggctggtctcgcactcctgacctcaagtgatctgcccacttcagcctcccaaagtgctgggattacatgtgtgagccaccgcgcctggcctcaaattgtttttgaagtagttaggttgtagctcataagactgtctttcagggttgtttgaaaaacataatggaattttagttactctatgcaaagtctgatcaggttgataatgtggcattgcttttgtgtccgaataaagaggttcttagaatgttagcgctggatacgaccctagcagttgtacagcctcttcattttcagataaaggaactggagccttagaaatgctaagtaaatgcctaaggtcactcacagagttaatgacaccattgagtctagaatgcagatttgctacctgctagtttagtgcttgatctgccacatcatgctgtttaataacagggggcgggaagggcatgcctggagctaattactacaactagcgtgtagttttctgagagtggccctggcatttgcctaatgtttcattcttaaaggtttttgaaattattttggggctttgaagtgcttgctgtaataaatttattgagcatttaccaccccttatcagttatttagtcttcacaacattctcttgaggttaggtactgttgacccattttacagatgagaaaataaaggctcagtaaagctaaataacttaggtcagtcatatccatgagaggagtgaggcttggaatcgaggtcatttcaaagtttattctagtagtgactgctagtgctttccttgtgattttgtattaaagtagactgagactctccagaaactggacctgtgagcttggaccatggcatttctctgtgttctgtctcagtagtagcagaatgacatttgtcataagtaggcagtgctctgatttaaagcaatattttgaaattacttctttttacattttagcaagtgttgatgtaaaatactttaaaacagctctgttcaccactgtctgtaccgagcctttttatttttagagtgttaggtaattaaggcaaaaccatccacattgttttatgtgttctgtagacttctttctggtgtttgcttttactgtttttcagtattgtctacaggagaaaaaaagaaaaacctcagcttgcaaatttttgttcagagatgggatcgttctttgttgttggagggatttacattaaaaaaattcaagaaatattgtctcatgtgatcttaccagataagtgcctattattaagacttgttggctgctggatttattatcttagcctaattttctttctgagttaaatgaatcttgcttttttatcgttaccaccctggcataatccaatgggaatatagtatgaaccacatagttaatttaaaattttctttctttaattttgttttttgagacagggtctcacattgttgcccaggctggagttcattggcacaatcatagctcactgtggcctcaacctcctgggcttaagtgattcttctgcctcagcctcctaaatagctgggactacagttgtatgcctccacgcctggctcatttttacatttttttttgtagagacagagcatcactgtgttgccctggctggtcttgaactcttggcctcaagcaaccctcttagcttggcctcccaaagtgctgggtttataggcgggaaccaccacagctggcccaacatctcctgagtgtagtgtttccctaaccccttcttagaaagttggcacatttaaaattgttttcactctcttgagccctaatggaaatgcaatgaatgtacagatggaggctaggggtcctggtcagaaaagggaagtgaggccagttgtggtggctcatgcctgaacccaggaggtggaggttgcagtgagcccagattgtgccactgcactccagcctgggcgacagagtgagactccatttcaaaaagaaaaaagaaaagtgaaaaaatgaagtgatgtgactggaaggaaccagtgtgaaaatcaaaggaaaacacagtaattcagtaaaaattgattgtgtatttattctatacaatacatcatgccaacttgttgagactactgaagtagagaaaaaagtcatccacccacagttcattctggaagtctacaatctagggaacaagaactaagatacatgtgtacctataatttatttatttatttacttacttatttttgagacagagtctcgctcttgtcgcccaggctggagtgcagtgactcagtgatctcagctcactgcaacctccacctccccggttcaagccattctcccgccacagcctcctgagtagctgggattacaggtgtgtgccagcagacccagctaatttttaattttttagtagagacggggtttcaccacgttggccaggctggtctcaaattcctgacctcaagttatctgcccgccttggcctcccaaagtgctgggattacaggtacaggtgtgagccactgcacctggtccccatgtgtgcctctaatttaaagaggtgtcatgtcctaggggagtgatcattagcccttcagggtaggggatggacagggaatgggatagaaatgggggattaggtaggcaagtgtgtactacaattaaggagaatccttgagctagaactgttatccaaagtgtaatcgagaaccacatgtggctatttaaatttattaaaattaaatttaaaattcaattcctcagtcataatagccatgtttccagcgcttaataaccacatgtggctggtgactatcatgtcacagcacagatataaaacatttccatcactacagaaacttggacagaattttgtcacacatatttcttactttcatgcaatgtgagacacttctgtgacagatccgaagttgtatttttctttaatgaacacccatttggctaacaaaactacagtttcactcaggatgcctgtgttttgttgttattgtttgatacagggtcttactctgtcacccaggctggagtgcagtggtgtgatcaccgctcactgcagcctccacctcccaggttccagtgattctcctgcgtgggactacaggcctgtgccactatacccggctgatttttaaattttttgtaaggacgaagtctccttgtgtttcccaggctggtctcaaactcctggcctcaagtgatcctcctgccttgcttcccagagtgttggttttacaggcatgagccactacacccggcttgaagattagttttgtatctaaagcagtatgaatttaaattgctgatttatgaaatacatgcatcaagcactttttaagacttagccaaacatttgtgtttaaaacatgtaacttgaatcaaaacgtagctttttttttttacctgccatgatgtctgtggccttgactgacgtatgctgtgaggatatgctggccaagtaggattctccatattcaagtcctttgacccatgatcatagctttaaaaaaaaattgtacactcttttaaaaaattgaagcaaaatccacataacataaaactggctgggcgcagtggctcacgcttgtaatcccagcactttaggaggccaaggcgggcggatcacaaggtcaggagatcgagaccatcctggccaacatggtgaaaccccatctctactaaaaatacaaaaaattacccaggcgtggtggcgcgcgcctgtagtcccagctactcgggaggctgaggcaggggaatcgcttgaacccaggagtcggaggttgcagtaagccgagattgcaccactgcactccagcctggcaacagagcaagactcaaaataaataaataaaataaaataaaataaaatgagtcaggaatgatgttggtgttgaggttggcatacgtatcaaggacagtaactaccatggctcccgaagtgttgccaaaacctcagatgtgtggccttctggccaagcgtctgcgatttcaatgtttggagcattcatggtgtccctgggggttgcagctttgtatgagtttggtgtgggtgaaccaagaaagaaggcatatgcagatttctgcagaaattatgagattttgagcagatgaggaaggctggtatctttcagtttaaagtaatcttggaatataaagaatttcttcaggttgaattacctagaagtttgtcactgactcgtgttcctgaactacgacacatgaatatgtgggctaatagttcgtcttgataaacaattaacaaacaaataaataaagccattttaaagtgaacaattcagtggcatttagtacattcacactgtgttgtacaaccagcaattctatgtagttctaaaacatttccttttttttggagacagggtctcacaccgtggtccaggttggagtgcagtggtgcgatcttggttcactgcagcctccctccacctcccgggttcaagtgatcctcccacctcagcctcccaagtagctggcactacagacatgtgctaccacacccagctaatttttattttatttaatttttttgagacagagtctcactgttatgcccaggctggagtgcagtggtgcaatctcggctcactgcaacctccgcctcgcaggttcaagattgccagattctcctggctcagcctcctgagtatctgggattataggcacctgtcatcaccctggctaattcttgtattttagtagagacggggtttcaccatgttggccaggctggtctcaaactcctgacctcatgtggtccgtctgcctcagcctcccaaagtgctgggattatagtcatgagccaccgtgcctggcttgaaactggattgatagttaaaatttgattatggtgaagcaacacaaacaccacatattctatgattccattgacatgaagtattcagaagaggtaaatccacagagacagaaaacagacatactgttggctgccagaagctaggagagagtatgggcagtaactgctaaatgaatacgggtttccttttggggtgattaaaatgtcttggaagccgggcgcggtggctcacacgtgtaatcccagcactttgggaggctgaggtgggtggattgcttgagctcaggagttggagaccagtctggggaacctattgaaacaccatctctataaaaaatttaaggccaggtgtggtggctcatgactgtaatcccgggactttgggaggctgaggcaggcagatcacatgaggtcaggagtttgagaccagcctggcaacatcgtgaaacccccgtctctactaaaactacaaaaattagctgggtgtggtggcacacgcctatagtcccagctactcgggacttaaagcaggagaatcgcttgaacccaggaggtggaggttgcagtgagccgagactgcgatagtgcactccaacctgggcgacagagcgagactccatctcttaaaaaaaaaaaaaagatccagttccagtttatcatgtgtatcacaggcagtactggtgttctgctgttctctggtaaagtcttcacttcatgttttaaaatttgtggtaatgtaccaagtaccacagtcaagtcattaatcttcctttattataaattatactattagttttgcctcttttttttttttttttttttttgagacagagtcctgctctgtctgtttttgagacagagtcgtgtcacccaggctggagtgcagtggtgcgatctcggctcactgccagctccacctcccgggttcatgccattctcctgccttggcctcccgagtagctgggattacaggtgcccgccaccaagcccggctaattttttgtatttttagtagagacagggtttcaccatgttagccaggatggtctcgatctcctgaccttgtgatccacccgcctcggcctcccaaagtgctgggattataggcatgagccaccgtgcctggcttttttttttttaagatggagtttcgctcttgttgcccaggctggagtgcgatggtgcaatctcagctcactgcaacctctgcctcccgggtagcttcctgcctcagcctcccaagtagctgggattacaggcacaagacaccgtgcccggcaaatttttgtgtttttagtagagttggggtttcctcatattagtcagactggtctcaaactcctgacctcaggtgatccgcccgcctccacctccagaagtgctgggattacagatgtgagccaccatgcccagcctagtttttcctcttttttttttgagacagggtctcactctttcacccaggctagagtgcggtggtgcaatcttggctcactgcgacctctgctacctgggctcaagcgattctcctgcctcagtttcctgagtagctgggactacaagcatgagccaccatgtctagcctaattcatatatatatatatatatttttgtgtgtggagatggggtttcaccatgttgcccaggctggtctcaaacttagtttttccttgtaatttggggcatggcagttgcactcagtggtaaaccctgaaagctttcccacttagaaaaaattgttccatttttaaatagttaataaaggtgtgtttctaaacatagagataacactggaaaatttgaaactgtaatttcattccttgagagggttctaacttcctttactagcagctgtgaaccatgtaggatgtgagaaattacaccctaatcatctatttcctagccatgaacagttcaacctcggaaaattctaagcccaggctcattagtagccagtaaaatctggatgttatgtgagtcatgaataagaccagagtagaatgaacaagtaaaggtttactgtgtatgtatgaagatagggtagaaatatatcggttttatttttattttttgagacagggtgtcactctctcgcccaggctggagtgcagtggtgtagtcaggtctcattgcaaccttgaccctcccaggctcagcccccggagcagctgggactgcaggcgcatgccgccattcccgacagttttttgttttttgttttttgtttttctttttttggtacaggtggggttttgccatgttgcccaggctggtctcaaactcttgccatcctcccaccttggactcccagaggtttaggactacaggtgtgagccaccatgcccaacccatttgcaacttacaatccattgtaagttgaggagccatctgtattgtaaatctaatagttggtgccaggaactaagtggtcaggtgtaagtactgttttgttttgaaaagctgttacagttagtgatacacttgagagtggtgaggaagcccaccacacccgtcattttcctgccttaagatacgcagtacatcataactgtgtgtccgtcagagcttagtttacttgtacactgattttcagcagggactatctgaggaaggggaagatggcacttgcataacttggaaatgcctgcagttgattctgatgtgcctgtatgttagatggtagtgattacaggatctgtttcctaaggcttttggtgggaatgagctagcagtcggcacttagggctcaataaaaattagttaaagcaaattgctaccccctccatcccccactccctacacaatatggatttgtgagtacttttatccttgtctggcccataatagatactcaatacatatatatatgtattcatttttattaatttttttttttttgagacggagtttcattcttgtccaagctggagtgcagtgacgtgatcttggctcactgcaacctccacctcccgggttcaagcgattctcctgccttggcctcccgagtagctgggattacaggtgtatgccacacccagctaattgttttgtattttcagtagagacagggttttgccatgttggccgggttggtcttgaactcccgaactcaaatgatccccccgcttccgcctcccaaagtgttgggattacaggtgtgagccaccgtgcctggctgatactcaatacatattgataggattgagttggagtagttacatagcagatggagacacatttgttgaatacgccaggagttctttaactgacactaaacaaattattctcccatttcctcccataaactcctcaacaatcctctcaggtagatggtatatcatttccacaatttcagtggaataagtgcaggcacagcttgtaataagccaggagttaaacctaggagtcagctcagttccaggctctgagaagtaccccatgcagtcacctccttcttagggtggcctgtgaacttgatactctcagtactacctggcttcctctgaaaactgagtaatttttccttaccttatccttaaacttttcttgaaaatggaaaagcaaaaaaaagttaatctgtattgtgttgaagtacagtttctgcctccttccaaaccaggttcaaatgcgtttcccccctgtttgttaatgtcctgctcatcccacagcttggggtcatcttagaccttttactctccctttctcccaactcctgtcaggtgtagcccccatcccctcctagttgtattgcttggttgtctccatggcatgctttcttgcagtggtgatgtgggtcttcctgcctgtggggtcttgcccactctagttcatgtagtttaagctgcaagaaaaagatcttcctaagtgacagtctgagcctgtcacttaaaaaaaaaaagaaaacaatttggttgtcctttacctatcagggacaggaaattactttactcaacatttgatgctattgaaggttgggcccaaaacactttctcttgactcttacaggtattgatcctttccgggcaatgattttacaggttacaaattcattattttttcatacttgctgtgcatgattcatatgatttaattctttagtatcgttttctgtcgtggagattctttaaagcaggggcacgttcatattggagtataatttaggtttgtctgtatctgacaaactaaaatccaaaaagcagacttagatatttggttattagtatgtatttctcctacatctcttccagtaatgtcataagtaaatttgcagtgtggcaactggaaactggattgttgcttggttttagagttctagtataggaaaaaactggcatcattggaatcaccttttctgcagatatttttaatggcttatatatgtttcaggactttatacacatgtcatttatcttataggtatctaatttattcagggattttgataacatgagtatggaatattaaaaagggctaatcacaggctggatgcggtggctcaagcctgtaatcccagcactttgggaggccgaggtgggcagaacacctgaggtcgtagttcaaaaccagcctgaccaacgtggcgaaaccccatctctactaaaaatacaaaattagccgggcatggtggcatgcacctgtgatcccaggtactcaggaggctgaggcaggagaatcgcttgaaccggggagatggaggttgcggtaagccaagatcgtgccattgcactccaactccagcctgggcaacaagagtgaaactcagtctcaaaaaaaaaaaaaaaaaaaaagggctaatcacagctttcttgggctgggttacctagagagaatcacgggaagtagatgtgtatttgttgagcacatctctaatttgatctgtgctgagctgcaaattactttgacagtatctgtgaagaaaaggtttataaagcaaatcaaaagaataagcatgtttttatgaatacattgaaactactgaaaatgtttcaaaattggctgtaattagtagaattttgaaaagtaggttaagcagagacttctaacttgaaggcctgagttagctgccattgatctggggttattgattgaggcttgtgtcgtgttattgaacttctgtttttactgcatattaaaagataagtgaaatggatggataagtatcaatttttaatagaacttctttctgttaaacagcacctgtggaatcctctcaagaggaacagtcattgtgtgaaggtaatgatgtactctttgaaagtctacttgagaaaacattaggttgtctatatggtgtgtaaagctagatactgtttggtaaatatatattatatttcaatctcttgtctaggttcaaattcagctgttagcatggaactttcagaacctattggtaagaaaatttctgaccatattaatacagtaatatgaaactctttcactctcaagatttaaggtgcattatgtaagttacgattattgtaatgcctacatttaagacacattgagtctttgctattagtatttagaaagtagaacaaactaggcactaacactgccttgataaacttaatgattgcaaataaaattgagtggaggaatggtcaagtcaatttaaatacctgtacctgttctgttttctttttttgagacggagtcttgctctgtcgcccaggctggagtgtagtggtgcaatcttgggtcactgcaacctccgcctcccaggttcaagcgcttctcctgcctcagcttcttgagtagctgggattacaggcgcacaccaccacaactggcaaatttttgtatttttagtagaggcggggtttcaccatgttgatcaggatggtctcgaactcctgacctcgtgatccacccacctcggcctccgaaagtgctgggattacaggtgtgagccaccatgctcggccacacgttctgttttcttggtgaaaaatgttcttcctttttataactttattcttaagggtttcacgttctcagcgtgattaaagttgatgccaaagttttattagtttaagaggaaaaagaaaatatttcctaaatcctttcatatttctcgtgtgtcacgattttaaactttcctttttttcttactatcagggtgtctcaacactggaataactaggctgttgggaatgttagaactcttgtttgcattttgtttgccattatgaaaatgaagctttgctaaaatagcaatctcagcctgtgagtcagtgccctctgatgtgataccagcagtgagtctgccttgaaagctgtcacccatttctgctatgaaagaggttttcctgcttatgtgtcactaggcattaggaaatggaactacatatgcaaacttccatttgttgttttaaagctagtgtattttaaagtatagattgtaagtctttttcagaatactaagttaaaatgtctttcttcagtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtaggtaagctgctctcatagcaattaaagttactggatacataaaacatagaacatcctttttagctacctggagatgtttagtgaaactgaaggaaattaattgaaaatgtcttgatttttaacttgctgattttttttagctggcaaaaaattgcaagtacttttttcctgaagtttaggcaaatgaataattctgtaacggcatagatgctggaagaaaaacttcagtatattgtacgtaacatataattagtctattgaccattgatggtagttcagcatagtattatatatcagtatcttagaaaatgtgcccttttttatgtgaacctcagttaacttgttaattttaatgggattgaccttaccagataattttgtgtgaagcaggaaatcaataatttggagtaacttctggatgcttgccaggttgctggtttagcaaaaaacaaaagaacaaatttatttaatttactcagatattctctaattatctggcctatccccagaattgtgagaaaaaaaatacagaattatgtgtctttcatttcagctatctctgccttccccccagatatgaaacactgtaccccttcttttagtagcaagaactcttttgaaagtgtaaaggagcggctgggcactgtggctggcgcctgtaatcccagcactttgggaggccaaggcgggcacatcacgaggtcaggagttcaagaccagcctggccaacatggtgaaaccccgtctctactaaaaatacaaaaattagccaggtgtggtggcatgagcctgtaatcccagctactccggaggctgaggcaggagaattgcttgaacccagaaggtggaggttgcagtgaggtgagatcgcaccactgcactccagctctgggcaacggagcaagattccgtctcgtggggaaaaaaaggtgtaaaggagcacatacctcatttgctgtaagtgaaaggaaaagcacctgaatctagttcacagttcttcagctgcttttgctcttggaaacttctcttggggaatttatagtctgttgccgctgtgctttcggagtaatctgttaaaaaattctttatcagtaaagtgtttttaagtggtttttttttttttttttgagatggagtttcactcttgtcgcccaggctggagtgcaatggcgtgatttcagcttagtgcaacctctgcttcccgagttcacgcgattctcctgcctcagcttcccaagtagctgggattacaggcggccgccaccacgcctagctaatttttgtatttttagtagaaacggggtttcaccatgttggccaggctggtctcgaactcctgacctgaggtcatccgccctcgctggcctcccaaagtgctggaattacaggcgtgagccaccgagcccagccttgaggctcattttcaaaaggagaagggtaatgaactaggatttatgccccaaattcatatggaagatttaattatgtatgttaaagggtgctgttgtttgcatatttagccattggtttttggttttaacctatggtttgcatgttgatgttacttttagatgctggcaagtcaaccattggaggacaaataatgtaagtctgtatcttttgttaaataacagagttaaattgatgtaatgaattttaggcattgtaaaccttcatacagtcacacaaaggagataaaacaggtcccccaaagaaaaattaaaaataaaattactgggacacaatactgatgttaagaagtgatttttggcctggtgtggtggaacacacctataatcccagcattttgagaggctaaggtgggaggatcactggacttgaggtctggagtttgaaaccagcctgggcaagacaatgagactctgtctctactttaatttttttaaaagtagtagtttttgtaatgtgattattactagtgttaaatgtgtttctgaaagctttttacattttttaaaaataaaaaatgaacacagaactctagattatgggaaacttggtctcctttgcatataacatacatgggaataatgacaaccagctcttgaatctggtgaatgggggaactgttttttcctcattcatcagctccttaaatgtatatggatttaataaaagacaggtagactagctaaaatgctaagataattttttgatcgtattatagaaatttcctaggtatgaaatgaccgtggctggcctttagtaatgcattttagtattgacaaatcttgataactaaaaagtcctaaatttttaattgcttctctaaattagacccatttctttgaactgtgtcatcagaggacctagagggcttgccatcatcttgcctagttaaattttttttttttttttttttttttttttttttttttttttgagatagggtctcattctgtcaccaaggctggagtgcagtggcatgattttggctcactgcagcctcgacctcctggactcaagcaatccttccacctcagcctcccaagcaggtgggatcacaggtgcatgcaaccaagcctggctaatttttgtgtttttttgtagaggtggtgtttcatcatattgcccaggctggtcttgacctcttggggtcaagtggtctgcccacctctactgcctcccaaagtgctggcatacaggtgtgattaaccacacctggctaatcatcattggtaatcttgccagttacttttgaacatttccacaacagagactctaagacaggctgttaaacaggggtccttccccaggtctctgtggttgaagtgtcacagccatatgatgttatgtttcaggacagtgtatattttttgctgatgggctgtaagttttggtggcgtcacactgggtttctacatgcaaatgcttaggtgcactgcactatagatgtctacgtggagaacacagatgaaagctatagggaaaggagagctttgaattggattgagtcaaggaagtatgcattactaacgaactattttgaaattattatctcattttgacaagtaataagacttacttgcctagacaacattgttgcaatttttttttcttttctatagtacctacatttacatttacttgttattttatttttaaatttacttggctgggcatggtggctcatatctgtaatcctagcattttgggaggccaaggcggaaggatcatttgagcccaggcttcaagaagagccaggacaatatagtgagaccctcatttctataaaaaataaaaataaaactatatttattttaagagacagggtctcgctgtgttgcccaggccggagggtagtggctatttataggggggaggatgatagcgcactatagcttcaaattcctgtgctcaactgatcctcctacctcagcctcccaagtagctgggactacacgcttgcaccaccatgcccaccttatatttacttaaaaaaaacaaacaaaaacaaaaaacaaaacctactatattctgaaataattttagatttacggaatggttgcaaaaacagtacgggaagttcccttcattcatcctgccctgatgttgacatcttataaccatagtcattcatcaaaacttccttattactggtgaaattagtcatgattacttggttaaggtgtcatctgtcaagattgtccactataaggttattgttttcccttttcttttcttttttttttttttttttttttttttgagacagaatctctatcgcccaggctggagtgcagtgcagtggtgtgatcttggctcactgcaacctccgcctcctgggttcaaatgattctcctgcctcagcctcccaagtagctgggattacaggcatgcaccaccacgtctggctaatttttttgtatttttagtagagatgaggtttcaccatgttggtcaggctggtcttgaactcctgaccttgtgatccgcctgctttggcctcgcaaagtgctgggattataggcctgagccaccgtgcccggccattttttattttttgttttttttgttttttttgtttttttgagaaagggtctccctgttgtttaggctggagggcagttgtgtaatcatggctcactgcagcctcaacctcatggactcaggcagtcctcccaactcagcttcccaaagtgctgagattacaggcatgagccatcacacctggcctgattttttgttttttttagagacagggtcttgctcttaaacacaggctagagtgcagtggtggaatcatagcttactgtaacctcacactcctgggctcaggtgatcctctcacttcagcctcccaagtagctaggaatacaggcatgcatcaccacaccaggccaattttttaatatttatgtggagatggtctcactgtgttgcactggctggtctcaaactcctggcctcaagggatcctcccacctcagcctcccaaagtgctgggattacgggcatgagccatcacaccaggccactttgtctgttaattcgagactgtaaatatcctttttccacttacactttccataattttagcatccaccagtggttcctttactttaactattttctggccaggcgtggtggttctcatgccagtattcccagcactttgggaggctgaggctggcagatcacttgaggtcaggagttcgagaccagcctgaccatggtgaaacccagtctctactaaaaatacaaaaacttagccaggcatggtggcacacgcctgtaatcccagctacttgagaggctgagacaggagaatcgcttgaacccaggaggaggaagttgcagtgagctgagatcacgccactgcactccaccctaggcgacagagcgagaccctgtctcaaaaaaaaaaaaaaaatatggccaggcgtggtggctcacgcctgtaatcccagcactttgggaggctgcggcaggtggatcacccaaggtcaggagttcgagaccagcctggccaacgtaatgaaaccccatctttactacaagtacaaaaattagccgggtttggtggtgggtgcctgtaatcccagctactcaggaggctgaggcaggagaatcacttgaacccaggaggcagaggttgcagtgagccgagattgtgccattgcactccaggtggatgacaagagcgaaactctgtctcaaaaaaaaaaatatatatatatatgtaatatatatattttatataaaaatgtgtaatatattttatataaaaatatgttatatatgttatatatatattttatatttttttagacagacacacacatataaaataactattttctgacgttgaaattttcgacaattttcacgttttcctaattccactgagtaatttgtgagtaattgtttacttttttttttctttaaatgttttcaggtatttgactggaatggttgacaaaaggacgcttgaaaagtatgaaagagaagctaaagagaaaaacagagaaacttggtatagtaaacttttatgacacttataaattacttttaaggagacgatgcccacttagtgcttttggagcctgttaaaatataaattgttgaagtctaaaatcgtatcacaacaaaggaaatttcccctctcctcataatacacagtagatgagttcctaatgctttaataacttacacagagaaatttggaaacaatccatatatctggtgatagacttgttgaaaatactataaaccatccatttaattgggtgattttgcaaccactgaaaacttacatttacataatttatagtaaccatgaatagaacttgcgttgtggtggcagttggggggaagcaggaaacatccctgtacttaagatatgaccattatataaataaatgctggaaataaaatggaatggaattattgacagtggttgcctttgaatggtgagacagtcaacttttttgttttctaaccttgttacttttatttttaaaaagttagcaagccttacctcaatgggatattgacagtcatttttttaaaataaaattatattcctctaaaataagcgggagaaatgctagtcagtgttgttataaaaaattgaggacatgctgtgaagatgatgaggtaagctaaattaatgcccactattacggatggtttgaatttatatgaatttttgcctggcagtgtgatattgaagcaatttttagcaagtaaccattgctcccacatggtgcgttagtggctttcagttttcaaaaatatctgaggacagttattttttattttattaaaaagttttagtcctggcacagtggcttaagcctgtaatctcagcactttgggaggccaagacgggcggatcacgaggtcaggagatcgagaccatcctggctaacatggtgaaaccccgtctctactaaaaatacaaaaaattagctgggcaaggtggcaggcacctgtagtcccagctacttggaaggctgaggcaggagaatggcgtgaacccgggaggcggaggttgcagtgagccgagattgcaccactgcactccagcctgggcaacagagtgagacaccatgtcaaaaaaaaaaaaagaaaaaaggaaaacaacttttattgggccaggcgcggtgactcaagcctgtaatctcagcactttgggaggcaaggcaggcagatcacacctgaggtcaggagttcgagaccaccctggccaatatggtgaaaccctgtctctactaaaactacaaaaatggccgggcacagtgtctcacgcctgtaatcccagcgctttgggaggccgaggcaggcggatcacctgaggtcaggagttcgagaccagcctgaccaacatggagaaaccctgtctctactaaaaatacaaaattagctgggcatggtggcgcatgctctaatcccagctactcggggggctgaggcaggagaatcacttgaacctgggaggcggaggttgcggtgagccgagatggtgctgctgcactccagcctgggcaacaagagctaaactccatctcaaaaaatatatatacaaaaagtagccgggcgtggtggtgggcacctgtaatcccagctacttgggaggctgaggcaggagaatagctggaacctgggaagcagaggttgcagtgagccgagatggtgccactgcactccaacctggccagagcaagactcccatctccaaaaaaaaaaaaaaaaaaaaaaaaaaagaagaagaggggtgggggtgccgggcacgacctaggctctgttgcccaggctggagtgtagtggctccatctccactcactgcaagctccacctcctgggttcacaccattctcctgcttcagcctcccaagtagctgggactacaggcacccgccaccacgcctggctaattttttgtatttttagtagagacagggtttcaccgtgttagctacgatggtctcaatctcctgaccttgtgatctgcctgcctcagcctcctagaatgctgaaattacaggcgtgagccacagcatccatccaaaaaagttttattattaccctttaactctcaagacagccattatttgtgttgtattttgtgccatgtgagtataaaaatgaagtaataagggagctcattatcacttaacacacagtgatattggcatttgtagttagtctttctgtgtagtcaacttgccataaagttctagatggtataattgactgcgtttatataaaagctctaagggtttgaatcaaaataatacattctttcagttttattttatttatttatttttttgagacggagtctcactgtgtcaccaggctggagtgcagtggcgcgatctcagctcactgcaacctccgcctcctgggttcaagcgattctcctgcctcagcctcccgagtagctgggactacaggcgcccgccaccatgcccagctaatttttgtatttttagtagagatggggtctcaccatgttggccaggatggtctcaatctcttgacctcaggtgatccgcctgccttggcctcccaaagtgcttggattacaagcatgagccactgcacctagccctttttttttttttttgagagacagagtctccctctgttgcccagcctggagtgcgatggcacgatcttggctcactgcaacctctacctcccagcttcaagcgattgtcctgcctcagctttcgaaatagctgtgactacaggtgtgcaccactatgcccaacttttgtatttttagtagagatgaggtttcatcatattagccaggctagtctcgaactcctgacctcaggtgatctgccagcctcggcctcccaaagtgctgggattacaggcgtgagccactgcgcccagccctattctttcaatttctttgttttcttttgagacggagccttgctctgtcgcccaggctggagtgcaatggcacggtcttggctcgctgcaacctcctcctcccaggttcaagcgattctcctgcctcagtctcctaagtactacaggtgggctcctccacacccagctaatttttgtattttcggtagagacagggcttcaccatgttggtcaggctggtgtcgaacccctgaccttgtgatccgccgccttggcctcccaaagtgctcagattacagatgtgagccaccgcacccggctcaattttcatttcaccaatcttgttcgtgatttaggtgttgtgtgtcatccattatatctttaatggtgaagaatatcctaaaaactctgatgttcttaggaatattgttctttttttaaaaattatttcaggtacttgtcttgggccttagacacaaatcaggaagaacgagacaagggtaaaacagtagaagtgggtcgtgcctattttgaaaccgaaaagaagcatttcacaattctagatgcccctggccacaagagttttgtcccaaatatgattggtggtgcctctcaagctgatttggctgtgctggtaagaaagacatttccagtccatctgtatatttgttagtagccccgcttatatctttaaatttgaatttatcttctaaaagctcaaattcaggttgcagtgaaatataatgatgtacacggtcacagttttcatcatactaatctctcttcaagaaatcttcaaaatttgatttacttctgaaaatacgtttcaccttttctctcctgttgctattatctattaccatgtcagaacttagtctccattaaatgccaagcccaccgttaggcaccatgggtaaaaaatgaataggaaaccatctgtttcatacggtcttcagtcattttgcgcttttcacaatgtactggtagtagatcacaattttttttcctttgtagttacaatagctagaaagtaaatgttggaattttaaaatatgcaggtatactagattttgggaatgtgggggattggaagcatctagacattgtttgatttgtgacattcaaaagcaggtacgtcataactcgtttgcttctattttcttgcaaaaaaaaaaaaaaaaactcgtgatataactgaaaggaaagatgttttactgccataagggtatgcctgaaggcgaaggagtaaactgtttcctttcttggaattaggtaatctcagccaggaaaggagagtttgaaactggatttgaaaaaggaggacagacaagagaacatgcaatgttggcaaagacagcaggtgtaaaacacctaattgtgctaattaataagatggatgatccaacagtaaattggagcaatgagaggtgagcgtagatgtctggtattttatgttagtgggattaaggatggttttgttattgtacgactttttctctagggtttttctaaaccttaatctgtttacttaggaaactagagttcttggtttacattataattgagttattttggttacattataattgcagatatgaagaatgtaaggagaaactagtgccatttttgaaaaaagttggcttcaatcccaaaaaggacattcactttatgccctgctcaggacttactggagcaaatctcaaagagcagtcggatttctgtccttggtacatgtaagtaactgttttttcctttttttaaaaaggaaaaggatgttattacttaaattacttataaagacatatgctgagtaacatgttaacatatgcttttgagcatatatctttataagtaatttaagaaaatattaaatgtaaccttggctttaaaaatactaagatctttgcccatttttaaactgggttgtcattttgttactgagtcctaagagttctttttaatactggctaccagtcccttatcagctacaatatgattatagcaagtattttctcccactttatggattgccttttttcacttctcgatggtgtcctttgaagcacaaaaggttttatttttgaagttttttacatttagatatgtatttgattttgagttaacttttgtgtaagatgtaaggtctatgtgtaggtttgttttgtttttgtatattaattgtttacacacaatttgttgaaaagactattcttttttcattgaattgatttggctccctctttgaaaatcaaatgaccataaatacgagtttattcttgaactccgtgtttcttttttttggtttgtttttttgaaacaggttttcactctgttaaccaggctggagtgcagtggcatgatctcggctcactgcaacctctgcctcccagctcaagagatcctcccacctcagcctcccaagtcgtagggactgtaggcacatgccaccgcacccggctgatttttgtatttttagtagagacagattcaccatgttgcccaggctggtgtcgaactcctgggctcaagagatgcacctgcctttcggcctcccaaagtgctgggattataggcatgagccactgcacgcagccaatactgtatgtttaaaggggaaattattttatagaatcttggtttcatagctggaaaagtccataaaaagtaatatagtcaatttattacatgtaggctatttgctataaaatatttctctaaattttaataagtttatgaggaagccttatactgagcagttttataatagttttctgtggaataagtgagatgaaatggataataaagtggttgaatgggaagaatacatgagtagaatgaaaatattattagaagctgtttatagtcatgtaacttaacattttgatatttatgttgacttcctttaatggctttgttgttatgttctcagtggattaccgtttattccatatctggataatttgccgaacttcaatagatcagttgatggaccaatcaggctgccaattgtggataagtacaaggtacccaaaatgttaaagaaattgggtttcctgggaggggaaatcattgttgtgcattttgtttctagttttgaaaactttttttcttttcttttctttcttgttttttttttgacagaatcttgcactctgtcccccaggctggagtgcagtggcgcgatctcagctcactgcaagctctgcctccttggttcaagtgattctcctgcctcagcctcctgagtagctaggactacaggctcccgccaccacgcccagctaattttttatatttttagtagagacggggtttcactgtgtcagccaggatggtctcgatctcctgaccttgtgatccacctgcctcggcctcccccaaggtgctgggattacaggcgtgagccaccgtacctggccttcttttttttttttttttttgagacggagtctcactctgtcacccaggctagagtgcagtggtgtgatgtcagctcactgcaacctctgcctcccaggttcaagagattctccagcctcagcctcctgagtagctgggactacaggcgtgtgccaccgcatccagctaattgttttttgtatttttagtagagaccggttttcaccatgttggccaggctggtctcgaactcctaacctcaggtgatccgcccgccttggcttcccaaagtgctgggcttacaggcatgagccaccatgcccggtccaaaaactttattaacaacataacattgatgtctttttcttaatggctttatattagtggtatagatagaccataatttattcaacaagtttagtttattttagctgtttcccgatgagccagggatcatatcttagtgataaactcatagatgtaactgctgggctcaaaggattttcttattaaagttgatgcatattggtaaatagcatcgcaaaaatactgtgctaacttctgtcaccactagcagcatgagtgttagttttaccacagcctcaccagcactggatgttcgtcttaaaaaaaataaacttccttgtttttaactggatttccaacttgaatttttaagttttgcggtatcaatgtatgtaatgttttcccctcctcaaatacattattctttaattagctccgttctaaatttctttaacaagtattgctttttccaattttatatatgaggaaacaggcctagagatcaggagaacctgaatttgtacaaacagttcagatcttccaacataaacttctgtgttgttttctgcacctttttttttttttttgagatggagtctcgctgtttcaccaggctggagtgcagtggcatgatctcggctcactgcaacctccgcctcctgggttcaagcgattctcatgcctcagccttccgagtagctgggattataggcaggtaccaccacacccagctaatttttgtatttttagtaaagacggggtttcaccatgttggccaggatgggctcgatttcctgatcttgtgatccacccgcttcggcctcccaaagtgctgggattacaggcgtgagccactgagcccagcctttttttttttttgagacagagtcttgctcttttacccaagctggagtcgagtggttcagtctcggctcactgtaacctctgcctcctgagttcaagcgattcttctgcttcagcctctggagtagctgggattacaggcattccaccgtgcctggcaattttttttttttttgtatttttagtagagatggggtttcgccatattggccaggctggtctccaactcctgacctcaggtggtccacccacctccacctcccaaagtgttgggattataggcttgagccaccacatccagcttgtgccattttctttttaaattataggcatactgaattattaatatgatcatacatatgcttatgacacaaattattatagagtatttgttactgagtttaagatgaacctaagccttctacttaagcaaatgattttcctttatgaataagcagtgtagaatttcactttgggctattgagctgttatacagcaccaagaagtctgaaactggattttattttacatttgatcaggatatgggcactgtggtcctgggaaagctggaatcaggatctatttgtaaaggccagcagcttgtgatgatgccaaacaaggtaagaatcggttatgctgtttcctatctatttattgattttttttctttttctttaagagatagggtcttcttctgtcaccgaggcaggagtacagtggcgcattcatagcttattgcagcctcaaactttcaagcaatcctgccacctgagcctcccaagtagctgggactataggcttgtgccactctgcctggctaattttttttttttttaaataaaaattgagatggggtctcactatgttgaccagactagtctctaactcctggcctcaaacaatcctcccatcttggcctcccaaagtgctaggattacgggcgtgagccatcatgcctggcctcctttgtgtcatttttgactgttcagttgctgagatttgcagataacctgaggcagggcttctctaacagctccaaagatgttgcttatgcaggaccacagacttgagtcatcagtaccttcagatggagattttgctagatttcagtgagaatttatttaccatgctaactccaggcagagtaaattagaaaaagaatccattatcaaatgtaatatttagacataattggcaccttacaaattgtattatctggtttcttgatgccttgtgcattggagatgagaatatatagtatcttctaaaatgtttacattttaaagcctactttttcctattatctttgcaacttggaggctaacatatgagtgaaaataattctcaggttgagttcttagttagttgttgctgctgttgttgttttgagatggagtctcaccctgtcgccaggctggagtgcagtggcacattcttggctcactgcaacctccgcctcccgggtagctgggattacaggcatgcatcaccatatctggctaatttttgtggttttagtagagacagggtttcaccttgttggccaggctggtctcgaactcctaacctcgtgatttgcccgcctgggcctcccaaagtgctgggattacaggcttgagccaccacacccagcccttacttactcagttttgtctgtagagttgtcccaaaaattatggagatgagccaggcatggtggctaacacctagcactttcgaagtttgaggtggaccgattgcttgagcccaggagttggagaccacactgggcaacatagggagaccctgtctctgtgaaaaataaaattagccacttgtggtgatacgtgcctgtggtcgtagctatttgggaggttgaggcaggaggattgcttgagcccaggaagtcaaggttgctatgatttatgagctctgatcacaccactgcactccaggctgggcaacagaacgagacctttactaaaaaaaaaaaaaaaaaagctatggaagtgtaaggcagcttggtggttgcaaggggctgaaggagggaaagtaaggagtgactgcttaacgggtgtaggatttcctttttgggacaatgaagttttagaattagatagtggtattgattgtacaacatggtgaatacactagatggcactgaattgcaaactaaaatggtttaaaagttgaatgttattacttatattttaccagaatagaaaaaagtatgattctctaaacataagtgaagttagtgcccagacatatttgcaagtgaggggccttagtaactagtatagagaaagtagctgttctctgtggaagctatcacttgatactaatcactaggcaggtatagaatgtcctagagttgagcaagcctcaaaaactcacttcagtttagtcctcctgaatctcagtggaacagagctagaatagtttaaaagacatagaggcagctggtgggtgggccatgcctgtaatcccagcactttgggaggccaaggtgggtggatcacgaggtcaggagttcgagaccagcttggccaacatagtgaaaccccgtctctactaaaaatacaaaaaattagccaagtgtgtcagcgggtgcctgtaatcctagctacccaggaggctgagacaggagaatcgcttgaacccgggaggcggaggttgcagtgagctgagatcacgccactgcacaccagcacaggcgacagtgcgagactccgtctcaaatatcaaataaaaaagaggccagacttttacaataaaaaattcatggggttggcaacctacggaatgagagaaaacatttgccaatcatgtatctaaatatggggttaatatctagaatatatgaagaactcctacaagtcaacagaaaacctgaacaacccaattcaaaaatgggcaaaggactgcaatagacatttttccagagaagatgtacaaacagccaaaaagtacatgaagaaatgcctagcactgctaactattagggaaataaaaatcaaatccacagggctggacatggtggcttatgcctataatccctgcactttcggaaaagctgaggcaggaggatcacttgagttttgagaccaggctgggtctctcactatgtgtgagatcccatctcaattaaaaacttttttttggaaagcagagtaacacgtgttggcaaggatgtggagaatttggaacccttgtgcactgttggtcatgtaaaattgtgccaagtgccgtgaaaaaatatagcagttcctcaaaaaattaaacatagatttcccacataatccagcaatactctttctgagtatatacccaaaagagtctcagatatctgtataaacatgttcatacatgtattattcacagtagccagaaggtggaagcaaccctggtgtccataaaggatgatggataaagaaagcgtgttacatacacgtaatagaatattgcacagccttaaaaaggaagttctgacacaggccacaacatgaatgaaccttgaggacattatgctatgtgaaataaaacagtcacaaaaagacaaataccgtatgattctacttaaatgaggtacctggaatagtcacatttgtcacctgaaagtaggatggtggttgccagggttcgggtgaacggggagtttcagttttgcaagataacaagatttcagagttctgaatattggttgtacaatattttaaatgtatttaatttaggtgtactattgaaatgtacacctaaaatggttatgatggtaaattttgttacatgtattttaccacagtaagtaattaatgggttaaattaaaaattggttattttttactttgatattttatgaaactgttctgagatacagattgttttttgttttttgttttgtttttttttttttttttgagacggagtctcgctctgtagcccaggctggagtgcagtggtgtgatctcggctcactgcgacctccacctcccaggtcccggttcaagcaatgctcctgcctcagcctcccaagtagctgggattacaggaacgtgccaccatgcccagctcatttttgtatttttaatggagacaggatttcaccgtgttggccaggctggtcttgaacttctgacctcgtgatccacctgccttggcctcccaaagtgctggggttacaggcgtgagccactgcgcccagccgatacagattgttttttaggtgagtgacttctaaactcttgtttctttcttttttttttgagacggagtctccttctgtggcccaggctggagtacagtggcgccatctcagctcactgcaacctccacctccagggttcaagcagttctctgcctcagcctcccgagtagctgggattacaggtgcctgccaccacgcctggctaatttttgtatttttagtcgagacagggtttcaccatcttggctaggctggccttgaactcctgaccttgtgatccacccaccttggcctcccaaagtgctgggattacaggtgtgagccactgtgcccggccttttttttattattattattattattttttattttttggagatggagtttcgctcttattgcccaggctggagtatagtggcacgatctcggctcactgcatcctctgcctcctgggttcaagcgattctcctgcccaagcctcctgagtagctgggattacaggtgcctgccaccacgccaagctaattgttttttttcttttgtatttttagtagagacagggtttcaccatgttggccaggctggtctcaaactcctgatctcaggtgatcacccgcctcggcctcccaaaatgctgaggcgtgagccactgcacctggcctgcatagcattattgatgtagtaaatgtcactgatggtaaatttcccgtgtatctcctctcaggtcacttgttcttttgcttcaccttgctgccacagccagcactggcagtactgaggagcaatactggcatcagaactggaggctccataactattttatttttacattaaaaactttttttttttttttttttaaagacagggtctcgctgtgtcactcaggctacagtgcggtagtgtgatcatagctcactgcagccttaaaacacctgggctcaagcagtcctcatgcctcagccttccaagtagcggggctaaaggcatgtggactacccagctccgtggactattttgttagaaacaaagagtttaggccgggcacagtggctcacgcctgtaatctgagcactttgggaggccaaggtgggtggatcacctgaggtcaggagtttgagaccagcctggccaacatggtgaaacctcgtctctactaaaaatacaaaaaattagccaggcatggtggtgggtgcctgtaatcccagctacttgggaggctgaggcaggagaatggcttgaacccaggaggcagaggttgcagtgagccaagatcgcaccactgcactccagcctgggcaacaagagcaaaactctgtctcaaaataaaaaaataacaatgctatgcagccatcatcactatctaattccagaccatttcattacaccaaaaggaaatgatgtattcattaaatagttgatagacttttaaagcttagttcaataatttttaagtagtgcataattccgatatttggagattgataggtaatagaagacaggtttattaaatccttcatagaattccataataataaaaattatatccataaaactgaaatccaaatattaaattgtgttttcgattttgaaaaggtaaaaaaaggcaaatgctagtgtatacagtgttctagttggaaatgattagaatgtgatatttaaaaggtgacacgttaatactttaattggcagttatacttctaggatatgatttttgctgatcatatctaggctaagattttatgtcatacaaacataagtgtttacagtcaaatcttgcaactctttattgagcagacagacattcagatcattttatgttgcgtaatgcagtgaatgtgtcagaaaacctccagtcttgttttcttttaaagcacaacgtggaagttcttggaatactttccgatgatgtagagactgataccgtagccccaggtgaaaacctcaaaatcagactgaaaggaattgaagaagaggagattcttccagggtttatactttgtgatcctaataatctttgtcattctggacgcacatttgatgcccaggtaaacaaattattgttgttgtcatagtgggttttaatgtctaaatgaaattagaatatcagtgccttttgtcctgattatttgtgacatgccagttaacccatcttagtgtagagaaggggaatggaaatattataagccacttatatatcataaccacaataggcacctcatacaaggtcttcaagctggtacaagtgcttactggataaggagtattctttgtaagttcctttttatgtttgatctcctgatgatacattctacagtatctaatattcactttgaccagagcacagttactgtggaagtcatggtttatgtgctcattgacagcacatagctttccagacaagaaatcacacaggtttccctgttattaacaatctaacctccctgggagaatgacagagtaagtgactggtgtgaataacagaattttttaaagttcttttctaaggtatgacaactaatcaagttagattttgatgccagatgtaaggttgtttactttactggaccttggatattgagaaatggataaagctggataagtttacatctaggtagcttctgagcggtaaaaattagcttagttccttggggaatataaggaaagtcttcccagataagaaagttggcctgctgtcttttgttttgtttggagatggggtcttgctctgtcacccaggctggagtgcagtggcgcgatcttggctcactgcaacctccacctccgggattcaagcgattgtcctgcctcagcctcctgagtagctgggatttaggcgcccaccaccacgcctggctgattgttttgtatttttagtagagacagggtttcaccatgttgtccaggctggtcctgaactcctggcctcaggtgatccccccggcccccctgccgcctcggcctcccaaagtgctgagattacaggcgtgaaccactgcgcccagccagcctgccgtattttgaaagttgaccagggacttgccaagaagataaatacaggataagatactgaaattcatgctttgagttcaagcagcctgacccatcctgtgaacaaaattagtaagacaaacctatcacctctaacacaaaaatcacttaagttgatgtcctagtgagatggtaacactaattcttgggatttatatggcgcttgagaacattgaattcttatttaccctaaggctaaagataagaatgtgtgtgtttgtttgacagatagtgattatagagcacaaatccatcatctgcccaggctataatgcggtgctgcatattcatacctgtattgaggaggtggaaataacagtgagtttaagataattggtttatttctgttttaatactgttttatcttcataatttctaatcagcaacagtgatgcacttttatttctacacctgttcttaaagattattttatttggcattattctgattttctcatactcttttcttggttaggccttaatctgcttggtagacaaaaaatcaggagaaaaaagtaagacccgaccccgttttgtcaaacaagatcaagtatgcattgctcgcttaaggacagcaggaaccatctgccttgagacctttaaagacttccctcagatgggtcgtttcaccttaagagatgagggtaagagcttttaaactgacgtctagtagtatatccaggatacctagctttggtcatcttcatcatctcagtacagtacacattgcaacaggttcacagaaaacttcgattcacattcttattcgtatgagtgttttatgagttgaatgtattgaacagaattgaccacgtgctttagtagtaatgccaaatctagtaatgctctacgtgaagaatcttaattttgatgttttgtgagtagtggatttggagggctattttgtttactaagatatttctatgatgtaatcctttgtaatatgtctagcgattaaaaggaacatagagattgatttttttttttacacctaatttttcagaggtctaatctttgtgaccttttgtgtgcatccatttctgcctacctctgggtgacgcagaacaactaacattcccatcttggggtcatgaagttctttggcataaaaacaaaatgattgttatgaaacgtttccttatgagcttttaatattcctgtccttttcctttccctttccctttccctttcctcttccctttcctttcctttttttgagatggagtctcgatctgtcacccaggctggagtgcagtggcaccatcttggctcactgcaagctccacctcccaggttcacgccattctcctgcctcagcctcccgagtagctgggactataggtgctgccaccatgcctggctaattttttgtatttttgtagagacggggtttcaccacgttagccaggatggtcttgatctcctgacctcgtgatccgcccgccttggcctcccaaagtgctgggattacaggcgtgagccaccgtgcccggcccagctgttaatatttctaacttagataaccattttaagactatagaagactttacataaaactttatagttccattgaaatacagaatagtcatttcacatgttcattccaattccatttagcaaaaactactttgtatctacaaagtgtcaggaactgtgctaagccctggtgatgaatacagttcctgaactttacattggatgaaattgtataaagacagtgtttattttactttaaaggcccagaactcttctggttgatagtaaaactggttattgggtttatcttattaatataacaaaatgatagttttagtttaccactcagaacctgataaaatcaggaagacagaagaaaagcaattaatgtagcaggaattcttaaccctagaattattttttcctaaaagctaacttggctttaaaaaaaaaaaaaaaaaaaaaaaaaaaaaagctaacttggcttttaggttttccacaagacccaatgggttttgtatcctttcagtccacaggattactaccagaaggacgtgttcactgcactgtagtcagtggtgattgctgtgccttttcacagttacttaaggataggttttgggatttttttttttagcagctttattgagatacaatttccataatatgaaattgacctgttttaagtatgtaattcaatgaattttagtatgtttacagaattgtacaaccatcaccatatactaatattagaacatttagaacacctaaaaagaaaccttacacctgttcataatcaccccttattcccacctccaccccaggcaaccatttttcaatttgtcttttatagacactccataaatagaattataaattatgtggtcctttgtctagtttattttacttagtgtgattttgaggttcaaccatgtaacatgttatttattcctttgtatcactgaatagtactccactgggtggatattccacaaatacggatattcccttttcttatttttaatccaaagaggttttttggcccagtgtggtggctcacccctgtaatcccagcactttgggaggccgaggcaggcggatcacctgaggccaagagttcaagaccagcctggccaacatggtgaaaccctgcctctactaaaaatataaaaattagaatgggcatggtggcaagcacctatactcccagctactcaggaggctgaggcaggagaatcacttgaacccagaaggaggaggttgcagtcagctgaagtcgcaccactgcactccagcctgggtgacagagtaagactctgtctttatgcagtggctcatgcctgtaatcccagcactttgggaggctgaggcgggtggatcacctgaggtcaggagttcaagaccagcctggccaacatggtgaaatcccgtctcaactaaaaatacaaaaattagctgggcgtggtggcaggcatctgtatctcagctactggggaggatgaggcaggagaattgtttggggggtacggggggagataggtttttgatacagggaaccatctctttaccagcccccccaaataagaccctcttattaagactacctaaatagaagtatcatgggtttggcagtaaagctagttaattagtaacttacattgtaaaaaatatttttgtgatttaaaataataagttttaatatcttatatagacttgctgttaactactgaaagatttttttaaaatttcatttctaggtaagaccattgcaattggaaaagttctgaaactggttccagagaaagactaagcattttcttgatgaccctgcacaatactgtgaggaaaattgactgcagaagcctacttcacaccgccttctcttattttctgcccattgataaacctctccccatattttgcaaagaggaaattcacagcaaaagtccacattatgtcagctttctcatattgagagctctgctatgccactgttgaatttttcccaagattcctgtccctagccctcacttcaaactctgcttccttggacagatttggcaatagctttgtaagtgatgtggacataattgcctacaataatgaaaacctacaggaatttttttatttttcattttccccttaggcatatttagtatttttcccccaggcagatcattctgagtgtgcgagtgtgtgtgcacatgttacaaaggcaactaccatgttaataaaatattcaatttg

SEQ ID NO: 36015 - DNA, 4149 bp, Homo sapiens
tccgagttgcggtttctccgttagtgcttccgggttgcagccagggaagcctccgcggtggtgcaagtggaacccaagccttgaggtttcagtgagtagggggccgacgtgagctttagcgtccccctttagcctccctcttcgattccttgaagaccctggtgcagcttagcaagagggcccaggatttttggatccccagccctgtgacaagggttcctgtccagtttccccctcccaggatttcgactcagttcagcgaagtcaccgccccgtctgagaaatgaggacaccaaggcttagagcacagccccgaggcgccgtctaccaggccccgtcccctcccccggctcctgtcggtcagcactgaaaccccgtccctgctccaggcctccttctctggggtccaaggtcccatacaggcctctgcctcggccgcaggcccttcagtcaccgtcgcctcgtctccctgactgtccgcaggcctgggcagcatggccgtattccggtcgggtctcctggtgctgacgacgccgctggcctccctagcccctcgcctggcctccatcctgacctcggcggcccggctggtgaatcacacactctatgttcacctgcagccgggcatgagcctggagggcccggctcagccccagtccagccccgtgcaggccacgtttgaggttcttgatttcatcacgcacctctatgctggcgccgacgtccacaggcacttggacgtcagaatcctactgaccaatatccgaaccaagagcacctttctccctcccctgcccacctcagtccagaatctcgcccacccgccagaagtcgtgttgacagatttccagaccctggatggaagccagtacaacccggtcaaacagcagctagtgcgttacgccaccagctgttacagctgttgtccgcgactggcctcggtgctgctatactccgattatgggataggagaagtgcccgtggagcccctggatgtccccttaccctccacgatcaggccagcttcccccgtggccgggtctccaaagcagccggtgcgtggctactaccgtggcgctgtcggtggcacgtttgaccgcctgcacaacgcccacaaggtgttgctcagtgtcgcgtgcatcctggcccaggagcagcttgtggtgggagtagcagacaaagatctgttgaagagtgagtaagagggaccctggactagggtggaggatccccaaatctccccacccccgacccttatgccgagatcaaggaagggtagggccattcattacttcccacccttcccaaatgtcacagtggttgacactcaattggtgctaaggccattttgtcaaatgaacagctttctcagcatgtggtccagtcaccactcaatcagaataccccaaatgtgaagcaaagggatctgcattttagcaagttttccaggtgatacaccctaatgagacactgggaatgaatgggtgagtgagctgcaggtagcagtgccacagacaggaggaggaaactcaagcatggcatgggtcttggaattttccatctgcctctgatgccctctggcactgctcgttctctggagtggtttcctggtggcttattctctggacacatgccagcccttggagtgactattgtgcttgcctgtttcttcaccttcatgctcccctcaccatcaccataggccttaccagttgaaccctttctgccaccccctctggggatactgtacttagggacactttttcccaaactggcccatactctcctccccaataaaaagatctcactgttcttctgggctccttccccaggcaagttgctccctgagctgctccaaccttatacagaacgtgtggaacatctgagtgaattcctggtggacatcaagccctccttgacttttgatgtcatccccctgctggacccctatgggcccgctggctctgacccctccctggagttcctggtggtcagcgaggagacctatcgtggggggatggccatcaaccgcttccgccttgagaatgtaacccctgagggagactggcagagggagtggatgggggacggggaaggccattttgagggggctgttggaagtaccatggccccagaggagagaagtgggggctcagggtggtgggaagaagcaaggaggaactggttctcagtttgcccgctgagtcggaggaggaggagcctgggtaggaaggggaggatgggggggcaggttggatgtcagggtcttcctctcactccctccttccctctttttaccctttcctctttaccccaggacctggaggaacttgctttgtaccagatccagctgctgaaggacctcagacatacagagaatgaagaggacaaagtcagctcctccagcttccgccagcgaatgttggggaacctgcttcggcctccatatgtaagctcctctccctccttccctcctgcttggtgtcctggcaatgctggagagtagaagctgaggggctcagccccaggcatgaggctgagggccccagtaactgtgggttccctttcacctatccccaggaaaggccagagctccccacatgtctctatgtaattgggctgactggcatcagtggctctgggaagagctcaatagctcagcgactgaagggcctgggggcgtttgtcattgacagtgaccacctgggtcatcgggcctatgccccaggtggccctgcctaccagcctgtggtggaggcctttggaacaggtaataactggggaaggctgaaagtggcctggagtgaggagctagccaggcctctgtgctcagttgtctgtctgtgttgtccagatattctccataaagatggcatcatcaacaggaaggtcctaggcagccgggtgtttgggaataaggtaaacaataacttcctaagggctcctaagccgctactagacccaggggtcagggtccagtggacctctctggtctggcccagaatgccatttccattgatctgttcccaacaccaccttgctcgggctggctgcctcttctagagaaggtaacctctgccctctgttcccctccccagaagcagctgaagatactcacggacattatgtggccaattatcgcaaagctggcccgagaggagatggatcgggctgtggctgagggtgagtgggagggaggatggcaacagctaaggggacagttaagctgtttcttcccctgggagcttccctgcccaacgtgggactgtctgttcaccctgggactgtgttctgcctgggagaacgtcggcactgctggcggtgactggggtctccccacaggaaagcgtgtgtgtgtgattgatgccgctgtgttgcttgaagccggctggcagaacctggtccatgaggtgtggactgctgtcatcccagagactgaggtatctcgccccaccccccacaccatccctactgcagatcctatcctgtgagctggaattcttcctgacaaatgtctcgtctgtgctcaggctgtaagacgcattgtggagagggatggcctcagtgaagccgcggctcaaagccggctgcagagccagatgagcgggcagcagcttgtggaacagagccacgtggtgctcagcaccttgtgggagccgcatatcacccaacgccaggttggtgcccagggcaaggccgggttgtggggaaggagtctccagtgggtactgcctgaccctgccctctcttcctcccaacatcctggcctgtctgaaggtggagaaagcctgggccctcttgcagaagcgcattcccaagactcatcaggccctcgactgaaaagttctcagtggggccagactggctcctggagctgacaagcgaccccgtggtgaggagaaatgggggccttgatgctcaccctggttcaggcccagaggtccaagctatactgtgcaggacatggccaggcctggtggacacaggaagcctacccaacacgctggtatttggccaacactgaggatgtggttcatgggggagcagtcccctccccactcttgcccatgggtgactcttacccacagctgactagggccagcgcaaatactggaacctgtaacagaattaaaggtgaatgttctgaga

SEQ ID NO: 36016 - DNA, 18884 bp, Homo sapiens
ggcggcggcagaagcggcgctcgcgccaagggacgtgtttctgcgctcgcgtggtcatggaggcgctgccgctgctagccgcgacaactccggaccacggccgccaccgaaggctgcttctgctgccgctactgctgttcctgctgccggctggagctgtgcagggctgggagacagaggagaggccccggactcgcgaagaggagtgccacttctacgcgggtggacaagtgtacccgggagaggcatcccgggtatcggtcgccgaccactccctgcacctaagcaaagcgaagagtaggtggtgtcccgccaaagggtgggaggggagattccggagacacgtgtaccccggttacacccccggaatctgggcttgggcggcaccccctgggctgcctccgggccctgggcgggcctggttctcacctaggagggcggggaggggaataaaggggagttctagctgtgaagaaaggtatggtttccactgatcagattttagaagaggtagtggttaccccaaaagccgcagctgagggaaagtgggtggccctagtcccgagtttgcatcgaggatgttgggcaaactgaaacagttcctgaaacatctcaaagtgccttcagcacatcctgtctttttcaggtactatttcagcgaaggaagacattgataggttgaataatgattcacaaaaagtttgattaaacagaaaagttgctaaacacagtgctcgggaggtcaaacatttcatttttctttcttcctttttgtttgcatcttacaaagattattactgaaagccaccttccccaaagcctgtgtagttaatggatattccttatgtttctcagacatgaagaacctattacagagtgtacttttgagggaaatgggggaaaaggttagaagtatgcatttgggttgatgataaacctcgtggcaaatttgtgtcctgccaatttggtttttgattatttgcatttctgtccagtgtacaaagctaatggccactttcaggaatgacacgtcagacgaagtagatactgtgaaagttgtagcctgctacatctggatgttaaaattaaccaaaagtgaacagtggctatagataaaggctgtctcttgcttgctattcagtaacctgcttttcctgcagatcatttgacattctgtaggtgtgtagttggtttttatggttcagttacagcatgttccatgccagtattcagtgaaaaaagtaatgcttcaaattctgaatccctagagttaaatggaatgttgttatgacttaggatgggttggttgggagtgataaatgagaaaaactgttttgtcctcttaaacatttacagttcttacttgctgaaagtaagtactttcagttaaccactttgggactttttttttttttttatttgagatgaagtcttgctctgtcacccaggcacccaggctggagtgcggtcgcgcgatctcggctcactgcaacctccgccgcccgggttcaagcgattcttctgcctcagcctcccaggtagctgggactacaggcgcgcaccaccacacccggctattttttgtatttttagtagagacggggtttcactatattggccaggctggtctggaactcctgacctcatgatccgcctgccttggcctcccaaagtgctgagattacaggcgtgagccacggtgcccagcctactttgagatttttaacaaaaccagtcttaaattttaaaatcagtatttccaagtcccactggttttacttgcctgggaaagtattttaaatatgtcagccagttaagtgtttacttacattacatatattttccataggaaacaaatctacttcaaagctttccctttaccagcaaaacttaacattttagttgtttactacatttctctgtcacatgtaggcttatctataattaaagatacaaagacttttgttagtaaagactattatggagccattaaggccatattttcaaataatttttagtaatatcaaaaactgttcataattaatttactgtttcctttaaggagaaaaaaaaggcgggatgcaacacgtggcaaatttgtgtttaaaaaagaacggaaaggccaggtgtggtggctcacgtctataatttcagcactttgggaggccgaggccatccgatcacctgaggtcgggagttcgagaccagactggccagcatggtgaaaccctgtgtctactaaaaatacaaaaattagccgggtgtgatggcgcatacctgtaatcccagctactgggcaggctgaggcaagagaatcccttgaacccgggaggcggaagttgcagtgagcccagatcacaccactgcactccagcctgggcgacagactgagactcttgtctcaaaaaaaaaaaaagtaaataactaaaattaaaaaaaataagactagaaagacagacatcagaatgttaacagtagttgatgggagttatggagagagaggatttaagtattctttgtacttctctgcatttaccagaatctttatgttaattacataatttatattcaagacaatttttgtttttttaataaatgcaagggattgctttgggaattccatttatagatcttagcaaagtaactaccattcttaaccaaatatttccaaaatcaattttcagaacaaaatttatttttcaaatatggttttcccagtatgctaaaatcattaaggcgtgtcattgtaatagatcattacaattattataacctctcacttgagtagcattttaagtaatttatttaaagtatatataattgaatactcttctgctgtctatttctccctcctggcctttacctaatcagatcaggattatatatatgaggtaggatgctggctcaagataagtaatcatatgttatatattaatttttaagagaaattcatgttgtttgtctctattttggagtgaccataaatggtggctgttacagagaagtataagccttactttctaggacccttagccaaacttagaagcaagcattgacttcagtgtttgtaaggggtctgaaagtataagtgctatctgaatgtgttaacagagcatgaaggtgcattagtatctaagtgtgttggctaaaattactgtacgcccttacaagagagcagcatgaactgttcagtttccattgggtcacttgaaacctgttcaagggagtcttctttcaaagccctctaggaaaatgatcccatggtctgggattttacacttctggcctgacatatttgtacattccctcctcattttgtgtagcctcatctgcagcaggtcctccatgtgtatgtcagaagctggacaaactagtacatctggaagactgccattagagaaaggaaaatctaattatttgaaatgtaggaagttgacaacttgaagcgggactatagtgaagtatccaggagggtttagtgcagggtagaatttaaggggtctgtgagcatgaataggggaaaaaagtatttattttcactaatccccatctgaaatttagtgtttccttctattatgaatgtcagcaacaaactacactatcttcagcagcacttgcttgtacctttcaccaatagaatcacttattttcttgctacatatggttatcgcaggtatcctgaaacaccattttcactcatcattatcttacgtagttgtcagattacaactagatcttgcagttttgaagtgttatagagcacatgtattatgatatcaccaattttttttaatatttttataattgcatttaaatacaattggtttcttttgtaattctatgtattttcctttttgcattcaataacactcttttaagaagtctgtaagcttcaccagactgccaaagagatctaaaggtagccctgatttttagtgattttctaaagatgtccttctaccattccaccaactttctcagtgttacagaacatcatgtattttattttcttagtttccaagccagcgccctactgggaaggaacagctgtgatcgatggagaatttaaggagctgaagttaactgattatcgtgggaaatacttggttttcttcttctacccacttgatttgtaagtaatacatgtaaatagctagtaaaatctcagtctttatcaattatttttcaggagtatcaaacaaattattttgttcagctcttggtttttaaaaaggcaagctgaagtaaagaaatgtatttaaaaaggtaacatctaccatatatttcagagtcataacacaccgacctcaatacttatgtctacatgattatgttataatggaataattagaggaaagctacaatatattcattaagctatacctactaaggcaagaaaatggactgataatatattagaaagcatttaatagcaagacctatgccataattctttttactgtatctctcttgattagaaaattaattctgtaatcccagcactttgggaggccaaggcaggtggattacaaggtcaagagatcgagaccatcctggccaacatggtaaaaccccatctctactaaaaatgcaaaaattagctgggcgtggtggtacgcgcctgtagtcccagctactcgggaggctgaggcaggagaattgcttgaaccctggaggcggaggttgcagtaagctgagatagtgccactgcactccagcctggcgacagcgagactccatctcaaaaagaaaagaaaaagaaaattaagccattttctctagtgataccatgtaactgtggtttttccatttttattctttgctgcatctgttgcttttctgggatttgaacattttgctgaaaatattatatactgcttaaggaataaggaataacacctgtgtatatgttatggttattgtggggtttctcgtctttttttaactctgtgacagtgagcgtttttgtatatggtcagaaagttgactaaaagtaaatacccttacagctttattcacgttgaggatttaattttattttacaaaacactattttgagtgtttttcaaaattcatgaaagtgagaagagaccaaaaagagttatgtcaatttttatcttttattctcttggaacttactttttggttacaacaaataactagaagtttcctcctctatctttgccactgtgcctttttccattaggactaatctggaactacatagatcaaatttaaacttgcagggagggtatacttaagctcattgctataggttgtttctaggccagggattaacaaattttttctgctggatttggcctattgacctatttgccaacccctgctctaagccacaaaggaagaattctcatgaaaattattacattgagactaaagttatgagtctgcataatatataatcttttaaattataagaacttgcttctttctaatcaactcatattgtgacttgatttttttaagtatagcttaatttctaatagaaaccagaagtagaaatttcagtagacataaaaaatgacaggccttctaaattcatgttgttataaaaccagaaggttaacatgtatgttaaatatatacgactaacaccctgaatttggaagttagtctaatgtagcagaaaaatatgttctgtgtttctccattgttattcataactccataatgggtaagagatagttaattggagcatgttgttagcaatggtcttctgggacaaggagctaagatagcctcttcctgttttcatgtaatgctggactgtgcctggttagagaaggaagaattctggggcatttgccacagtctacaaggaggaaagttacaaacgtaacccttcagtttcctgccaaaactttttctgtcttcactaagaagttggtcaaatgtatctctaggtagcattccttgaaataagaagaaaggcagaggctgggtgcagtggctcacgcctgtaatcccagcactttgggaggccaacatgggcggatcacctgaggtcaggagttctagaccagcctggccaacaaggtgaaaccccgtctctactgaaaatacaaacaaaattacccgggcgtggtggtgggcgtttgtagtcccagttactcagcaggctgaggcaggagaattgcttgaacccgggaggcggaggttgcagtgagctgagatcgcgccactgcactccagcctgggtgacagagtgagaccctgccacaaaaaaaaaaaaaaaggaaggctgaggctgaccattcctaccctttagaaaatattaaaaatacattttatagcccaggtttccagggacatcatccgagattagaactgtctacttggacatgacagtgctgtacctgaatacctgaaacatgttaaaatcctgtattggtatctggtaggaacttgtgccctaactaagtctatgtttttcaaactttcttgaccatgtctcacagtaggaaatacatttttcgttgtcagccagtacacaggcacatatatatacggtaacattccatctggatgcaccagcacagccatgctccttaaaatactgaaaaaccctcatatcatgtggtaaatagccacttccctttcctcaccaactagttagtcctcctgcctgatccctttcagaaacctccagaactaaagccagctttgagttaagattgttaaatattttgaatatcatcactgttgaagacaaacatatatatttgtatatataaatatgtgtttcataatttacccttagtatgtatgatagagtctcctgttttctattcgatttcactttttaaaaatattttttagaactcagttaatttaaggagtccctaccacggtttgaaaaaatgccaccctagtaatattctgtaaacatggcctgacaacatgagggtattaaggtataaaatccctggctgcacaggactggtagacaaggtggaagaggaccttatcaagaaaggaggggtgggggtactggaaaacattgcctcctctccaaaatacacatagatgcatctaattcatagggttggtataggaatattaaaaaaaaaatagtgaaatgacataaaatttgtatagatcctttgaaagctataaaatactatataaataaaaggtattattaaataaaagtaataaaatgaggggtggctattgctataagggagaagggaacattggttgactactgatctattaagttgtaataagaaagtttattgagatgtagttgggaactctgtaatatgtttctgtcttaaatatttgattaaatgacagtcttttagactactccattttgaaaaggttcaaatataaaattgttcttaatgtgcatttttattattaaaggtatttgtaaaaattgtcatttgaaagtttaggtatatgcttatttggagaatactgaatatttttttttttttacctttcagcacatttgtgtgtccaactgaaattatcgcttttggcgacagacttgaagaattcagatctataaatactgaagtggtagcatgctctgttgattcacagtttacccatttggcctggtcagtatcttacacttatattcgtagaaaaaaaagaatggatttactcttaaagcatggacagataactcttgatatgatataagaatatagtcatttatcagacaattcaggaatagctttatctaagagtaatacatgtaactacacattttccaggttaaaaaaagagagaagagtaatataatcagctgctataataaaaatgcttaaggattttataggacatttcaaaataaggggaaaagttaaatgcaatagatgtgatttctatagcgaaaaccactgaattatatgcttatgataaattgggttaccataatctggaggaaaaaaatctttaaaatatgccatttctctgttacacagttatatagtcaaactcagcttttacaattttgaagaaacaatactttttaaaaatgaattttaaaaaatgtttaaaaattcattaatcataaaaagatgttttacctaaattcgttataaagaattgcaaattaaaatgacgagatgccaattttccctgtctggttggccaagatttaaaagattgaaaaaatgtatccactgtggacaaaaattgaagaaacggcactcacacacagctgtttagcatttctggagagcagttgggcaacatgtctcaaaattggaaatttacatgttaatatgagtttttatagtgtccacagtcttgtgcagaaaactttgtgcacaataaagaccattcagaattgggctgggcacagtggctcatgcctctaatcccagcactttgggaggccgaggcaggcagatcacctgaggtcgggagttcgagaccagcctgaccaacatggagaaaccccgtctctactaaaaatacaaaattagccaggcgtggtagcaggtgcctgtaatcccagcaactcaggaggctgaggcaggagaatcacttgaacccaggaggtggaggttgcagtgagccgaggtcacgccattgcactccagcctgggcaactgggcaatgagagtgaaactccatctcaaaaaaaaaaaaaaaaaaaaaaaaaaaaaaagattcagaactattggttttaaaacataatattcaatttattaaagttacaaatttgaaacacaagcttttctcatttataatctgtgtgtgtataacaaattttcattgcttggtgagctacaatttaattaattacatttccctaagaaattaattcccataagtatttttaaatgcagttatatatttaatatatttgaattccttaagtatctcaattttcagacaaaccttcccaaatacttaagtagttctaatatgccaaattctcttaaacattataaataacttaacatataaatatgtactgattatttcttaatgtaaaaatattaaaatagcctggcatggtggctcacgcctataatcccagcactttgggaggtcaaagcaggagaatcatttcaacccaggagttcaagaccagcctgggcaacatagtgagaccccatctatacaaaaaataaaaaaaattagccaggtctggtggtgcatgcctgtggtcccagctactcgggagcctgagatggaaggatgacctgagcctaggtggtcgaggctgtagtgagccaagatcataccactgcacttcagcctgggcaatagagtgagatcctgtctcaaaaaaaaaaaaaaaattaaaatataggcttaatttgcttcatcatttcctttaaaaaaagaaagacagggtcttactatgttgcccaggctggagtgcagtggcacaatcaatcatagctccctgcagccttgaactcctgggctccaacaatccttctacctccccaaatagttgggactgcaagcttgcaccaccatacctattttaatttttatttttgtagagatggagtcttgccatgttgcccgggctgtgcttcatcacttctgtagtaattataaatcttccgaggattaaaatgcatatccactaaggaaaaagttatggcatcccaaataatttgggattgctttcccaaggaaatttggggatacattctcagcctgatagggttcacatcaaccagaaatttctacttgggtgtcagaactggggctccagatatctagagcaatgtcgttttgttttctatctgctgtgtcagtaccctcctgttagagcatcagcccatgtctcctggtttcaagttacagaatacagattgagcgtccctaacctgaaatccacagtgttccaaaattcaaaatttgagtgctgacatgatgctcaaaggaaatgcttagtgaagcatttcagagttcagattagggatgttcaaccagtaagtatgcagatataccaaaatcggaaaaaatcctaaatccaaaacacttctggtcccaagcacttccgataagggatactcaacctgtagtgaagactgaggcatctgatattataactcacttccttcactgcttcaagtggactttgcatttgtctctcagaatattaaaatgtcatccatttgtatcctgcctgtctgttcaaggctttatcttatgatcacactactaaggttatgcttttgatactacgtatcttttgatctatcagtttcactttcagaaatcaattagacaagtgtataaaagtaagaatacaaggatgttttcagcagtgtttataaagcaaaaaaaaaaggtaaatggtttaaatcttcatcatggaattaagtaaaatacagtaaagatgttcctgacttacgatggtttgacgtataatttttcaactttacagtgggtttatgggatagtaaatacatttttagctaatgatattttcaatttatgatgtgtttatcaagacacagccccagccgggcacagtggcctgtaatcccagcactttgggaggccaaggtgggcggatcacctgaggtcaagtgtttgagaccagcctggccaacgtggcgaaaccccatctctattaaaaatacgaaaaatagctgggcgtggtggcgggtgcctgtaatcccagctacttacaaggttgaggcagcagaatcacttgaacctgggaggcagaggttgcagtaagccaagatcgtgccattgcactccagcctgggtgacagagcaagactccatctcaaaaaaaaaaaagaaagaaagaaacaaccccatcttaagtcaaggagtatctgtgtatccatacattaaaaatgtgttataggccaggcgcggtggctcacgcctgtaatcccagtactttgggaggccaagccgggtggatcacctgaggtcaggagttcgagaccagcctggccaacatggtaaatccctgactctactaaaaatgcaaaaatcagccaggtgtggtggcacatgcctgtaatcccagctacttgggaagctgaggcaggagaatcgcttgaacctgggaggcagaggttgcagtgaaccgagatcacgctgctgcactccagcctgggcgacagagcaagactccgtctcagaaaaaacaaaaatgtgttgtaggctgagcacaatggctcacggctataatcccagcactttgggagggtgaagcaggaggattgcttgaagccaggagttcgagaccagcctgggtaacaaagccacaccccatctctacaaaaaagtgtttaaaacattagcccagtgggatggtgcacacctgtagtcccagcttctcagggggctgaggcaagaggatcgcttgagcctagaagttttaggctacgctgagctatgatcacgtcactgccctgcagcctgggagacagagcaagaccctgtctcaaaaacataaaataaaaatgtgttgtgtatatatatttttaatgtttaaaggatatgaatatattaaatgggaaaagcaagaaaatagaaagtatattagcctgtttttgttagtgaaagaatgtgtgtatttcatgtgtgtgcgtgtgcatgtatagagaaagagtgctgttttaatatatgccgtttacttagctctgagaggtaagcgttctgtttgttacaggattaatacccctcgaagacaaggaggacttgggccaataaggattccacttctttcagatttgacccatcagatctcaaaggactatggtgtatacctagaggactcaggccacactcttaggtacctttcagtggttttatattatgacaaatccaagcgtgtttataatcctccttgaaatagatgttatttatgaaatagaagaacaaattttgatcaagaaatataattttgaggccaggcacggtagctcaagcctgtaatcctggcactttgggaggccacggtgggcagattacttgaggtcaggagtttgagaccagcctggccaacatggtgaaaccctgtctctaccaaaaaatataaaaattacccaggcatggtggcgtatgcctgtagtcccagctactcgggaggctgaggtgggagaattgcttgaacctgggaggcggaggtttcagtgagcccagatcatgccactgcactccagcctgggcgacagagtgaaaaaaaaaaaaaagaaataattggctgggcatggtggctcacgcctataatcccagcactttgggaggccgaggggggcagatcatgatgtcaagatatcgagactatcctggccaaccaacatggtgaaaccccatctttactaaaaaatacaaaaattagctgggcatagtggcatacgcttgtagtcccagctactcgggaggctgaggcaggagaatcgctcgaacccaggaggcggaggttgcggtgaggcgagatcacgccaccgcactccagcccaggcgacagagcaagactccgtctcaaaaagaaaaaaagaaagaaagaaaaatgttactttgttctattagtctttaaactactaaacttaaaccgttagtttatattaccctgattaaactatgttagcatcatagacttttagagctggaagattatttagaggtctttcacccaccctgtcatcttacagataaaagagacagattcatagagttccgtgatcttagccaaagttatataataatttaattgcagagcccagacttaaatccaggtcccccaactccttgtccatttctttttccttttttgcaacctgactccagtaatgtttttttctaaatacaagtgtcatactacttagcaaacctgtgtctttggagtaggaaaaattaaggaaatattttacccagacgctctcactgggttacttgagctaacaaacattaatagaattctttgaaaagggggcaattttagtgtggaacagttgtaatttggttgtattgatttgctttgtagtgccaatagtttttcttgaatgttttatgtgaaagtgtcagtattttataatcctgtgtttttttataacaactttattggaatatagttcacatataatacaatacccatttaaagaatacaattcagctgggcatggtagttcatgcctgtaatcccagctctttgggagacctaggtgggaggatcccttgagcccaggagtttgagactagtctgggcaacataacaagacccttgtcttctacaaaaaaaaaaaaataatttttttttgttaaattaggccattgtggtggcacattcctgtagtcccagcctactcaagaggctgagataagaggatcgctagagcctggaagttcaaggttgcaatgatctatgatcacaccactgcactctcgcctgggtaacaagagtgagaccctgtctctaaaaaaataattaaaattaaaaataaagaatacatagccgggcgcagtggctcacgcctgtaatcccagcactttgggaggccaaggcaggcggatcacgaggtcaggagatcgagaccatcctggctaacacggtgaaaccccatctctactaaaaaaaatagaaaaaattagccgggcgtggtggcgggtgcctgtagtcccagctactcgggaagctgaggcaggagaatggcgtgaaccctggggggcggagtctgcagtgagccgagatcgcgccactgcacttcagcctgggcgacagcgagactccgtctcaaaaaaaaataaataaataaagaatacatttcagtggtttttgtgtattcacagagttgtgcaaccatcaccacaattttagaatgttttcatgctccaaaaaaccccatacccattagcagtcactccatgtttcccctaacccacttcccctggctttaggcaaccacaaatctactttatgtctctatagttgcctattctggacatttcatataaatggaatcctacaatatgtgcttttatgactagcctctttcacgcagcataatgttctcaaggttcattgtattgtatcatgtattgctaccagtagtttcccctcttttgtacttgctaagtatttaatgttttctgctttcataaaatctgttactaagttaatttccaagaataaatatgccccaaaaacgactgaggcagttttaaaatgtggaatcatttgaacattaaccaagtaaaattatctaacgttagctatattatttgacctgagccagtagtttctttttaaaatttttttgttaaggccgggcatggtggctcacgcctgtaatcccagcactttgggaggccgaggcaggtagattgctcaagtccagcagtttgagactagcctgggcaacatggcgaaaccctgtttgtacaaaaaatacaaaaattagctgggcgtggtggcacacacctgtagtcccagctactcagtaggctgtggcgagaggatcacttgagcccaagaggttgaggctgcagtgagccgagatcatgccactgcacttcagcctgggcaacagagtgagatcctgtttgaaaacaaataaaaaatttattatttattttcaaaataatacatgtacatatgcacatagtttttaaaggtcagattatcttcaacaactgtaaatactctggtacatttcttagccaaaaacaaatttttaaagctgcagttttacagtgataattccaaattatacattagattgagggagggatgtccacaggtgtgtgtacgtgtgtgtgtgtgtgtgtgtgtataccattggagtaggtaggtagtgtggtgtttgttctgtatagcatccttttgtgtggatggtataggaattcacaatacataaatgagaagaaatgacctcatctctaccattcttctgttttacagaggtctcttcattattgatgacaaaggaatcctaagacaaattactctgaatgatcttcctgtgggtagatcagtggatgagacactacgtttggttcaagcattccagtacactgacaaacacggagaaggtacctctcccttctaaccttttgattttttagtttgaaagatagcataattagttaggtttcttatcgtaaaagtaatcgatatttccaaagttttctgattatttacaaattattagcagatccttttaacagaccaaattataatttacagtgctttaacaaaatatcaggccaggcatggtggctcatgcctgaaatcccagcattttgggaggccaaggtaggaggattgcttgagctcaggaattcaagaccagcctgggcaacccagtgaaacctcacctctactaaaaatcaaaaaaaaaaaaaaaaaaaaaaaaaaaaatatatatatatatatatatatataaactaatatattctgcttactaaatgagatgcaaaaatattcactatttgcatagtcctttttgataaactcaaagacaaaagtttctgctactgcaatttttaaaattatgtttctgcaagcttagaatgtgtcaatctggcaacatttagtgatgtagttttcatttgcctctttgcattattgaatttagccttttaaataatccttgatcacttctctgcctttcagctaagatgaagtatagtaatgtaatctctgggcttattcagtatcacatttgtaatctacaagttcatcattttgctaaaatagaacacattatatattccttttaaaaatgtcactgagtcaggatgcattctaatgtctcttttgacaaacagtgaatcatgtcatcagtacaaagtactgaagtatacatggcaaacaagcgtactggaagtttatgtaaatttggaggaatttttgccatgcccaggcctttcagctcaccagattcccaaactttccaactgtattagaggggcaatcaatttgatttcttatattttaaatgtaactaaacataattggtaaaaatgaaaatagattagctgcctgcttatgagctccatgactaaaattccttggtgtcaacaggcagctaatagaagtcatgtgctcggtggtctggaaatgttcttattagtatattctattcagtttcatatagaaacagaaaaagtcagttgctgaaggtaactgaattctgtttttaaaatgtcttctgcctctttttgtttcttttagtctgccctgctggctggaaacctggtagtgaaacagtaagtatatatatatgtttttatgttgagttgatggttagagttgaaaaaaatgctggccgggcgcagtggctcacgcctgtaatcccagcactttgggaggctgaggcgggcagatcacgaggtcaggagatggagaccatcctggctaacatggtgaaatccgtctctactaaaatacaaaaaaaaaaaattagccgggcatggtggtgggtgcctgtagtcccagctactcgggaggctgaggcaggagaatggcatgaacccgggaggtggaggttgcagtgagccgagatcatgccactgcactccatgctgggcgacagagcaagactccttctcaaaaaaaaaaaaaaaaaaatgctaaccttagaataatcttcccttgttactagaactgtcttgattttgtaaatgaagtaaacattgctaagcagaaatcagagtacagacattctttggcctgtaggaagagtagctgaaaccggagaaagcagaatatggggcgtgatgctgtgaattttaaagccaggtatacagataaatacaccgttcgaaaaaaaaaagtagggcagagtggagacttggtagaataattcagaggtcttataggtcatgtatcgaatttcttcctgtattgggacaaagaaaacagtcacaagcaaaacctttctatgcatagtaagaggttttgagaaaatctagctcaattaatactgaagataatgattctctccttgtcatgaagaaagaaaagattgaaacacgtatattctttcatttaggaggctgtataatttttttttcttttttgagacggagtcttgctctgtcgcccagactggagtgcagtggcatgatctgggctcactgcaacctccgcctccagggttcatgcaattctcatgcctcagccccctaagtagctgggactacaagcctgcaccaccacacccagctaatttttgtattttttggtagagacagggtttcaccatgttggccaggctggtctcaaactcctgacctcaagcgatccacccacctcagcctcccaaagtgctgggattacaggcatgaggcaccgctcctggcccaaccaacctatttatgaaagcatttattaccacaacctaaaattagaattaggatataactccaagggcagggactttggctgtgttgttcactaataaatactgcctatcataataccttgaatagtttccatatagtgagtctgttgaaagaacgtccaaacacataaatatatacaactattatttgtcaatcaatcaaaaattaaaaagaatgaccaccacagtatgtgataacacgtatgcatttttctggagggagaatccatagttttcaccagattctcagagatttgtggcccccaaaagttaatcatgtaaatagtcaacatgttttccgaaatgtccggtactcatcctataatacctttcagagtgaaattgtacttcttgggagctctcactgatctctgggaacttggacacctagcacatgcctgtgattggagatgatgttttcatcagtcacagagggttttgctgcacctccagggggaagtgccccctaccttgaagatgtgtctgaaatgctttttaaggcttcttaagctgctgcttaagccagcagcttctgattcatatttctttctataagcctcataatcaacaaatgtaaactaatgtgactgatttatactttaaggtacctagtggtcaaagtacctttaatgtgtaatttcaaatcccctttgagatccatcagattaacatagagatgagtaagtttgctattgtaacattaactttgacctcaaagcaaaactgttttgcaaacccatcagaaattgattcagaatcagtcaattacaaaagttacaataagttatttttatatatataaagatagatgtactttacctataactagcaaataacataatgtgaggccaaattatattggaaattttttttaagtctaacaggattctaaggctgtgatgctcttagagggaacacaacagtattcattaactattgacagtagtgcttgatgtatttgagtttgggttttttttttgtttttttttttttactttgcagcttgagatttaaaaggtgtattctggactttagtgagcccttagtgaacacctgcctccttttcagataattgtgacataccatcattttagcagcatgattttaaaagtacattaacatctgtagccatgctctctaaatgtgtttgacttaattagatcaaacctgaagataccatgaaagcctggtggccaagagagagctgtaagtaagttttggggtgcttgagtacagatgttaatttattcacacaaaataaaaatatttgtcttttggaatagccgaaattagtaggcaggacaaatctcatttttttctaaatatacaatctgatatacaaaaataatttttagtcaaggcatgggcaactaatgtcagactactcattatgtactttggctttaaaatgaataatttcctttcttcgttttgttttaacagataatcccagatccagctggaaagctgaagtatttcgataaactgaattgagaaatacttcttcaagttatgatgcttgaaagttctcaataaagttcacggtttcattaccac

SEQ ID NO: 36017 - DNA, 36814 bp, Homo sapiens
aaagctgcagcgtctggaaaaaagcgacttgtggcggtcgagcgtggcgcaggcgaatcctcggcactaagcaaatatggacctcgcggcggcagcggagccgggcgccggcagccagcacctggaggtccgcgacgaggtggccgagaagtgccagaaactgttcctggacttcttggaggagtaagtcggcgagcgccccgggcctcgcccgcctccggagcctgcggcgtctgggccaggcggtgccgtgtgggcggcgggtgttccggaacctgggggtcgcgcgtccgggaagcgcctccccgcccgccccccaactttaggctccgagcccggcggccgcgaggagcctgggacaggctgggtttttctggagtaaaacccatctcgagccctaagacgctcgtgcccagtgctcagcgctttgcttctgtcacttgatgctcaccaccccgcgagcctggtatttgcacagccctcggtgaccggcgcggaaacctgggctcgctgagtatagtaactgggccgctgggtgcggccaggtcgagtgggaggccgaagtgccattgaatctcgtcggtgccctgctgggccacgcagccgggagcatggtgctgggggttcgcagggcacgggccaccctcgcctcttgtgctgatgaaagtttctgcgtcaactgtggtttgaaagctgctggggggcggagccctgccctgcagagagtagctcaccatatcccttcttctgggtcccttgctcccctttccctctggccttcctttcctttctctactcttctttttttctgtgcctctgggctcctagcttcataaccccaacctcctccctggcttgcctcacccaccggttatttttcctggagcagatacaccacggcctccaggatgaagggtcagcagtttggaatggcttttgaagttcttttttagtaaaatatacataacaaagttgaccattttagccatttttaagtgtagagtccagtggcactaagtgcattcacctcgttgtgcagccgtcaccactctcccatctccaaacttttttttttttgaggcgtaatttagcccttgttgcccaggccggagtgcagtgtcaccatctcagctcaccgcaacctccgtctcccgggttcaagctattctcctgcctcagcctccctactagctggaattacaggcatgcgccaccacgcccggctaatttggtattttagtagagatggggtttctccatgttggtcaggctggtcttgaactcccgacctcaggtgatccccccgcctgggcttcccaaagtgattacaggcgtgagccaccgtgtccggctccaaactcttttcatcttccaaactgacattctgtgcccattaaacacgaactctcctccgttaccctctccctcagccaccgtcacccaccactctgcttcctttcattatgagtttgaccactctaggtacctcatataagtggaagcgtgtagtatttgtccttttgtgtctggcttgtgtaacataatgtctacaaggttcctctgcgaggtagcatgtgtcagaatttccttactttttaaggctaaataacattgtctgtacacattgagtatcccttttctgaaacgcttgggaccagaagagtttgggatcttggatttttttttcagatttggaatgtttacattatacttaaccaattgcatccctaatttgaaatgctccagtgaaaatcatgtcagcactcaaaaagtttcagattttggaccatttcatattttaaattttcagatgagggctgctcaacctgtatatatactgcattttgcttatccattcagtggacacaggttcattccaccttttgtctattgtgaataatgaggttcattccaccttttggctattgtgaataatgctgccttcttaggaaattttggtatacttaaaaccataatttaatttccatttcactacctatggcaatgttattgtctgcctgatagttcctccttcaaagcccagctaaaaactcacacctttgtgaaaccttgtacacctttttgagaggcactaatcctttcttccttaggctcccagggtgctgtttgtttttcattatctctggcagtgtaacacatttacctcctagctacttagtctggaattcaaattccatcctcaaccccacctacccaccacatcacattacaaaggtttttcaataaacgtttcatttcaacaaataatctaagtgccttgactttgcagctagatgataatgatgagacaaataatctctgtgctttgtttaaagaaatgccaactccctgtcacaaaataaactttaattcaccattgcttgtggaataaagttcaaattcttcatcactcctctttcctgtttgtcttacaaaaacaccccagtcatcatccacacttctcccctaccttctctgacttaatcacattcttggaatcatctagtcagtcacttcaccacctgtttttatttgaaatttttaactctttcagaagctgaattccaacgccaccttttatatgtataacttgtagttgtttttttaggcagaattagtttctattcccctagcacatttcttgttcttctcattaacaggaacatctttcttgtctgtcttcattgcttacatgtctaactccctagacgcagacaaagtgttagttaaccctagggcaggaacaacactgccattttcagcctcaggtacctctgttatagggctttgcacgtagttgtttaacaaatattttaaggagtcagaacatgctgtatatggaggagaaattgattttttcttaaggcgaatctgcatattatgtttgaaagaacagaaataaatttgtatgatatcctgcttgggctttagaagcaaaaataccagcagctttatttagtgtgcctgtttcaattttcccgaagtcttgggctgtgaaacacctcatttccatgtattcttatttctgttctgcttcttaaatccctgactaatttgttagtttgcaaattccctacagaaatggaatcattgggtttgagactgaatttcttgatttaacattttccaatcttaattatacatgacagtagtaaaagaagagttagttgttgggtttttttgttagttagcagttaaacctcacaatcatggtggaaggcaaggaggagcaagtcactgatgtcttacgtggatggcatcaggcaaagagagcttgtgcagaggaactcctctttttaaaaccatcagatctcgtgagacttactatcagagaacagcaggggaaagacttgtccccatgcttcaattaactcccaccaggtgcctcccacaacatgtggaaattcaagtcgagatttgggtggggacacagccaaaccatatcagaagggaggagtaacttgccccaagttacagaactgccaaacatgggcctgtctgagcctagttgttggactttaaccaatgttctgaattatcattcaggttctttgtactgcctgtgtccttaatctagttgactcgaatgtacctgcaggtttcagagcagcgatggagaaattaaatacttgcaattagcagaggaactgattcgtcctgagagaaacacattggttgtgagttttgtggacctggaacaatttaaccagcaactttccaccaccattcaagaggagttctataggtatgggcatattaatcttctttactttgaataggggttgaaatccgggaagccagctcttcttggactgtaagtgttcacttgtgtagcagaaggtcagctttcacagttatttcccactgagaagaggcgctttgatactgccagtggtcgttttagtactgctctgaacttcatgtaggcctttgtagagccgaacgtttttttgttgttgtgttttgtttgtttgtttgtttgtttgttttttgagacggagtcttgctctgtcacacctaggccgaaatgcagtggcgcgatcttggctcactgcaacctctgcctcccgggttcaagcgattcttctgcgtcagcctcccgaatagctgggattacaggcgcccaccatcacgcccggctaattatttacattttttaatagagacggggtgtcaccatgttggtcaggctggtctcgaactcctgatctcaggtgatccgcccgcctcggcctcccaaaatgctgggattacaggcgtgagccaccgtgcccggccagagctgaactttttttttcaaatacaaatgttgaaaatctttgctttctatatagttttcccaagaggaaaactgtacttacttacttttgtgtcattccattgatcctttttccccacaggaataggtgtttgtgtgggtccttttcttgtactggggatatctttacagcattgacgttgttgtacttcttgttcccttaaagtttaattttgttttcgcttataaaagtaataggtatatattgtagaaaatggagaagagtaaggagaattaaattgcttatacacttgtaatccaccaccgtcattagcagatctgctacaacagagttccaggagccttccaagtctgcaagtgcagagttttgtaaggatcttctgtcacattttgatgtctttgtgtgtatgctgtgtatgaaattactcaaattcatataaaatttcttaaactcatactaatagctccaattgtggttttttggtagaaatactatggttagacattatatttaatagaaggcttttattttgttttgacttgttatatatagcaagaaacatctttgcacacaagactttgtattaggattaaataaatgtgacagtctatagaaatagaatcaggttaaaataaattgtggacagttgtgaaagataaatgaaaacccagggataaggaggcacagtctcgttcatttcttagtagattaggagatggaggatttgtctgtgtttctggtcatagctgatgatcaagaataattggagggggtaagtaagcaacaggatttattgtgaaagcatgcagcagtagaagttatagcactgacaaataagggagaggtagacaatcaagcctggtggtagaagcagctgtgccatgcctcatgcacaagccaggcagcagttctctttcctgagagtagcgccttttttagagggtttcagaccccacttcttaaacaaactaagctggagtaggtattagaaacatatcaaaaggacatgcatacttcactctcaccagtcaaatggagcatttttgccaatttgttctcacattagtgcacaaatacttctcctgtcctcatccatttcttatcaaaccagccagatgtggtggctcacacctgtaatcctaacactttgggaggctgaggtggatagatcacttgagcccaggagtttgagaccagcctggacaacatggtgaaatcccatttctacaaaaaaaaccccacaaaaattagctgggcatggtggtgcatgcctgtagtgccagctactcagcaagctgagatgggaggatcacctgagcctaggtagattgaggctgcagtgagctgtgatcgtgccactgcactccagtctgggtgacagagtgagaccttgtctcagaatgaaaccaaagaaattgactgacttgacacatgacttactaagtcataaacagcccacagaaaattcacagtattgagcataatattgacaagatgattgttcagctagtcatcttggacagaggaatggccaacagtgtgggtgctgtatgattatttatgtgctatatgataatcaggtatggtatgacattttatatttagtgttccggtgggataggagagaactgaaagagggtcctaaacctagagtagataatagaagtgtcctacacagttaagttctaaggtttagttgtaaccagatgaaattccttaatctcggctgttggtaggtatgtaaagggaaggaggccttggtaaacctctaaggtatcagctgacttttttgtttttcagagtttacccttacctgtgtcgggccttgaaaacattcgtcaaagaccgtaaagagatccctcttgccaaggatttttatgttgcattccaagacctgcctaccagacacaagtaagaaacccttctctggaaaaaaaggaattcaccaaatggtataagtaccacttagctgacagtcagaaaacttgagaggttgccttgatctgctattagctggctatttaacattatacaaatcacttttacctccctgagcctcagtttccttgtctgtgaagtcttttggcttaggttttctacctaaatcatgcaaaaaataggtttgttgctgtaaaattactttttcataattgataatcacaataattataaaacaagtacttataaaattgatgctgtaaaataccaggaggaaaaaatagtggtttgcattcagattttgtagaaggttgacttttgtaggagttatacccacttatccagaaagtttagtgttggagaaatgtattttcctatggagatgggattagatgtaaagggagtgaagcaaatttttaggattatcacattttagggcgccttttagggaaatttgggagaaaattgatcaagggagaaaatatgaaattctagaaattcctgaatctctggaaatttttgttggtttaaatgcataattttcaaacacccctttggcagttattttaagaataaatttactggataaaattgaagtgatattttgaaaagttaaactactgaaattataaaattaccaaattacttcacataaaatgggtttgtaaaggaagtgtttctgaactttgagtacaaaattttttctcatgataggattattatgtaacacatgcttttttttttagaaattgcgggtaagcaaaaaagtatttgcatataaaacaaaaacaggatcattctgtttttgtttttttttttttctgagacagagtcttgctctgtcacccaggccagagtgcagtggcacgatcttggctcactgcaccctccacctcccgggttcaaacaattctcctgcctcggctccccgagtagctgggattacaggcgcccgccaccacgactggctagtttttgtatttttagtagaggtggggtttcgccatgttggccaggatggtcttgatctcttgacctcatgatccgcccaccttggtctcccaaagtgctgggattacaggtgtgagtcactgcgcccagcccgttctgttttataattttaattttcatttttttggcatcctttagttcatttatatattttgttctggatacatatacgtcatataatttaggattgggcacgttgactaaattattcttataggagagtccaaagaataccttgtctcttgaattttttttttaaacataaattatctttgaataccctctcactaaaatggaaagattcttagttaagagatgaatgtttactaatgggacatttgtctttaaacaggattcgagagctcacctcatccagaattggtttgctcactcgcatcagtgggcaggtggtgcggactcacccagttcacccagagcttgtgagcggaacttttctgtgcttggactgtcagacagtgatcagggatgtagaacagcagttcaaatacacacagccaaacatctgccgaaatccagtttgtgccaacaggaggagattcttactggatacaaataaatcaagatttgttgattttcaaaaggtatttatttaacatctgtttagatcagagtccatctatgataataattcacttctaggcccttgcaatagcttatttagataatgttcaactcaatttttatgtaagttaagcatcatcaaaatgactacaaagttaagcccaaaactgttcatgtaaattataattgttagtatatacatttgttttaactttcagtaacttggaagttccttaagactgacaagatgtatttgtcaaagaataaatggtaactaggtggtggtggttgtcattatgaactggagttaagaaaacttaaagaaatagcaacttgttagtgtaagatttccatttgctgcatagaaaggaaagcatgaataggacaggctagcttggaagcaatgaggattatcatgattgaagtaaaggagccaaattggagatcatctgagagatgatttgatgtgagacctggaggtacttggatccctaaatcttaggctgaggagtttgagcctatcttaataagcagtgggaatatagtgggaaggtagtttgtgtgtgtgggtgtgtgtttgttttgttttgttttttgtttttttttgagacagtctctctctgtcacccaggctggagtgcagtggcgcgatctcggctcactgcaagctccgcctcctgggttcacgccattctcctgcctcagcctcccgagtagctgggactacaggtgcccaccaccacacccggctaattttttgtatttttagtagagacagggtttcatcgtgttaaaccaggatggtctcgatctcctgacttcgtgatccgcctgcctctgcctcccaaagtgctgggatacaggcgtgagccactgcacccagcctgtgtgtttttttttaaaagcaaactgaataagtccgtgatgggtttaacagagggtaataggcaatttcagttacctgggcaagaggtgatggatggcagtagtaagaatgaaggggaccctcagatttcagcaggacttaattttatgggacatacaaaatggaaagaaaagctgaagcagctcaagtatggaataattattatcagatgaatttaatattatttatattgctctgataatcattctccttatttggctttcttacattaacctggtagcttataagatgcacatattttaccaacagctttgggtaggagatgtcttatcttataaagtatgaatctagattgggtcttagtttgggggggggaacacaactgtataaaggacactcttgacaagacatttgaagatggactagataatagaagatatgtaattttatgaaattaaatattgtttaattatcttggttgtgataatgatattgtaacaggattgtctttattcttagagatgaatgctaaaatatttaggtatgaagtttcttgatgttcacaactgtgttcaaatacatagtaaaaaaacatgtatctgtaaataatgttagcagttgtgttgaagtggagggtataaaaggtgtatttgaaattttctgtaaaattatcttaaagcttaggagaagatggagcatggaacagatatttggagtcattttgaacaaagaaaaaaattattttttaatgagtaaaagtgaagttttttttttctctgctgcttgaatcatcatggagtttttaaatagatgtaatctcttgccaaattgaactatttgactaaaaggagttttagagtagataatttttaggataaatgttggtacatgtgaaaagtctgctaatgggtcagatagtttagaatacgtccgtatttgtggtatttaatttagattatatggcatctgaaaggtattgcttctcattcttggttggttgtttgtctgtattacaggttcgtattcaagagacccaagctgagcttcctcgagggagtatcccccgcagtttagaagtaattttaagggctgaagctgtggaatcagctcaagctggtgacaagtgtgactttacagggacactgattgttgtgcctgacgtctccaagcttagcacaccaggtcagtaatctgtggctcaaatttaacaaattctcagttacctaaactgcacagtatctagcttcccacatcttcattgtcttctttttggctaccaatcagaagctgaggaacgaagtgtgatgagaataaaaacaaattggttttgccacaaatggtgctattctgaaagtattcaaggcttaagtgaagtctttggatttatagctttcatttatttgagcaattttgatgttcagcacctttaatatttaagttgtgaaacaacctatcattctgtttcaggagcacgtgcagaaactaattcccgtgtcagtggtgttgatggatatgagacagaaggcattcgaggactccgggcccttggtgttagggacctttcttataggctggtctttcttgcctgctgtgttgcgccaaccaacccaagggtcagtcgttttgggggtttttgtttgtttttgaaacagtctctctctgtcacccaggctggagtgcaatggcaaagtcatggctcactgtagcctccactttctgggctcaagtgatcctaccatctcaacctcctgagtagctgggattataggtgtgaatcactgcacccagctaattaaaaaaacttttttagagatgaggtcttgctctgttggccaggcaggccaacagtgagtcttagtagagtgacagcttaagaaacacctaccctgagctgccacgaaatgataggattctgaaacatctgggctgtctcatcaatgttgagagcacgggatggggttaagatttgatgagttttaaaaccaaatcttttgacgtatgcctttctgatcttgaaaaaaagtcttatttgatgtcttacataaaagctcaatgcttttaagtgcagtggtacaaattatccacgctgttttttgttttaaagtttcatagttcctctgttattcttctggaggaaatacaaataaaaagatttagtaatctgggaagtaaacttctgagaatgatgaacccctggcagtatcattcagttaacttgattctgtgtcataaatgggagtttggaaaatagttcagtattggaaaaagggagtgaacataatattctcttattttatttgcatctttatgtcagtgattaacattctgctatcgcttatctcttgagcattcaggtagctttttttctatttaactcactggacaaatgacatacccttaagtgtctttgttaactgagggcttactagtttggggagttgtttttttttaaacctttacagtcaataaattgtgaggttgacttcccatgctatgttgtgtttgtaatgaagtttcttctcctttatgctcttttgactgcttctatactaatgattcttcctttgttctctaccattagtttggggggaaagagctcagagatgaggaacagacagctgagagcattaagaaccaaatgactgtgaaagaatgggagaaagtgtttgagatgagtcaagataaaaatctataccacaatctttgtaccagcctgttccctactatacatggtaagaattccatccatttgtaccataaacttgaaatcaaaataatgattataaacagccacaggtgatttctgaaagcacataaatcagactgtgaaagtttttagtgggtctgaaagaggtcatttacaaaaggacaggtacatgatttcacttatacgaggtacctgtaatgtgcaaattcatagagacacggtaggatagaggttatcagtggctgggggaatgggagaaatgagttatttaatggataaagttgctatttgggatgatgacaaagttctggaaagggatagtggtgacagttatacaacataatgtacttactgccactgaacttatacactgaaaaatggttaaaatgataagttttattatgtatttttatcacaattttatttttttaaggaaaagttattttgtcatcttatttcctggccttatgacagagctgcacttaagtgtgtttccatatgcgagactagtctcctggcctttttgtggttgtagtctcctggccttgttggtgtgtgtgtatgtgttttagagagacggggttttgctatgttgtctaggctgaagcactccctcctgggctaaagcaaccctacctccagcctccccagtagctgggattacaggtgtaggtcaccacattggctcttgtttctctttttatttaccaaaatggagtgtttatgattggttacttgttctgtctatacctttggcagtttcacattttcctgactcttggttgcaagctgtgttttgaaggctatgactaaaattttaggcctgatgctttatctttgaactcttccatccttgtcttccatactcaattaggattatggtaagaactcaacctttttttatctttttttattctattttattttgagacagagtctcactctgtcgcccaggctggagtgcagtggcgtgatctcagctcactgcaacctctgcctcccgggttcaagcgattctcctgcctcagcctcacgagtagctgggattgcaggattgccccacaacactcagctaatttttgtatttttagtagagatggtgtttcgccatgttggccaggctggtcttgaactcctgacctcaagtgatccatccgccttggcctcccaaagtgctgagattacaggcatgagccactgcatccggccctttttttctatctaaatataagtcagagaagttttgtttgtggaagggatttttagttttctacctgttttgttttgttttgttttgttttgttttgttttgttagggtcttactcttgcccaggctggagtgcagtgacagcatacattgcctactacagcctcaacctcctgggcttaaacgattccccaccacagccccgaaattagctgggactacaggcgcctgccaccatgcccagctaattaaaaaaaatttttttttttagagatggggttttaccgtgttgcctgggctggtctcaaacctctgggctcaagcaatcctcccgccttggccttccaaagtgctcggatcttccagagtgatcagattacaggcataagccaccacacccagcctaattttctgctttaaggaatgccttgtgtaactttgcatagcactttgttgatggagttcagagagtcgacagttccacagaaaaatgtttcttttaatagcacagtgttcttttttaagaaaattgtttttccttcttattggatttatgaactaagcagctgtaaattgcattcagcatcttatttaatccacatgaattcagttaacatatatttattcagtgctggtcactgtaggtgatagaaaagtgttatgaaccatttcctcaaactcttcacagaactataagaactggcattaaaaaggactagcaaatgtggtaggccttggtggacatagttcatttatcaggagagatctttgagggctaaggcattgggtaaggttttgtgtaggaagtaggactcatggacaagtaaaggctcttaggatggtgagcactggcacggtgacatctgtggtgtaggagaaaacattggaacagtggtttaggtgactaagtccacagaacaagaaccaagatcggaagccaggtgttattactccagttttatgctttgctttagctgactctgcctttcggttggtaaacatgcctttactgtttcttctgaaagtgtttaacttcatgttgaaaaattagtttttcatctgtagcttcttttcatttcaggcaatgatgaagtaaaacggggtgtcctgctgatgctctttggtggcgttccaaagacaacaggagaagggacctctcttcgaggggacataaatgtttgcattgttggtgacccaagtacagctaagagccaatttctcaagtaagcgtttgcctgatacagtgttgcaggaaaaagtgtacatagttcccaggctggctgtgctaccaagaatgcagtcagtatggccttactaggagtgtaaattatgactatgttgaatatataattctcatagattaaagttatggcaacattgtacaattttttagaatagggaaaaattgcctgtaataccaatctcacattgaactgtttagtctttgtataatatctttgtaaaatatatttgtataaaattttatacaaattttattatttgtataaaattttatacaaattttattatttgtataaaattttatacaaattttattatttgtataaaaatatgaattatgtattttcattattgtaaatcatattatacatacttgtaatttcaattttctataaacattttttccatgtttcttttcgcatggaaaaatctcatgagtttgtcattttcacaattgtctttttttgttggtatactatagcttacaaaatcattttcttagccctgttaaatttaacaggatagtttattataataattaccgatatagatgcagtgaacatcataatgttatatacattttttgtttgtttcctctgggtaaattgctagatacaggattgttgagactaagaatacaaacatttgtaaggttttaaaataggatgtactggccgggtgccatggctcacgcctgtaatcccagcactttgggaaatcaaggcgggcggatcatgaggtcaggagatggagaccatcctggctaacacggtgaaaccccgtctctactaaaaatacaaaaaattagccaggtgtggtggcgggcgcctgtatacagtcccagctacttgggaggctgaggcaggagaatggcgtgaacccaggaggcggagcttgcagtgagccgagattgcgccactgcactccatcctgggcaacagagcaagactccgtctcaaaaaaaataaaaataaaataggatgtactttccaaagggaatgctgctatgagatattttatgttaactttgtcagtgtgaacacaatttttgactgtttttagaagctataataaatatttgattactttcaaacttttaagaaacttagggcccaaaataaaagcaacaagtttctgagcacctgccatgttctcagtgctgtatatgtgttatgtcttactctagcagcacccagacaggcatgtgtattattccctttttttttcagagagtcacaacctctccaagcctacaagaaatttgcccactttcttgtaggtgaaaggtgacaccgagccatgaatattaaaattcagatacagttgcctgcaaaacatgtgtacttcatactacatcaagctgccttttctttgttttggaaatttgtagcatagtaccattttagaatattgaacatttttagttggtttggagttttatgattaaatatttcttttgaacatatcacagactgagttttagattttaagatagtagtcctgtgttacaaaggattcttttttttttcttgtcattctttctcccccctcaaaaagaaagatgtactacaatgttgcctctggtaacagtgtcatgtggtatgtgacagtcttagtggattccatagcattttctatgtataaaatctgtatataatgatagtcggagtatcccatctggctgcctttttttcttgcctaattgtccttgattagagccatcagtataatgttgaatagaagtggcaagagcagacatccatgtcttattcctgatcttaggggcaaaacattcagcctttcacctttaagtttgatgttatctgtgggttttcatagatgccctttgtcaggttaaagaaaaaaccctttattagacttaggaaaacctcctctattcctggtttgtttggtttttgtaatgaaaaggtgttggattttgtcaaatgctttttctacatctgtttaggtggtcatgtagttcttttattaatttagcatattgattgattttcagatgttaaaccaatcttgcatttctggaataagccccatatctagttttgttttgttttatttttaattgcaagaccttctgatagatgattgttgctgtttattactattaaagacttcttttaaaattgatgttttagctgggcgcggtggctcacgcctgtaatcccagcactttgggaggctgaggtgggtggatcatgaggtcaggagatcgagaccgtcctggctaacacagtgaaaccccatctctactaaaaatacaaaaaaaattagccgggtgtggtggcgagcgcctgtagtcccagctactcgagaggctgaagcaggagaatggcatgaacccagtaggcagagcttggagtgagccaagatcaagccactgcactccagcctgggtgacagagcaagactctgtctaaataaataaattaattaaattaaaaaataaataaaattgatgttttaggctaggtgtggtggctcacgcctgtaatcccagcactttgggaggccaaagtaggtggatcacctgaggtcaggagttcgagaccagcctggccaacatggtgaaaccccatctctactaaaaatacaaaaattagccgggcatagtggcgcacacctgtaatcccagcaactcgggaggctgaggcaggagaatcgcttgaacccatgtggcaaaggttgctgtgagctgagatcacaccactgtactccagcctgggcgacagagcaagactgtgtctcaattaaaaaaaattgatatttttatcaggtattaactctgaaaatacaaaaattagccaggcgtgatggcccacacctgtaatcctagctactcgggaggctgaggcacgagaatcgcctgaacctaggaggtggaggttgcagtgagctgagattgtgacactgcactccagtctggtgacagagcgagaccctctcaaaaaaaaaaaagaaaagccgagggagagaaaccttcccatttagtctgtggcatgtgtcttcatgaattgcttaagctctcaaatgttctttcagtaatttaaactcttctgctggttttcctgggaagggtgctgtataatcacatattaatgagtctttatgtgataaccttgaacaggcacgtggaggagttcagccccagagctgtctacaccagtggtaaagcgtccagtgctgctggcttaacagcagctgttgtgagagatgaagaatctcatgagtttgtcattgaggctggagctttgatgttggctgataatgtaagaacattttacactcttcagtataaagaagtcagaatacccctaccctatcagtaaaggcctataagttaccattaaaaagatgtccttaaaaacagcattctcagctgggcgcggtggctcacacctttgtcccagtactttgggaagccgaggtgggtggatcacctgaggtcaggagttcgagaccagcctggccaacatggcgaaaacccattttctctactaaaaatacaaaaattagccgggcatggtggcgggtgcttgtggtcccagctactcaagaggctgaggtgggaggatcactgagcccaggaggtggaggctgcattgagccaagattgtgccactgcactccagcctgggtgacagagcgagactctgtctcaaaaaaaccaaaacaaaaaaaacccagcattctttagtaaataattcatagttttcttcatctagaatttaaaattgtgatagttgatcagcatgtcctgagcacgtgtgtttgctgttactagtttagatcggtagatgtgtatataagttataggtataaaatcaatcctgagttgacacaaggttttgatgttgagtacaagtacagtaagtgtatatttttagttatgctcttagttttaagtcaattgtgtggttctttctagctttaggatctgttgaattatcttccttagaaaagggagttaagaatcttcacttacctatcttctacttgtttggagaatagaagagtccctgtggtagcagactttgtgagtttacttgtaattttccatctgaaagactgttcttgtttttcgtgatgaagtcttgctctgtcgcccaggctggagtgcagtggtgcaaccttggctcactgcaacctctgcctcccgggttcaagcaattctcctgcctcagcctcccgagtatctgggattacaggtgcacaccaccacacctggctaatttttgtattttcagtagagacggggtttcaccatgttggccaggctggtctcgaactcttgacctcatgatcagcccacctcagccttccaaagtgctgggattacaggtgtgagcccccacactcggccgttgttgttttttaagagacagggtctcactctgtcacctaacctggagtacagtggcaatcatggctcactgtaacctcaaatgcccggccttagtgaagcgttcttcctgccttggcctcccaaagtgctgggattacaagtgtgagccatgcatccagcttgaaagacagcttcttaggcttgatttgtttggttacagggtgtgtgttgtattgatgaatttgataagatggacgtgcgggatcaagttgctattcatgaagctatggaacagcagaccatatccatcactaaagcaggagtgaaggtatgtgttatctacttctgttctgctgcatcgtccatagccttgttgattaatgtagtactagagaagttcacctggataaaattcattacttcagtgtgtaatgctgttcattaaaatggaaaatacagccctgagaattatttattgaaactataaatgttgtttagagtactgtgtaaatgtattgccatgataatagaggaaaatgtccatgaacaaagcttttattttctttgataaagcatgctccaattataacaaaaataaccaaagatcaacagattgattatatatgtatatatttatttatattaacagagtatttaaatgaaaataagtatgacagtataaccaacactagggagaatctaaactttaaaagctacagattcaagtagcttttaagcagtacacaattgtaaattgaaaagacaactctttccctgcaactcccagcaacagtagatacttagaggtatctaatggataaaaaggaattttaggaggaggaaaataaggcatctattgagtttgtgccccttttaggaatattttgtacataagcataatactgacaatttcattcctgctggtttaacttcataattttattttggcaatcttttaccagcacatattagatcaactttggttttttattaatttcccatattcaattgtgtataccacagcttgattctttagactcctgttgagtgacatttggttcattttcagtgttttgtattacaaacaaaattgtagtaagcatccttgaacgcaacatccttttatatttggctataagagaaatttctaacaaattgatgtcttcaatggtgtgcacatcataccaccaaaatcacataggagttcctgtttatgtgaaaaagggtatgtcattattttggtttgtgtttagttaattatgggtgagattgaacatgttgttatatatttattggctgatgtctatttaaatctgttaagattctttcttttgtggtcaggctactctgaacgcccggacgtccattttggcagcagcaaacccaatcagtggacactatgacagatcaaaatcattgaaacagaatataaatttgtcagctcccatcatgtcccgattcgatctcttctttatccttgtggatgaatgtaatgaggtaaccccatgagcttccttttttatttccagttggagtaatcgagtgagacaaggctggaagatacactgctcaacagctggtgcatgtatgtgcaccagcctttgatttccctcagggtggcacaggatcggacaaagggtttagtaagcaactcaaaataaagtcatttgaattgcctcttccacttaattgtgttcaagaattaagttttcaggttttgttactatttatttctcaaaaggaaacaagttacagttaacttccaaccacactttttatttttttaaacagcctctcactggagactgggctggagtgcagtggcacagtcttggcctactgcaacctccacttccaaggttcaagcgattcttgagtctgagcctcccaagtagctgggattacaggcatgtaacaccatgcgtggctaatttttatatttttagtacagacagggtctcaccatgttggtcaggctggtcttgaactcctggcctccagtgatgcacacccacctcagcctcccaaaatgttgggactataggtgtgagccactgtacctggccccaaccacactcttaagatttttatacaattttttgttttgttgattgggcttttattttatttttcagtcaccttgaaaaaaactgggatgccaaagaaatttcttttcttcttcttttttttaatcatgagtcatttatctttgtattttttcctatcaagttgctgaatgtattttacctttttttctcacttttaagattgagtgaaaaaatgtagatttacttggattctgatatgttagtttaattattagagttatgtgtacttaaatatttaataatgcacttcagatgcccacagaactataaaatgacagtttgtaggaactaatattttaggctgtactttttaaatcattcagcattgaggttctacattttattgggtacagtgcacagctctttgttacagtggaactttaaatattatctaaataaaagtagccttccattttgtgagtgtttggagggcttggatttttatttatttattttttaaagacaaagtcttactctgtcacccaggcagtgccacagtcatagctcactgcagcctcaatctcctgggttccagtgatcctcctgcctcagcctcccaagtagctgagactacagctctgtaccaccatgcctggttaattttttcatccttttgtagcaacggcaacaagttcaagacccgtgttggtcttgaactcttggcctcaaaccaccttaccacctcagcctcctgaatagctaagattgtaggcctgcaccatcacacctggtttggtttggtttggtttggtttggttcactttttttcccttcacaagagagacatatttaattaccagataattgagttgtctgattttcatacatttatgtttgttcatgattcattaaagtagctttagtagcagatcaagttataaacctttaaaagatcaatttataaacctttaaaacattcaagatttttttaaaactgttttctttagttttgttttgttttgtgacggagtctcactctgttgcccagactggactgcagtggcacaatcttggctcactgcaacctccgcctcctaggttcaagtgattcttctgcctcagcctcctgagtagctgggattataggcgtgtgccaccacgcctggctaattttgtgtatttttactagagacagggtttcaccatgttggccaggctggtctcaaacacctgacctcagttgatccaccgacctcagcctcccaaagtgttgggattacaggtgtgagccaccgcgcccggcttgttttgtttttgagacagggtcccactctttcctgcagtggcgtgatcatggctcactgcagcctcagcctcctgggctaacacaatcctcccacctcagcctcccgagtagctgggaccacacatgtacaccattgtgtctggctgacttttgagttttttgtagaaacaggattttgccatgttgcccaggctggctgcaaactcctgagctcaaccagtctgcccacctcagcttcccaaagtgttgggattataggcatgtgccaccatacctggccaaaaagccttttctttttctttttctttttctttttctcttttttttttttttttttttttgagatggagtctcgctctgttacccaggctggagtgcagtgctgccgtctcacctcactgcaacctccgcctctcaggttcaagtaattctcctgcctcagcctcctgagtagctgggatcacaggcgtgtgccaccatgcccggctaatttttgtatttttagtagagacggggtttcactttattggccaggctggtctcaaactcctgacctcaggtgatcccgtcttggcctcccaacgtgctgaggttacaggcgtgagccaccgggcccagcctgttttattttagttatttattttgagacagggtctggctgtattgcccaggctggagtgcagtggcatgatctcagttcactgcaacctctgcctcctgggctcaagccagcctcccacctcagcctcctgagcagctggaactacaggtgcaggcccccatgcccagctaacttttgtattttttgtagagaccgagttttgccgtgttgcctggactggtcttgaactcctgagctcaagctatccaccagccttggcctctcaaagtgctaggattacaggcatgagccactgtgttccgcccagacaacttcttaattagaaataatttcaagcttacagaaaagttgcaagaaatggaatagtgcatagaacacccatataccctttacgtgattcacataataacattttaccctgtttgctttattgcttactgtctgtatatatctgcacacttttttcctgaaccatttgagagcaagttgcatattttggggtcttttttttttttccagtattctgggatgaatatcttcaaaatttagtggctaagagcacagtctctgaagctagactattcaaatcctggctccactacttaactgtgaccttggataaattacttaaccttcctaggcctcaatttgcccatgtataaaatggggataatatcatttacctaataaaatttttgtgaggattgcataagttaattcttctaagacctgcctaagagaacagtgtctcatacactgagggccctataaatgttagttctgctatttttgttgttttgtttttgagataaggcttactctgttgcccaggctggagtgcagtggtgcaatcatggcttcactgccccttcaacctcctgggctcaagtgatcctcctgcctcagccacctgagtagctgggattacacatgtgcaccaccatgcccagctagtttttttgtagagacagggagggtctcagtttgtcgccctgactggtctcaaactcttgacctcaagctcttctctcacatcagtctcccaaagtgttgggattacaagtgtgagccactgcactttaccctactattgtttttaaagccaatcaattccttcaggtatagttttagagtggggcaatggtatacatttaaacgtttgattttaaatccacctgttcccaaactttcatcagaaacttggtacccattaatacttctttaagtggtatattagagcttgtttttggcgataaatcatttcttattgcctgggatagtctggagaagatattgctgtgactatcaaagtgatttttttgttttgaattaggttacagattatgccattgccaggcgcatagtagatttgcattcaagaattgaggaatcaattgatcgtgtctattccctcgatgatatcagaagatatcttctctttgcaagacagtttaaacccaaggtaacctacccttttgtactgggataaggtataatgggtatattaaagtggaatttaagtaagtgtgttatatggaaattaactgaacctgtcatctaccttagttcctaaattttacaactttttttttttttctggaacagcaatttgttttttcagagagggctgagaaagggaactgtaaaaaaaattctgaataattccattatttgtttggtggtaataaaaagatttgtatgggagaagagttttggataactggataatctagaacattcttttatttcaaacattactaagaacgttaaaattgtttatgcgcctaaatcaatagttgaatctttctttgaaggaaacattggattcatctaggccattatgataaatataaattactgttttacagtgattgatgcattgtattggactaactctgttctggacccaggattcttacctggacataaacccccaaatgcttggcattttcccaaaatagggtatgaaaaggaaaaaaaatactcattctggttgagattttcacactgttggctaacttgacttctggaaggtgttactaggtattgatcatttatcatcttcacttgattattcatgagattgcagttggctctcactgtcccaaagaaatttaatcatttaaaactaaggattatgggtgattcttgtgtaaaaaagagcatctgttctccattactgcatactgatatactgatccctctgtaaccttggcatgcttccttaatatggtgaattccttgctctgaaaagctgaggatcctttagatataaagtttattgaaacagcttttttttccctgcaaagagtgtgagttaattaattgagcctcaaatactgagcattaatttatttaatgagcactgacatcctgaggtgtaaaagacattacatcttgttccattgcttcagcttgttaagcagcttttagaaatggtcatttgcttaaatactaagccttttttcaggttcataaaattagtaacatggaattcacaagcctccttaatattagtttcttttgaaagacattacaatagtaatttattgtcactggcttctcaaagtttcaaccctctcaggttccctaaatgtttccacctggaaggctcttaaacttaggtttaccgtagctctcatcaaatagaaatgtttctctaacttgagtgatgatctgaaacagatttccaaagagtcagaggacttcattgtggagcaatataaacatctccgccagagagatggttctggagtgaccaagtcttcatggaggattacagtgcgacagcttgagagcatgattcgtctctctgaagctatggctcggatgcactgctgtgatgaggtatcagagtcactttgatatgatgagagcagagataaacagatttgttgcatgtttttaatctttggtatgggacatactagaattcactgcaaatacatttttatgtaactgttgaatgctcatacgaccatggaattcttccctttaaagagcttggtaagcatttgagtgtagttgttagacggagacgatcacgtcatagtttatagagtgcataaagacgtaagttaccatttaatacctttcattcaggaaaaatgtacttagaccctacaatgtactagtaggcctctgcgctggcaatacagataagataatgtagcccctggcctcaaaggaactctcctccttaggttgcatttgtataatgtttgatttttagattgttctttgagccctgcattccacgaggataggtcagtgggtattaacgaggtaaaaggggagtagtacgaaagggcattcaagcgtcccatcttcgcttcaaccaaagcagccctgcgttttcctagttttattaataggtttgatgtaaggtcgtctttgaaaagggggtttggcttttttttacagtgtgactgaggtataatttataaaaagggaaatgtatggcatggtgagttttttcacatacatccttgtgaatacccagctcaagatccaaaacatttccataatttcagaaagttccaaacccctgcctcttttcagtcttagccctcttcccctgaagtaaccactgttccgacttcaatcactacttttatcccacaggttaattttttggcttttttccactaaattttcaaattctttgatatggtactttactattgacgaagtactttcacactaggttatttaatattctttgattcacccaatatttagggaacacctgtaggggacaaaaaatgaatgagagcccctgccttccattgctgctaatctggtgggaacgagacatgtatttaattaagcatgtaaaaaatagagtgggtgatgaaataatctatatactaaatccccatgacacacagtttacctatgtaacaaacctgcatgtgtacccccgaacctaaaatataagttggaaattaaaaaaaaacgagagggagaatagagcatcacaaccagagtgctgagatgaattactttattaccaaagaaggaggaggactcagggaggtgccgacgtttaaacccagtcactgaagggtgtgcagaatttggataggcaagataccctgggacaaggtcattctaaaaccatgctaacatttgtactttttttttcattgtgatagttcctgaaatgagttgcataaaactggtacatgtcttagggcagtctctaattgatttttattttgttctatttttaaaaattagtcttcaaatagcagattcacatgatattaaaatatatgcacataaattatatacacaaatatattttctgaatgaaatttagtatctgcatatatttaagagctatttctgtctcatatgttcataatcttcatccattaaaaaaacttttgttaggcctttctcactctaagattataaaaaattctcccattatttacctagctagttttctagttgttccaaaaccatttattgaacaatccatctttttgacactggtttggcatgccttaattatatattcttgtgtgtgttaggatctccttttggactttccattctgttcattgagtcttatcagctcctcttacattggtaccatgatgttttaatctatggggctttgtagtttaaatgtagggctagttccagcgcattgttctctatcagctgttaggaacttagaaatcagcttgctctgttttaaagaaaaacctggtatttttttatcagtataacattctatttatattaacttgaagaattgaaaacatctatgatttttcctattcagtaacgtatcacttagaataggttaggttgtactactataaaatctcagctgcataaaacaatttttttttgcttgtgctacacatccattaggtcatcaagggactcaccttgtcaagttactcagagattcaggctgatataaaggtttgatcttgacatacgctttcatgatgacagaaagcagggaagagaaggtggtgagccatgtgctttctcccccttctatccagaaatgacacatactcacatttcattcgccagagaaattaacatggcccctcctaagttcaaatggatagagaaatgccttcctaccaggtgcccagaattagaagagcaaacatttgtgaacagttctgagtaccacaaataccgttatctttccacttaagtcttctgtttcactcagtagtgctttaaacttttcttcatatgtttttcagtgtttcttgttgaatttcttgatattttatcatgtttgttcgtactgggagtagcctttttttccatttcattttctggctggtttcattgctggttgtttttttgttttgttttgtttttgagatggagtctcactctgtcgcccaggctggagtgcagtgtcacaatctcggctcactgcaacctctgcctcccaggttcaagcgattcttctttctcagcctcctgagtagctgggattacaggcatgtgccaccatgcccagctaattttttatatttttagtagagatggggtttctccatgttggtcaggctggtctcaaactcccaatctcaggtgatccgcctgcctctgccttccaaagtgctgggattatagacatgagccaccgtgcctggcctagttcttatgggatgtatatgtctttggattcatatgatatgtatatatgtttatatttctacaagtacatacctaggagtggaattgttgggtcataggttaatgcatgtttttctgccaaacagttgtgtcaatttctgttttcaccgctgtgaatgagagttgttctaccttcttgacaacacttgatattgtcagtcattttagccattctggtgaatttatagtgctatttctgtgtgtgtaagagagagaatgagagagggtgtttgtgagaaaaccaaagcaacactgtgagagtgtgtgtgtttgtgagaaaaccaaaatacatactactgtgatttcattgggagaaaatctgtttggtatatcaaaaaaagtagcttaattacttcatcattattggtttaggtccaacctaaacatgtgaaggaagctttccggttactgaataaatcaatcatccgtgtggaaacacctgatgtcaatctagatcaagaggaagagatccagatggaggtagatgagggtgctggtggcatcaatggtgagatacttgttcatgtgactgttttggagttagggaccaaaacattttctgagatgtcatgtggtagaagtacacctgctgttggctaatagtctatggtagcaaaacggaaaaagcagatactgaattctattcactgtttacaagttaaaatgaaattaaatagttgatataaaatatatatacttggctgggcacggtggctctcgcctataattccagcactttgggaggctgagataggtggatcacaaggtcaggagtttgagaccaccctggccaatatggtgaaaccccttctctactaaaaatgcaaaaattagccaggcgtggtggcggctgcctgtagccccagctacctgggaggctgaggcaggagaatcacttgaacccgggaggcggaggttgcagtgagctgagattgtgccactgcactccagcctgggtgacagagcgagactctgtctcaaaaaatacatagatatttgaaagactaaaagaaaaggcagcaaaatggtgataatagacataaatcccctgggttttacccttatttgtattgttgttttgcttctgaattgaaaacattttttcaagcacattagaacagaaaaatactagaaattttatttattttgagatggggtctcattctgtcacccaggcttgaatgccttggtacactcatggcactgcagccttaacttcctgggctcaagcagtccttctccctatcctctctaatagctgggacatatgcccacgccaccactcctggctaattttttgagaattttttctagagacaggatctcgccatattgcccagactggtagaattttttattttgtatataatactgcaagtggactttcagattgtgaaatctttatatctctgatccctcacgttcctcccaagttagtttttgtctttactagtagagtttatacatttgcttctaatttatttgaaaattcttatatgctatgtataactgtatgcatgtttttttttgtttgttttttgtttttttttatttttgagatggagttttgcttttgttgcccaggctggagtacaatggtgcaatctcatctcactgcaacctttgcctcccgggttcaagcaattctcctgcctcaggcttccgagtagctgggattacaggcacccaccaccacacccagctaatttttgtatttttagtatagacaggatttcaccatgttggccaggctggtctcaaactcctgacctcaggtgatgtgcttcccttggccttgcaaagtgctgggattacaggtgtgagccactgcacctagccggtttattttgtttttcatttttattttttggcagaggagatcatgtgggaatgtatgcttgttttaaaattagtgttaaggctggatgtggtggcccacacctgtaatcccagcacttgggagaccaagacaggaggatcagttgagtccggtagttcgagaccagcctgggcagcatagcaagaccctgtctctaaaacaaataataataataatttttaaaagtgaaaaaaatcagtattaaatgtaagtagtgtatttgtaaatgcttgacaaggggatgttaagggcacaaaaataagattcaggtggtcaatttttcacttaggtcatgctgacagccctgctcctgtgaacgggatcaatggctacaatgaagacataaatcaagagtctgctcccaaagcctccttaaggctgggcttctctgagtactgccgaatctctaaccttattgtgcttcacctcagaaaggtggaagaaggtgaggcttacctggtactgcttacatgctcggtcacttctgtaagctctgttcacataggccacttgtgattgccaaacttcgtgttgttctgtcggaagagaggataagttgttagataaactcactttagcaaagtaaatttgtggagtatcagcatacctgccagcctgaacatttcttcacaagcttattgtcaggcaaagctttgtaggtccttctttttaacattctgggcctattttaataattttgggacctgataacatatgaagcagcacatacaaatgtttttacaaatgcaaaattactattcccttacaatggttctgtttaaaacagctggacccctagggtatattttaacagtaattaattgagcctagaaatctatactatcaaaaggccattgcagactagaaatggagtaaaatcctcatgtagttattggtaaagtgtggcgtctggacactagtacgcttcctacccttaactgctttaccatgctattcaaagttttatcaccctatagttaactacaaagcagaaggaaaaatgatgaattcaagatgttgaacctaaacttctacttgatagttaagcatcagataattcttgattaaaagccccaaggatggcttgtgctggctttctggaatattttgtcatcacagtatttgctctgctatgaaagaagagaacaagagattgtagtttctgcccttgttcccctgggaactttagaccagtaggagagaaggcaacaaagtggccactaggacgcctcagcttttgtcctcattcgcgtctcacacaaaatgatttgggaactcaaggtgttcttgattcatgttatatgtcattattctctttctccctcatacaagtaagttttaaacacagcagaagttgagttttatgatagttatgttatccaggtccaaacatttcctatgtgttgagggttcttaccaggactttctaaaagtctggtagaccttggacttgttaaaagcagcaggcagttcacttagtaagatgaaccttgctaaaataaacaggtaattttttattttgagtgaatactcatgaattttacttcttagtaaactccagttccataaagccttcccctttctacagaggaaaagttgttatatttcagaatttttgcttgctgttgcttcattcctaatttatgcttttagtttctgttggcaagcattctcagaggtggtgaagcataagaagatgaagaaaagaccttcatactttgaaatcttaatagctttaagaaacatatttcttataatctattttattaggtttctctccttatggataaaataaggcatgctttaatacaagtgatatgacttgttatttcaggcttatgctagaacattgcggaccttacgtcaccagatgtactttcggacggcttgacatttatctaatctgtacattatctcgttgtatatgtggcagagatttacccaaggactgacagtacgagttgctaggataatttgaatgtgtttttttgttgcagaagaggacgagtcagcattaaagaggagcgagcttgttaactggtacttgaaggaaatcgaatcagagatagactctgaagaagaacttataaataaaaaaagaatcatagagaaagttattcatcgactcacacactatgtaggtgcagaagtgcgcgtgctctggtatcagggagggagggagttcatgccctgtatctgcaggttcactagtgaaattttttttgacctttgtttgttttgaatcattggagtgtagtcagaagtatgagttgtaaaataagagagaatgaacagcaggtaaatgacttatttcctctgctgaaacaagcagaatttaggttaaatctcagaaggtgggattgaagtcttactagttaggtgttttaagcttctgtttcccatcctcatatttgcccttggtcgtactgctgtcacctactttctatgtttcattttcctcacattcttagttcccaccttacccaacccaatagtcaatcttccatcttacttgcttggcgaaaccccaaacttggttaaatataacttttttttttttttgtatccttatctaagcagctgaaagtatctggagaaaagcatataattatgagcccagtcttatttaaatcgatgaccagaaatctcaagtggacagttcttactgtctcatcaacctcatgacagcactgcccagtgcaattccttttcccgggtcagttctttgcctcactctctcacaggcccatcacataccttctctccactcctgtcagctggccattctcagtactcagcctgtccacagctttgtcacagttgatcactcctacaaatagtgtcttcctcacttggttctgagtcactgtatcctcctggggcttctttctcactggttattccctcttagtctctttccctgaatggttttgttttttttttttttttttgagacagagtttcgctcttgttgcccatgctggagtgcagtggcatagctcactgcagcttccacctcctgggttcaagcgattctcctgtctcagcctcccaagtaggattacaggcgccggccaccacgcccggctaattttttaattttttttttttagtagagatggggttttgccatgttggccaggctgatctagaactcctaacctcaggcgatacgctcactttggcctcccaaactgctgggattacaggcgtgagccaccgtgcctggcctgaatctttctcttcttactttactctcagatagtttacattcattacctaagtgatctcatttggttttatgaatttatccatctactgatgacttccacatttatgtcaccagctctcaccactcctgtaaactccagatgtatagagctggttgcctactgatgagcgtttaacaggcatctcgtgcttaatgtgttcaaaaacagagttgttcttccctgtttgcagttgagttgttcttactcaattgctataggccaaatgccttggaattgtctttgactccttgattccactctcccctcacagctcctcttcagcagcaaatcctctgacccccagcttcagtgtgtgtatattttcttttctctttttaccgccttcaccagcccacccaagccaccaggcatggactgttgcagaagcctcataaaattgtcctttttttgtattggcttcttgctcagcagccagataagtctttttaaaatataaatcagattattttactaccctcccttccagtgcttctctcacattagaaggaaattcagcctccttgtcatggcctgcagaactattatacagtgtaacccctgtcccctcattcacctaatttcacagcagtcttccccatacccatttcaccccagtgacactggccttgatccctaggcacaccaaatatgagggcctttgcactcaccctttgtccatttccctagatatcctcctcctctccaatgtctgctcaaatgttacctcttcaaagaaacctttcttgctagcctgccaaaatagtagccttctgctcttgctgtcaccctgccttgtatttcttcgtaatgtttaacatggcccagcagtatattctttatttaagtggttagtttgtctctcttatggaatataagctctgtgagggtagagactttgccccggagctacagtggtacctggcacatagcaggatcaaatatatgttgaatggttaaattttcctattatgtggcagagatttaactgtcgtgccaattcacagggctcactatataaatattacagaggtcatgtattggggttgtgtcttctcaaaaaccgttttcctgtgaaggtagatcagtctgtgattattgaggggtagggaggtgtaagaacagctactcagatcagggtccagagttgcttttctagtggtgggacatgtctgtgtgctccttgggatcagtgtaaagtaaaacgacccaggcaaggaatctgcttcaggactttggaacacactgtgaagctaactgatctaaacttgaattacctatttatttatttatttatttatttatcttttgagagagtcttgctctgttgcccagactggagtgcagtagcatgatctcagctcgccgcaacttccgccttctgggtttaaatgattctcttatctcagcctccagagtagctgggattacaggtgcccgccaccactcccagctaatttttgtatttttagtagagatggtgtttcaccatgttggccaggctggtctcaaactcctgacctcaggtgatccacccacctcagcctcccaaagtgctgggattacaggcatgagctactgcgctcagcctggattaccttttaaaatttggcttaccacctgaactaatttgctacagaaaactagagagcttatactgtgctgatgagatatgatgcttcctatgaaggtatgttaacacatagagtgagtgcttgaaagtgtccaatctaacttcaggggtagatttgaaagggcaattttttaaaaagtgtccagtcccccttagtggcttcagtgtttatactgtggagccttgccagacttcttaggatcaaatcacagtttcctgagttcctttctatgggcttggctaggagctcttctcatttgtggacagttttgactaacctgtaattatatcgtgggcttaaaatctgtcatcaagattttaagccagatggcatgttctacctttttttttattagctcagagtgaaaaatttttcagatgaattttcatagattcttctcctaactctatgaaatggtggtatatgaaaaagttcagtggtcataattaaaaattgctgaatgatattaagtatgaaacagacttccaattaattagaagattttgcagagttgtttaaccttaaaattcaagcattacttccttttttgaagttgtatttacaagcatttgatgtaatatatttaagtatttcttaattttccacaaggggtttatggtatgaaaaggtcagcatcctactaggaacagggtttagcagagcactgatagtgatttttaaagtgtggtccttttcctaggagtttctagttgggaaatgaaagaaaatgttgatagcaaacactcggaagaagggtcaagtcttgtatatctggacattggtataatactgcttgaaacctgaggacaaatatttgtgtttcacaggatcatgttctaattgagctcacccaggctggattgaaaggctccacagagggaagtgagagctatgaagaagatccctacttggtagttaaccctaactacttgctcgaagattgagatagtgaaagtaactgaccagagctgaggaactgtggcacagcacctcgtggcctggagcctggctggagctctgctagggacagaagtgtttctggaagtgatgcttccaggatttgttttcagaaacaagaattgagttgatggtcctatgtgtcacattcatcacaggtttcataccaacacaggcttcagcacttcctttggtgtgtttcctgtcccagtgaagttggaaccaaataatgtgtagtctctataaccaatacctttgttttcatgtgtaagaaaaggcccattacttttaaggtatgtgctgtcctattgagcaaataactttttttcaattgccagctactgcttttattcatcaaaataaaataacttgttctgaagttgtctattggatttctttctactgtaccctgattattacttccatctacttctgaatgtgagactttccctttttgcttaacctggagtgaagaggtagaactgtggtattatggatgaggtttctatgagaaggagtcattagagaactcatatgaaagctagaggccttagagatgactttccaaggttaattccagttgtttttttttttttttaagtttataaaagtttattatacttttttaaaattactctttagtaatttattttacttctgtgtcctaagggtaatttctcaggattgttttcaaattgcttttttaggggaaataggtcatttgctatattacaagcaatccccaaattttatggtcttccaggaaaagttattaccgtttatgatactaacagttcctgagacttagctatgatcagtatgttcatgaggtggagcagttcctgtgttgcagcttttaacaacagatggcattcattaaatcacaaagtatgttaaaggtcacaaaagcaaaataactgtctgaggctaaggcccacgtgggacagtctaatacccatgagtactcaacttgccttgatgtctgagctttccagtgcaatgtgaatttgagcagccagaaatctattagtagaaagcaagacagattaatataggttaaaacaatgatttaaatatgtttctcccaataattatctctttccctggaatcaacttgtatgaaaccttgtcaaaatgtactccacaagtatgtacaattaagtattttaaaaataaatggcaaacattaaaaac

SEQ ID NO: 36018 - DNA, 95164 bp, Homo sapiens
ggctgaggcggcgccagttggccgggcacggggctgctgtaaggccgaggttgcggcggaagcggagaccatgttccgagcggcggctccggggcagctccggcgggcggtgagtccggactgggaaggcgaacccagggacggccccccgtcaacccgccgtccctatggggtcttgcaaagatcactggccccctcagattcgaccagccctcgcgcccgcaggccggtccccgcctgggacttgggtccaaagttctggggcctaccctggactccctgcggaacgccagttcggggcagaagtcagaggtttggggtcagggtgaccccgaatgatgtgaatttgcgcgtctgctgccccttcttctggcccactctctgccctgccgtttcccacctttgtcggtcactctgggcactttcgggccgccaggtcctccacacttgctccacacccgagggagcaaaatgtcaccggggaatgccctgttggggaaagtttcaaacctagattcctcccggaggccggcatttctggaagaattaaacactttgggcgcatcgtggctactccgacccactcactgtcaagggcgggggtggggtggggtgggaggctgcgtggccagttatggaagctggttctgctttctggtttatggagcagggctgaatttaggtgattgtatttgtaaaacctgcgatccgatttgacagctttagccagttttgaaaggcagacgtctttttatatgcttcaggctgacctgcttttaaccagcagattgtagattaggttaactggtgacagtggtacattttcagtgtttcattagtgacaaaccacatttctctcttctgttgtgagaaggactgataggaaacatattttccttctcatgctgtgggaaaggagtatttggagactgaccagtcacaagtcaagtaacaataatttatattgtggattgtgtagttttcctagtttacatttaggtgaaatgagaaacaagattggtaaacttgggtcagaaacttacctgatggtttgtaccttttctcctttttttttttttttttttttttctgggcatggatattttcccatccactcctgggatttttctctctgaggcatagctggagctctttctagatgtctgtagacattagacttttgtttgtttgtttgtttgtttgtttaagagacaaggtctggctctgtttcccatgctggagtggagtgcagtggcacgatatgggctcactgcaaccgtcgcctcccaggttcaagcgattctcccacctcagcttcccgagaagctgggatcacaggtgcgcatcatcacgcctggctaattttttttttttttttttttttttttttgtagagacggggtttccccatgttacccaggctggtctcgaactcttgtcctcaagtgatccacctgcctcggcctcccaaagtcctggaattacaggcctgagctaccgcacctggccttagacatcttttttcttgtgcgtattccttgtttaataaaaagttctgaccctcccctcccctaaagagttcaaacccatgtctttcaggttagtgtcctgtcttcccctcaggacatgttttctcccggttggggatctagacataaacaagtgaaaatcatgaatttggggaaattccaggaacctgagccagaagaatgctgctctatgcagcagttggaaaacagttttgtggacagattacaagtctggcctaagtgaaattataattgtggtgggggatggaatttaggactcagtaattttgtagagctaacagaaaaaaatggaatgattaagtaatttttactatccacatcgttggctaatgtgtatagacattacttccagatattcattgtggtttgccaaagactttgaccttgacttatttttaaaatttgaagtcaagctaagtagaatagctgttttttttgtttgtttgtttgtttgttttgagacggagtctcgctctgtcgcccaggctggagtgcagtggcgcgatctcagctcactgcaagctccgcctcccgggttcacgccattctcctgcctcagcctcctgagtagctgggactacaggtacccgccaccacgccccgctaatttttttgtatttttagtagagacgggggtttcactgtgttagccggtatggtctcgatctcctgacctcatgatccgcccgccttggcctcccaaagtgctgggattacaggcgtgagccaccgcgcccagcctagaatagctgttttaaagtcattaagaatgttggagagatttggatttctagcataaaagaaatggtggcaacacttctaaagtggacccatatattaatagggacatatacctgtatttaactttttaaattttgaaatagttgcacttatagaaaagttgcaagaatagtacaaagaaatctcaaaacccttcccctggttttcccagcatgttagcagtttgacacatttgctttatctttccacatatatacataatactatctttctgaaccatttgaaagtatgttgcaaatgtgccctttactcctaaataattgagtgatattttaaaagaacaaagaggttcactttctaactacactgtaattggcaatatctggaagtttcaccataaaatactgttttctaatctatggatgttcaattttgccagttgtcccattagtacagtttatagcaattttccttattctggtctaagatactctagatgtcctgcaagtggttttcatgtctctttactctgttagaaaggttcctcagccttcctttgggtttgatgacattggtgtatttgaagagtacaggccttctattttccagactgtcactcaatttgggtttgtctggtgtttcctcatgattagattcaggtcatgtattcttggtgggaatatcacaaaagtggtattgtgttccccgtgcatcatattagcaggtacttaatgttggtttatcccattagtggtaatgctgactttagttacttagccaaagtgttgtttgccaggtttctccactgtcaagttaatactcctccttttgtaatttttaactaatttgtgaggcgattcattgagactatgtgactgtcctatttctcatcagacttttacccagtcttagcatctgttgatgatttttgcctgagaaatgattactatgatgcaaaatggtgattttctatttccatgataccttcgtacattttttagttattctactataaggaagaacattatcttcttgcatatttatggatttatggatacatggatccttatttaggataatacatttctaccttatgctgaagttgtctcatgtttgtaaagtggggcccattcaatctgactcctgtttgtttacatatatatgtttgtgatatcacaaagtcaaaatagcttatctcaagtccccactcttgaaattaaaaaaaaaatgttctgtagctaaccattaatgcatttaggaagaggatacatttccaaaaccatatttaaaaaaataaagttaggaattacagttaaaagattaccataaactgttaacgatgtgcatatagttaacacttaacacttaaaaatggttaagatggggccaaccatggtggctgacacctgtaatcccagcactttgggaggctgaggcagatggatcacctgagctcaggagttcgagaccagcctgcgcaacatggcgaaaccccatctctaccaaaaaaaaaattagccaggcgccatggttcacacctgtagtcccagctacttgggaggctgaggcacgagacttgcttgaacctgggcatttgaggctgcattgagcccaggtagcaccactgccctccggcctgggcaacagagtgagacgctgtttcaaaaaaaaaaaaaaaggttaagatggtaaattttatgtattcttttaaaccactttgttaaactattaggatataagttcaatgacttgcatttggtatctaagttccatttttagttctgactgatttgtgccattgagtaaagtctttcatccttatgtgtgtggcaatggtctttaaagtcatctgttaacaaagatagtttttatatctataataaagagctagagaacacaccaagaggcaaataggtaggcatttgcagttagttaatattcttgcagggatattaatcctaattattgttatttattaatttgctcttgaaattgatttattgaagaataagaagatgcagaaaaatatttatgtggtgagtgaaacaacaatttcaaggtcatttgagtactctttttactgtgtttattgtcaggtgggaaggaatatctatcaggactgagaagctatgaaactggtgtgaaggaacatgacacttttctgtctagtattgatgaataagattgaactctgtaatttgcatgcaaattttaatttctattgaaagaagaaagagagccaattttggtgtgattctaaaagaaaatttattgcataaggtgaattcagtaaaattatgatgcctgccaatgtgtctactaagagtcttgtcctttcttaaagtgaagtaaattgactgtgtttttagtattacagtcaatgtcatataacatttctggtcatgattaaaagctgctatattttattactaaaaggattaaaggaagtatttaaagtacagaaatatacattttaaaaattacaaaatgtatgttaaaatagggataggtgactttatatattatccttttgggtatgactcagaaagattttatagcttattcttgctgtttttctttttttaattaagaagcaaaaaaaccggctgggtgcagtggctcatgtctgtaatcccagcactttgggaggctgaggtgggtggatcacgaggtcaggagtttgagattagcctgaccaacatggtgaaacccgtctctactaaaaatacaaaaattagctgggtgtggtggtgcgtgcctgtaatcccagctacttaggaggctgaggcaggagaattgcttgaacccaggaggcggaggttggagtgagctgagatcgcgccactgcactgcagtctgggcgactgagcgagactctgtctcaaaaaaaaaaaaaaaaagaagcaaaaaaaccctcccctgccctctataccctcattacacctagtttccaaagatggttggggtggaggtataggttacaatcattcttactactttaggttatgagtgggtttgtaagggtagagagttagattccagctttttttcttcttctaccatctgtggtactttactatgtgaatatacagttcaagtcacagcaagaactctaaaaaactgacaagcaaaaacaatgtcaaaaatgaggctgatgctgggcacagtgtcatgtgcctgtagtcacagctactcatgtggctgaggcaggaggatcacttgagtccaggagaccagcctgagcaacatagcaagcaagacccagtctcaaacaaatacccacccccacaagaaaaaaaaaaaaacaactattgaggttgaaaaagagaaggaccaaaatgtgttcattggacttagccataatgaagtttttggtgactttggaaagattggattcagtgttgtgaaggtgaaagccagtttgcatgagtaactgaaaaaatggaaggtgaggtaataagagttggtgtctgtggaaattattttcaagaaatttagctttgaaagggtgcagagagggtgataacctctttaaatcctgcccacaagaagtatactatcttataaaggccagtcaactttatatgggtatgtggctggcatgagaaagaaaacttcatattttgctatttgcaaccaagtctaaacagagtatagagaacttctctaaaagcatgatggtgtgtctgttttagtgatgtaacagtttatgtactgtttagttacccttatacatgtttagttgattacattatcaatgaggaaacagttgctttttagtttttgataattttaagaaaagttttcatttagttactattcattgagtgccaactgtgtgccagagaggtagataccaagttcacagtggagaacaagacagacctagtccctgcccttgtgatgcaaacagattaaggaagaaacacattattttaagtgtggtcattgttacagaacatagagggtgtttgggagaggtttaatcttgttagaggactggaaaacactgaaaggatatctgtgaaattatgtttgcacactgaggtgccttaaactattgttactgagtgataaagtaatagagcggaggattttctttctttctttctttcttttttttttttgagacagagtctcactgttgcccaggctggagtgcagtggcgccatctcgactcactgcagcctctgctgcctgggttcacgccattcatctgcctcagcctcccaagtagctgggactacaggtgcccgccaccacgcccggctaatttttgtatttttagtagagacggggtttcaccatgttagccaggatggtctcgctctcctgaccttgtgatctgcccgcctcggcctcccaaagtgctgggattacaggtgtgagccaccgctcctggccgaggattttctttagataaaaacatcacttcattttttagttttgtctaaaatcatttatcattgctgtattttttcccccaattttttttttttttttttgaaatagagtcttactctcacccaggctggagtgcagtggtgtgatcttgactcgctgcagcctcaaccttctaggcttaaatgatccttccatctcagccttccaagtagctggggctacgggaatgcgccaccacatctgactaattttttaatttttatctttcatagaaacagggtcttactgtattgtccaggctggtcttaaactcctgggccaattttaggtttgcagggtatctgtgcagatttattatgagtaaaccgtgtgtcctgggggtttgatgtacagattattttgccgcccaggtaatgaacatagcatccaataggtaattttttgattctcaccctgctcccaccctccaccctcaaataggcccaggtatctattgttcccttctttgtatccataggtatttgatgtttggctgccacttacaagagagaacattccatgtttggtttttctgttcctgcattaattcacttaggataatggcctccagcactgtccatgttgctctaaaggacatgatctcattctttttaatggctgtgtagtattccatggtgtatatataccacattttctttacccagtccatcccttgcatgggcatctaggttgattccatgtctttgctactgtgaatagtgctgccatgaacatgcacatgcatgtatctttatggtagaatggttcatattcctttgggtatattcccaattatggtattgctgggtcgaatgttctaagttctttgagaaatcgccacattgctttccgcagtggctgaactaatttacatcctcaccagcagtatataagcgttccttttctctgcaaccttgccagcatctgttgttttttgagttttaaataatagccattctgactggtgtgagatgtctcattgtggtttttatttgcatttctctaatgattagttaatgttgagcatttttttatatgcttgttggccacatatgagaagtgtctgttgatgtccattgcccattttttaatagggttgttttttgcttgttgatttaagttccttatagattctggttattagacgtttgtcagatgcatagtttgcagatttttttttaccattctgtaggttgtctgtttactttgttgatagtttattttgctgtgcagaagctctttagtttaattaggtctcacttgtaagtttttatttttgttgcaatttcttttggagtgttcgtcatgaaatctttgccagggtctatgttcaaaatgccatttcctatgttttcttcttgggtttttatagttcgaggtcttacatttaaatcattttttgtttgtttgttttttgagatggagacttgctttgtcacccaggctggagtgcaagggtgcaatcttggctcactgcaacctccgcctcctgggttcaagcaattctcctgccgcagccttcggaagagctgggattacagactcctgccaccacgcccagctaatttttgtatttttagtagagacaacagggtttcaccatgttggccaggctggtctcgaactcctgaccttaggtgatccactcgcctcggcctctcaaagtgctgggattgcaggtgtgagccactgcacctggcagaagtttttttgttttgtgttgttttgtttttaagtagagtttggcctgtgtggtagtacacatctgtagtcctagctactcaggaggctgaggcaggaggatcccttgggcccaggaattggacgccagcctgggcaacatagaaagacactgtctctaaaaataaaattttttgaaaatagactttatgttttagagcagttttaggttcacagcaaaatccaatggaaagtacagagagtcttcctggtccacacacccacaacctcctccactgtcaacatacagcaccagagttgtccatttgttacaattaatgaatttacattgacatcagcatttcccagagtccatagtttacattaggattcactctttgtgttgtaccttctatgggtttggacaaatggataatgacaggtatctaccattattatatcatacagaatagtttcactgcccccgcccccactccccctggaaaaaacaaaacaacaacaacaaaaaacctctatgctttgttctcctaatccctggcagtcactgatctttttactgtttctatagttttgcgtttaacagagtgtcatatagttgggattagacagcatgtagccttttcagactgttttttttttcactaagtaatatgcattcaaggttcctccatgtcattctcatttcttgttactgctgaataagattccattgtatgaatatttattcacttactgaaggacattttggttgcttccaagttttggcagttatgaataaacctgctgtagacgtctggtttttgtgtggacctaagttttcaactcatttgggtacgtacaaaggagtgcagttgctagattgtatggtaagattatgtttagttttataagcaactgccaaactgtcttccaaagtggctgcaccagtttgcatttttaccagcaatgaatgagagtttctgttgttccacatccttactagcatttggtattgtcagtgttttggttttttaccattctaataagtgtgtagtggtatctcgttttaatttgcaatttcctagtgagcatcttgatgttgagcatcttttcatatgcttcttggccatcttctttggtgaggtacctgttcagatcctttccccctatttaaatcagattgttcattttttatgttgacttttaagggttctttattttttttagataagtcttttatcagatatgtcttttgcacatattttgtcccagtctatggcttgtgttctcattcctttgatgaagaggtgtttgttttgttttgttttgttttgttttgagatggagtctctctcgcctaggctggagtgcagtggtgtgatctcggctcactgaaacatccacctccagggttcaagtgattcttgtgccttagcctcctgagtagctgggactatggcgtgtgccaccatgcccagctaattttcgtatttttaggagaaatggggtttcactctactgaccaggctggtctcgaactcctgacttcaggtgatccatcggcctcggcctcccaaattgctgggattacaggcgtgagccactgcgactggccaacgaagagttctttaaaaaaaatgttcacttcccttattggtgtcagctctgtgctggatactggagtctagggttatagtggtaagaaatatcagacattgctcctgtactcagtatcaaagggggacgagaagacaatcaggtgaatatgatcaggtgtgataagtgctgtaatgaaggcaattacaaggtaccatgttggtgctagcaaagctaactagtccgagacggtccaaagaaggcttttatgtgtagctaacatttattgaggattaatatgttccaggcatcattctaagagctttacatttattaatttaaccctcacaacaactctatgagatattaatattattatcatcatctccattttacagtcagagaactgaggtactgagacgttatggtggaggtgggattcaaacccaggcaacgtggctggctccaaagcctgtactctaccactgcaactgtactaatgctttttggaggaattgacctttcagcagaaaacctaaggatgattaattggaatttagtagggtaacagggaaagaggtccactaggcagagggagcaatgtgtgggaaggctggaagtctgagagagcagggcaagttcaagtatctgaaaataaggcataaatggagtgagggatatatggttagggaggtagatcacgccataaaataaacacatgataaaccaacctaaggagtctagtttaccatatccagaggaggcagaaagcaatagcagtgttttaagcaggggagaataacatgttagatttgtgtcatggaacgatcactgagagaaatagattggtaggaagcagaattgtaggttagaaacaagctgggttgggagactctgtggggtaatagaggagaaggataatggcctgcactaggatattggcattgacgatggagagaagtgaatggatttaggagtagctctctttagaaggaagaattgttatgacttgagtggttggttagatgtaaggttgagagaaaacccagacatgattctctggtcatggttggggcagatcgaagtctggagaagtagcagtatggggaaggggctggaggaacagagggaaaacatgagttaaagtttaaatttgctgagatggaaagtgtttgatgagacaggcaagttaagcacttagatatacagatgtaaccatattataagtctagcacttaggaaagagctttgaaccctatttgagatttatatatataaaatatttgagccactcttctataggggttaaattaagccatggaaggcagaagggagtagtcagtaactttaaacattgctgagataacaagtaacataaagcctgaaaagggtttgttggtaatttgggtgagggcaaaaaccagatgcaagtaattgaggagggagtgagaatgaggaattagagaagctagagttgaatgtgggtttgtggctttttagcaggattgttgcaaatggggagagcctcaatcatgtttaaatgttgatgagaaggaaccagggtaaagggagaagctggagacatgactgggaagtgtagattacagtctctgagtagattcgagagaatggaatctagatcccagatgaagggattagacccaggagaaaggatccacagcagcttccattgtgatagggcaaggacaggaattgtaatagggcagggacaggaatttctatgttgagtatcagaaaaggaaatcaggtcccttgatggctttagttgtcattgtgaagtaggaggtgaggctaccttctaagagtagggggcagaatgtgttggcagtttaagaaacatcaggaggcaggcacagtggctcatgcctgtaatccaagcactctgggaggccaaggtgcgaggatcgtttgagcccaggagttcaagaccagcccaggcaacacagcaagaccctgcctctacaaaaaataaataattggctggacatggtggcgtgtacctgtggtcccagcgacttgggaggctgagatgggaggaacgcttgagcctgggaggttgaagctgcagagagctgtgattgtgccactgtattcaagactgggtaatagagggagactttgtttccaaaaaagaaaaagaagaaacatcaggagaggatatttgaaatcattgctgtggagggtgagagtgcgaacaaggaagttgtggtagcattgctagacagttttgagagcccaggtaaggctgatgactaagaatttatggatggcataggcctgcatagttaatttttatttaaatagcagtgtttgaagagatcgagattccttttgaggcaattacctcgttaagtatttcaatagttatctttaaatgtttaagaatttggctccttttcctctcataactattgttaaaagaggattgatcctaaagtgtagagaggcaatgggttataaaataataaaatgaaaatttgtttcctttaaaacgttttcaataatggacatgtatttttttactctttagtcatattctgtactactcttctgcttaaaataggattttagagttatagaatttttagagcaggaaaagaggtcttttgagattatatttttctttctgacaatgctatttttttttttaagcacaagaatgtttgccaagtgcaatcttagaggaatgacccatgtataaaacagctaaaaatggtggtgctttgatgtgtgctggtaattaggaactcaaactgtggagtcagactacctggacttagaataacctgactctgcttcctacctgtgtagctgctaagctccagtttcctcatctgtgaagtcagagtaatactagtacctccatcatagactttgtaggaattttaaataggatactatgtataaaactgcttagcacagtgctccatcaatgttagtttggttaatctggttaaagcaaagttgggtaggggggcattctagcagctgtacatgcctagtccctaccttatcccatgtggtggctcctgagatagcttcctagaacccttctatagatgcagtttgaaaatctctaatcttggctaggtgcgatggctcaatctgtaatctcagcactttgggaggctgaggcaggcagatcatttgaggtcaggagttcaaggccagcctggccaacatggtgaaaccccactctctactaaaaatacaaaaattagctgggcgtggtaatgcatgcctgtaatcccagctacctggcaggctgaggcaggagaattgcttgaaccctggaggcggtggttgcagtgagtcaagagcacgccactgcactctggcctgggcaacagagcaagactctctctcaaaaaaaaaaaaaaatctctaatctgattcatcctcctaaatttgcagatgggctttagattgtagaataacattttaaaagttcaggccaatttcttctgctctaggttctacacaaccgctattgctgaattaagccgcataaccatgcctagaggctgtagcttctctctaggtggtatctgagaaatggaatgtaaaacattgaattagaaggaagtttaatattttaaaaattatagaggagtcaataaaatagagtacctttatgatgtatataatgcttagtaaaaatcgatcagctagatggactgagtgggttcttaaatatgttcttttgttgtttatgcttataaatctaattttgataaatcttttaaaaagtatatataatctccagttggaagttctaaaagcttgatggttccttaggataactacttaatttatcttatgatagaactataatttacagcaagtatgggccttctgccaccaaatcttggattttttcttcaaatggtgatggaaatctcataatttttatggcaaatgatgtgtgaaacataataaaaaatatgatgccggatatatattggtaataaatagcttgttactggcaattcttgtgaaatgtgatttaaataatttaaattattttttatttttaattattttattaattttatttaattatttatttattacaaagtcctttccaaaatatgatgctcttccaacgaaaaaagaaagggtaccatataattaattctgcagatgtacattggaaaacaaacattgtatttgattctggggatacaaaatataaacaggtatggtatttgctttctaagaactttcatttcattccaggaactgtcctgacttcccttcaattcataccctccttttaagtttccagctctgggtaaattccatgctatgctttcttcactccagctccagagcttaaggttattgctgaattaagccacgtaaccatgccatttgatccacagttcctctttttctcacttttctttgccattttccataagaatagttccaagattttattttttccttatgcctatggtgccattcctcatcttttcacatgatagaacacctgaacttccttccttccccacttgactgtacttcatgatctgtagccttcaacattttggatctcttcattatttgaaaaactgttctattttataattgtatatgaacaagtctaatttcctgtgaaatatacagggaccattcttgttcatctttgtgttccttgtgtttaaaattattccacatgaccatgaatgattggtggtttcttgatagtctgcattagatagggctggatattggttggttccaagatactgtctgcaagcttccttttttgaatccagaagcatatttgaacagtcaaaacctggcaaaactgctgtttagtgtcatattttaaaaacatatttccattatcaattattttggtattgaatgcattttgactgaaacaatagggatcaactttcgtgactgatttcaaacccattatttgtgattatactgtactcctatactgtaggagtacagtatgtaaccaaatgtaattggtagtagaatttgaccagttcctagttaggtagttaatatgttctgtttaaggaatttacatttagttatatagtagtttcttatcagatgtagattagtgggaaagttgttttgaagtaattaaacatttttcctaacaatagaaggctaatttgcgttctaatttttattagataagaatattagtaggccaggtgcggtggcgcatgcctgtaatcccagcactttggaggccgaggcaggcagatcacgaggtcaggagatggagaccatcctggctaacactgtgaaaccccgtctctactgaaagtacaaaaacaaaattagccgacatggtggtgggcgcctgtagttccagctactcaggaggcggaggcgggagaatggcatgaacctgggaggtggagcttgcagtgagccatggtcgcacgcgccactgcactccagcctgggcgacagagcgagactccatctcaaaaaaaaaaaaaaaaaaaaaaagaatattagtggtacagtgatagacacaaatagctagattttcgctatagaacaagtattttataaataaatttatagaataatattgtgtacagaatagttttctttaaagcatacatgcttaacaattagtaaaaaaaaaaaaaaaaaccctgtgacaacattctttacctttttttttcctttttgctctttttaggcctcattgctacgatttcagagtaccctggtaatagctgagcatgcaaatgattccctagcacccattactttaaataccattactgcagccacacgccttggaggtgaagtgtcctgcttagtagctggaaccaaatgtgacaaggtgagaaatttttaaggtcagccatagcaaatattatctccatcaagagacaggaaaagatggcaacagagaattatgcttaggattgtaacccaaactgggctctaatcctcattaaatggtcagtgtcacaaccattaccatgtgtgaaaaaggaactaaaaggtttcttccctaagcattttatcttttgaaatgcagtagaatacttgatttagttccactggcaccatcatgtgccatcaggtaccaagtggaatgataatatttgagtccccttagaggttaatagctgatctcttttttgtgttgatgaatatacttggtaattgcttctaattcctgaaagtggtaaatctggacaaagtattatggatgttaatttttaattggtagaagaatttgaatgttaagtactattctttccaaactctagctggtactaaaagatgttcttgggtttgtttgttgttgttgttgttgttattgttgaaatcagatgataacagcttggaacactaaccctctagaaaggtgctatgatatgatttgcagggtctataccaccagcctgcaatatagatgagtgcttcagttaagcttacacaccttcagccaccagttccctctcacatggtataggagttgctgagtgtgtagttgggggcttaaacttcacagaggaataaatctgaagggagtatgttttgaggattttatgttttattaaataattgatgctggctgggcatggtggctcatgcctataatcccaggactttgggaagctgaggtgggtagatcacttgaggtcaggtgtttgagaccagcctgggcaacatggtgaaatcctgtctctactaaaaatataaaaattagccagtgtggtgatgcatgcctgtagtcccagctacttggaaggctgaggcacgagaaccacttgaaccttggtggcagagtttgcaataagcagatattgtaccactgcactccagcctgggtgacaaagtgagactgtgtctcaaaaaatatattaaaaataacaataattcagagcatgtgataatggaggttcatactgctggtgttgcttctgtctaattttttacatgaaattgataaaagaacatattctggtgggtttatgattagttatgtggatttctttacccaattcctgctaacaactgtaggatcttacatagttgatacagccacaatgtgtgatgtgtgatggctaagctatctatttgtatgtctgtattagccacagtatatgatggctaagctatctttttggtttccctgtttttggatatataggaatttgtgatttgttgtttgttttgctgtgatttaaaataattattgtaatattactttaaaaagactttgatactttatactactttgagaaaaatcaaaatagaaatcgtcttctgtactcagttacaatcctaacctgtcatgttctaattttaaagaaaacaaccagtacctgtatgaagagatcgtttaatagagttcggttttataccattttattcagctacttgtcataaacagcaagttattcttctgtataatgccagccgttttgccagtaaaaacaagatagtttcaatgggaaaattctgccccattttctatcccatgctgctatgcagctacattgcaattaactgagtttcttaattggaaattctcttaaagtttgagaagctaaatgcagctgcatccataataaagggcctctgtagtacaaatggtatgccggtgaacacttggtttagcagagaatgtattcttgcactgcatcctttcttcagtgaatattgttgcaagctaacagttcatatgagggtggcacaaggcacagccttttaatcctactcatcagtgaatcaatgaatcagtttggaggtaaacaaggagacagaagacgatagtatgactgatatgacttagctaaagtggaaaccagccatgaggtaataaagatacttaaaaaggggaaatctaattgccttctgaatatagaaaatctgaatcatcaaaaagctttctcagaaccccattctaattccaaacaggaaaaatgaagaattaaaataggaaatattttgctttgtcatagataaatatgtgtatgtgggcaggaactcagtggttgacaatgggatgttactagagaacttcattttcaccatttccaggacattgaacttacacttggattgaaccaaaagtaaaaagcacaatttataacaaaatttgaataaagagccatgttgattttggtttgtcaattagcacttttctttttcaaggcaggaatttttgttgaaatgcttggtagttggacagtgtaaggtcagtcagtagtaagatctattggcattagattttctttgttaaggaatgtattttaatattttaattctttgtttgtttgagatggagtttcactctttcgcccagtctggagtgaagtggtgtgatcttggctcactgtaacctccgcctcctgggttcaagccattctcttgcctcagtctcccaagtagctgggattacaggtgcccgccaccatgcctagctaatttttgtatttttagtagagatggggtttcaccatgttggccaggctggtcttgaactcttgactccggtgatctgcctgcctcagcctctcagagtgctgggattacaggcttgagccactgcgcccggccggaatatattttaattcttaactggcccttttgctaataagaataatttttacagttggccattaagattttatgatctgttgatatttatagtggtggctttatttgtatatttctgatagatggataattaggaacttatcttttaatcataggtggcacaagatctctgtaaagtagcaggcatagcaaaagttctggtggctcagcatgatgtgtacaaaggcctacttccaggtgaggttttccagtagaaaaaaatgtagtgtctaaattacgcttgaatatatgaatatgaaagtatttcaaaatatttttttatcaaatgtgtttaattctcagaggaactgacaccattgattttggcaactcagaagcagttcaattacacacacatctgtgctggagcatctgccttcggaaaggtgagaaggttgagaatgtggaatctgatatcactgcttgaaagggttagatttcattgtgctgaaagtatgcaacagactgtttatgtagccaatctggatttatctgaattgatgtggtagttttgctaaaatttattctttcaagattttgtcataattttccgttaaaactaccatttccaggttttcaaattatgttgtggagaaaactctaattaggctattattttaaaattttctgcatgtaaaagtaatgctgaattctgcttgcatgtgagagagagagtgaacgagcaagagtcatttctattagtagcccattttaagagatggtttatttggatggctgatggatatctagaaaagccaaattttatctacgtagggaatttggaaagggcttgtggtggttgaagacatccttaaggtaaagaaagctgtaatctgatcatgtgcattgtgatgtgtctgaagaatgagtgtgttataagatggatagcagtctacataaagttaaaaatggagggaggagtgtaatgggagcttaagacaaggaattcgtcagtggatttttcttgctctctctctgtggccgtgggtgttatcttagctctcttttcttttgttccattcttaataaggtgtcatttttagtctttatttttactttcttttttttgagatggagtctcactgtcgcccaggttggagtgcagtggcgccatctcggctcactgcaggctccgccccccggggttcacgccattctcctgcctcagcctcccgagtagctgggactacaggcgcccgccagctcgcccggctaattttttgtatttttagtagagacggggtttcactgtgttagccaggatggtcttgatctcctgacctcgtgatccgcccgcctcggccccccaaagtactgggattacaggcgtgagccaccgcgcctggcctactttttttttttttttttttcgagatggagtcttactttcctcgcccaggctggagtgcagcagcacaatctcagctcactgcaacctctacctcctgggttcaagccattctcctgcctcagcctcccgtgtgtagctgggattataggtgcgtgccaccacacctggctaatttttgtatgtttagtagagacagggtttcgccgtgttgaccaggctggtctcgaactcctgacctcaggtgatctgcctgcttcagcctagctctgttgcccagactggagtgcagtggcacgattgtagctcaacataccctccaacttgtgggctcaaacgatcctcctatcctagccttctgagtagctaggactacaggtacatgccaccatgcccagctaattttcaaattttttgtatcgatgtagtctccctatgttgtgcgggcttgtcttaaactcctggcctcaagtcatcctctcatttcagcctcccaaagtgctaggattacagacataagtcactgtgcttagcctattttcacttttaaaaattgtaaaataagttgtacacaaatacatccttattaggaagactgcgtgtagtacagcagtgtgcagagcaaggtgtcaaagtcctgctttcttattcccaactcaccctcccctctttagaagtatagctgttaacaattgtacattcttttaggcctccttctatggatttttaaattacagtacatgtacagctatatattttttacttctaaaatgggataatatggcatgaattgttttgtgaatagtagcttttacttaagagtatgacttgggcagggtgcggtggctgacgcctgtaatcccagcactttgggaggattgtctgagcccaggagttgtagcccagcctgggcaatacagtgagatctcatctctacaaaaaaatgaaaaaaaaaaattagctgagtgtggtggtgcatgcctgtggtcccagctacttgggaggctgaagtgggagaattgcttgagcctggaaggttgaggctgcaatgagctgagattacactgctgcactccagcctgtgctccagggtgacagagcaacaccctgtctcaaaaaaaaaaaaaaaaaaaaagagtagcgactttggctcataatgtttctctttttttatggctgcataagattccatgtttagctaaggacagttaacttggttccagttttttgcatttatatactttactgcaagaaaacatggtcatgcatgtatctgtgtaaacatgggctggaatttatttacaatagagttctagaggtgaaatcactgagtcaaatgctatgtagtttaaaaattttgatacctattacttaattgtcaacacttggtagtatacattttaacattttttcctccagtctgatgggtgaaataatctttgtggaccgttctgtctctgagagttttgattatatattggatgatttaaataatttcatgagccttgagtttccttctatgatgacagttcacctaacagagtgttagaccatgaaagggtgtttgtcattagctagattttagtactctggccatgattgctatgttgtaacagatgggagttttgagaataagggtcacataatagtagctggtcgtgcggcctgtaaatgggtttggaatgagaaacgtctatcagaagaagccaaacaatttgctgtatgatagtccttcaccagctgtggttttgagataacacacttttatacttgtctgctagaattttaaaatatgtcattttttatgcacaaaaagaactcaattattgcttcttcttcccagaaaccatgcaggcagcttgttggatgggatatatttttaataggatagatatctgtgtaccatccaccctcatgatgtttagatagaagaccagatccaggaaaacatacttttaagtaccatggtaaaatttcttgaagatatgttaaacaagggataatgaaaatacaaaagacattaaattttgagcaatttagaaagttctaaaacttttaaaagaggcaaagtctgtataacataaaatttgtaagataatctgttcagccaagtaactattccagtaataattcctgaacagttaaagaaggtggttcaggaggaggattacttactgaagctagctttaaatactgacaaatctggtttttaaaccagattaagtaggtgcttcagaatgggcatggtggctcatgtctgtaatcccagcactttggggtgccaaggcaggaggatcagctgaggccaggaattcgagaccagcctggacaacaacgcaagaccccgcttctacagaaaaaaacaaaacataaaccaaaaaatgagctggacgcagtagcgtgcgcctgtagtcccagctactcaggaggccaaggcagaataatctcttgagcccaggagttcaaggttacagtgagctatgatcacaccactgcaagttcagcctgggtaacagaatgagaccctgtttccaaaaaaaaaaaaaaagaagaagaagaagaagaattaactgagacttggggaactgtgactttcccaaggattcctgctgctgaggacaaagttagcacatgcatctatttcagtacaagcacaagaacacacctttattttatttttgttgctttttaaatatgtactacacaggctgttcttcaggttagtgttattcttttccttttttttttttttcttttgaggcagagtctcgctctgtcaccaaggctggagtgtggtggtactatctcagctcactgcaacctccgcctcccaggttcaagcaattctcattctcatgcctcagcctcctgagtagctgggactacaggcatacaccaccatccccggctaattttttgtatttttagtagagatggtgtttcaccatgttggccacattggtctcaaactcctggcctcaggtgatcctcagcctcccaaagtgctgggattacaggtgtcagccactgtacctggccttactcttttttttatacaatatcaatttaaacaaaaggtgaaatgtctgctgtgaatttttttcttttatatacattaagtaaatgtatacaagcataatctttttcagtatttgagaattttaccacccttctaaatttgttctatcttttcttatctaaattcaataatccacaactgtcacacttggtaattgatgtttattaaatttcatatctcatagttcaatatattgcattaaggtggcttaatactgtaaaactcatgaaactcttaatgtagttagagtaatggtaagtactcaatctcaaaggctatttaaaaagctgtgcttgaagttgtgtatccaaaggtgcacacgaaatataaaatatttgaattaaaatttctacagaatatgcatttagaatatgtcattactgatcatttatagtcttccatcactatgtatgtgtgttaactcactgcttattttgcttttagaaccttttgcccagagtagcagccaaacttgaggttgccccgatttctgacatcattgcaatcaagtcacctgacacatttgtgagaactatttatgcaggtgagtactcaaggaagataattaatcaacatgttaaattttagtgaaaagcataaattaatcttgaagatagaattttaaatcaaaccatacaattgctttaagtggaccatcttaaaggtttctgaggaaaattttagtctagaattgctggtggcccttgacatggcattctctctgatggatcgcaaacacagagatttcctgcctgtttattcagtttgcagggtgatattttcctagtgatcaataaaaattagattcacaatttaatatattttgtaagtggtacctggaaaagcaaaacttaaaaaaaaatagtattctcaatctttgctgcttctacttcatttccataggcattaagaaattcattttagccagctgcagtggctcgtgcctataatcccagcactttggcaggctgaggtgggaggattacttgaactcaggagtttgaggctatcctgggcaacataataagaccctatctcaaaaataaataaataaaataaattagctaggcatgttggcatatgcctgtagtcacagatacttgggaggctgaggtgggaggattgcttgagccagaaggtcgaggctatggtgagttgtgatcatgccacagcactccagcctgggcaacagagcaagaccctgtctcaagaaaaagaaaagaaattcatttcagtgtctcttcagttgattttttgcttagcacactggtctctagtggggtcggagaaggcagtgaactcttcgttttttgcctgattaaagttgtgtattccagtatgaatggctaattctgaaattagacttttcatcttccataatgtttgagggaaaatattttgtcatggtttaggttactgttaatgtgatagctaatccagagtgtctcaaatcctcttaaaatcttagcacattcatacctgttctttatgacctattgtgttttcaagatattcctcctttagcatgcacagtagctacattcttcctaagttgttgcagctcatagttttgagttactgattgtattgtttttggagaaggaagctttgttcatattccttttagaggtgtagtgtaccttcttagtgtggatgcctgttcgagtttcttccttctaggtgtggtagtacctgtcctgcttttaaagacatccagggttatacagatatctgctgatatgtttcttcaccgttatggttcattttttcctatacttaatagagttagaagacaactggtcaatagttatttcttgccttgtctgtgaagtaaattccaagcatcaaaggagtgctagttttgttgccttttgctgttgcttttaagaaatagattgtatgtttcaggaaatgctctatgtacagtgaagtgtgatgagaaagtgaaagtgttttctgtccgtggaacatcctttgatgctgcagcaacaagtggcggtagtgccagttcagaaaagggtgagtgttcatttggagtttttttgttttgtttcttacttttttaattcatagactgtattataataagagatgacctctgcctacatttctaatgaatagtatttgaaagttcaatttaaatgatattcccaagcttatacaaaaataataaatatgtataacttacatctttttcacattatctttggtactaggatagttgctttggtagatcaagggagtgggagacagaggatctattaagattaagcttttttactcttgtcactgtttcctattatatttgggtgattcagtataacagaagaatgtaataggaaacgtgtggagggtgtcacactttaacatatatagtgtcttatttgaacctcatagaaagaaagttattctatattcagactcagagaattgaatgatttctggagtcatacagctaatgtggcaaaggctggaatctagtctccttaagtctttccattatcagagagaattaattaggagcactgaaaattcacagtaattaacttaaatttcgtggaattatatacttgtgtgtttctcttgaaaataattcttgttatagaacttgaaatcatagtcattgttttattatgtattaatgtatgcagcatcaagtacttcaccagtggaaatatcagagtggcttgaccagaaattaacaaaaagtgatcgaccagagctaacaggtgccaaagtggtggtatctggtggtaagtgaaatattaatcttaaaagatgtaaattgaaaatactttgatttttttttttatttttagtatttattttagaagtacacagatctttttcaaatgtaagaagttgggaagtttgggatattattcccatttaaccaattaggaaaatgaaattatgagcataatacacagtttggggtttctgttgcacacctagtcactggcaccagggggagcatggtataaatcttatctgcataactttgccacttggtgccatcttattgatggacttccatgaattctgcagagtatggttggcttctcaattatagatagaactggcttgaatttcagggccatcttgtgtataattcctacccttctttccacttggaaagatttccagagttgtccatgtctttgtgtataactctttaaaaagtttcttaacatttaatatcaaaactgttaatattgcataagacatgcttatttttatacatcatgctccttgtctttaaaaacaatgatttttttatggcccactgactaactttttgaaaaaataaggactgttatgctttttaaatccttgcaattaaacatccaacaaaataagctttcagacagccttctattgcaagtatcattgagaaaaaaaaattaatattttgaagtgatatatctgacttgtttttcgttttctttttttctttttgagatggagtttcgctcttgttgcctaggctggagtgcaatggcacaatctctgctcaccgccacctccacctcccaggttcaagcgattctcctgcctcagcctcccgagtagctgggattacaggcatgtgccactacgcccagcgcggtgactcacacctgtaattccagcactttgggaagccgaggcgggtggatcacccgaggtcaagtgttcgagaccagcctggccaacatagtgaaaccccgtctctattaaaaatacaaaaaattagctgggcatggtggtggatgccagtagtcccagctactcaggagggtgaggcaggagaattgcttgaacctgggaggcagaggttgcagtgagccgagatcgcaccattgcatttcagcctgggcaacaagagtgaaactcctcctaaaaaataaataaataaataaataaaaataataattttgtatttttagtagagacggaggttctgcatgttggtcaggctggtctcgaaatcctgacctcaggtgatccgcccacttcagcctcccaaagtgttgggattacaggtgtgagccaccgagctgggccctgacttgtttattcacttatttattcaagaaatgtatattggttatctgttctatgacaggcttattgccaagtgctggagaaacagatgaaaaggcagaatgttcttcctctcgaggagtttaaagtccttgagatgactcccattcaaataataactttattcagtcattcagagaaatttattgagcatctattatatgtagagttttgctaaatattgcagatatggcagtgaccaagatagatatagatcctgaaattaaagagtttttattctagtgggaaaaaaactcatattaattacacaattagttaactaggtaatcatagtagtgttgaatgctttatagaagtataggagtgtcagaggccagaaaaggtttatagaggaggtgacatgcttaatatggcagttacataatatgaaaatttactccagtatataaaatagcaaaattgttccagaatgtatttgatgtttgcctaatttttttttttcatctttttaaatgaggtcgaggcttgaagagtggagagaactttaagttgttatatgacttggcagatcaactacatgctgcaggtaaagttattttccttagtagaaagatattccctttttgttggaaatattttttcttcattatttcatttttgtgtaagtctttcagccctacaaattattttacttttccggatttttcagtttttctctctgaaccagtttttcttaagcctccaagtaaatggtatatagcattcagtgaggagaaggcctcctagtatctcttacctttgcctaatcttagtaggttttcttttttcttcactttaaaaataatgaaatgggccaggcgcagtgacacacacctgtaatcctagcactttaggttgctgaggcaggaggactgcttgagcccaggaatttgagaccagccctagcaatgtagtgagaccccatctctacaaaacgtttaaaaattagccaggcatattggtgtgtgcttgtagtcccaggtactcaggaggctgaggtgggaggattgcttgagcttgagaggtggaggcgacagtgcactgtggtcgtgccactgcattccagtctgggcaacagagtgagaccctgtctcaaaaataataaaagacaaaataatgaaatgttagtttcagtgcctacttcagattcaggaataccctggtttttcatcttttttttggtggtcttaatataactcttatacaaatagaaatacatttaaagtttttaagtttgtagttaaaaatatagaattgtagttaaccatttataggtaaggtagaacctattgctaaaagtacattgatgagaagggagtgatgttttttgaaaaaccaaaaaaatttaagccaggcacagtagcatgtgtctgtaatcccagttacttgggaggctgagttaggaggattgcttgaacctaggaatttgagaccagcctaggcaacctaattgagaccctgttttgaaaaaaaatctttttaaagacatttgattatttttgaattacacaatcactacaatgaatatatattaaaatgtcccaattctgtcatctcaccctccttttaagactttaacatataactttcgagggttttcctgtaactttctgtggttttcctgtgcgaaatttctattacataacacgtgtacccatagaaacagtaatagttttgtcagaataaaggcattatattgacactgtataatcagatggtagtatttcagggtttattttcattccttctttctttgaacaagtatttatcaagtgtctgccatattccaggtactattttaggtgctattagtttattttggctacagtaataagttactacaaacttggtggcttaaagcaacaaagtttttctctcacagctttggaggccagagatgtgttgaagtgttagcaggggccatactccctctgggggctctaggagataatctgttattttcctcttccagcttctggtggctactctgatatccctgggcttgtggccacatcactacaacctctgcctctgtcttcatatcatcttctctgtgggactgcattcagtctccttctgtgtccctcttataaggatacatggcaggcgtggtggctcatacctgtaatgccagcactttgggaggccagggtgggcggatcacctgaggtccggagtttgagactagcctggccaacgtggtgaaaccccatctgtaccaaaaatataaaaattagtttgatgtggtggtgcacacctgtaatcccagctacttgtgaggctgaggcaggagaattccttgaacctagaaggcggaggttgcagtaagctgagactgtgccactgtactccagcctgggtaacagagtgagatgccgtctggaaaaaaaaaaaaaaaaaaaaaaaggatacgtgtaatggcatttagggcccatgtagataatccaggataaactccctctcaagatccttagctttatatatatctgctgccacgtaggtaatattcacaggttctgggtattaggatgtgaatatatcattggaggggccattttcttgcctactacagacacttaacaccatagattagtaaataatataatatgggccaggcgtggtggcttacgcctgtaatcacctgaggtcaggagtttgagaccagcctggccaacatggggaaaccccgtctctactaaaaaatacaaaaattagctgggcgcagtgatacgtgcctatagtcccagctacttgggaggctaaggcaggagaaacgcttgaacctgggaggcagaggttgcagtgagcagaaatcatgtcactgcaccctagcctgggcaacagggcgagactctgtctcaaaaaaaaaaaaaaatgttagagagtcgtaagtgttagggagactaataggatgggttatggggggtggagaattgaagggaaagattgaagtttaaaataagatagccagatttggccttaatgagaaagagacatctggctgggtgtggtggctcatgcctggaatcccagcactttgggaggccaaggcgggcggatcacttgaggccaggagttcaagaccagtctggcccacgtggtgaaaccccgcctctactaaaaatataaaaattagctaggtgggcggatttcttgaggccaggaattcaagaccagcctggccgacatggtgaaaccccacctctactaaaaatacaaaaattagatgggtatggtggcacgtacctgtagtcctagctactcaggaggctgaggcggcaggatcacttgaaccatgaggtggaggttgcagtgagctaagattgtgccactgtactccggcctgggtgacagagacactgtctgaaaaaaaaaaaaaaaaaaaagacatctgaacaaaggtttgaaggaggtgaggaagcgacccatgaggagatctgagggagagtgttccagaccagagcaactagtaaagtgcacagagcctgtctaacgcaggaacacatctggcctatttgacgaataggaaggaggccagtgttggaatggaaagtgcaaaagagaaagtagcaagagataaaattgggaggcaacacaagaccagatcacatagggccttataggacattgtagagattgctctttctctgaatgaaatggggaaccatttcaaggtttgagcagaagaatgacatgatctaacacatttttaaaggatcactttggctgcagttttgtgaataagctgtagggggtaagtatagtaatggggagatcaattagcaggctatatcagtcgtctaggtgggagatactcatagtttggaccagggtagttgcagttgatgtggggagaaattgtcagttttgagatatatatttgaaggtagagccatcaggatttcccgacagattggatgtggattatgagagaaagtatttttcctggcgagtggtaggatggagttacagttagctgagataaggaatatctcgagtgaagcagtttccagggagagatcaggagttcagttttgggcatattaacctttgagatgtctaataacagacatctgagtagacatgtcagttaagcagttggtataggaatgtgaagttccatggagaagtttgggctagaggtacatatttgagaatcagttcatttggatgatattgaaagccatgagactggatgaaattaccaagggagggagtgtagataaaaaaagaggtcccaggccaggtgcagtggtgtgagcctgtagtccctgctactctggaggctgaggcaggaggatctcttgagcccaggagtttgaggctgtattgtgttatgattgtgcctgtgaatagctactgcattacagcctgggcaacagaatgagactttgtctcttaaggaaaaaaaaaaaaaactcaggactaagccataaaccctgtatgattgagagctaagagagaaaaggagaaagaagaccaaaaaggagtgataagttaggctagataaccagggcagaggctatgttttggaacccaagtggagtgtttcattgaggggggaaaaaattgatcaactatgacacacactgctaacaggtcaaggacggtgaggactgaagattgactattggatttaaccacttagacatcgttggccactgagcagtttcagtggagtgatggaagcaaaagtctgattagagtgggtttaaaagaacaattctggccaggtgcagtgactcgcacctgtaatcccaacactttgggaggccaaagtgggaggattgcttaagcctaggagtttgagaccagcctgggcaacacggcaaaaccccgtctctacaaacaatatcagaattagccaggcatggtggtgtgcacctgtggtcccagctgcttgggaggctgaggcaggagaaatcacttaagcccaggaggttaaggctgcagtgagctgtaattatgccactgcactccagcctgggtgacagaacaagaccctctctaaaaaaataaataataaaaggcataggtagtggttacatggttgtcttcactgtatgataatgctcttgagcagcacatttgtctttttctgtgtgtaggttatattttaatgaaaaggtttttagagatagaatgggagggctggagttggagacagtgaatacagataactttttgagggattttgctatatagggaagcagggaaatggatggtagctagaagaggagtctggccaacagggggacttcataaagctgggacaggtaataacatgcttctatgctgatgggaatgctccagtagagagggaaaagtagtcatattttttctcttcactttttccccttcccttcacatactttttcacttcactcaaggacgtcactcccttattctccctcagtaattctcccctgagggaagtcagaattactggaatgatgtccttgagtagacaagagacaatgtggacatagctgcaggtggtgggtagatgtgttacttggagcatgtggaaattctcttttgatcctttcagtttttttcagtgaataagaagcaaagtcatcagctgagaatgaggatgctaaagaggtataggaagtttgaaaagaagaaaatatatgaaattatagtttaggaaacagctaatgaaaggactgggggaacttagtataactgccaggaattaaggtttatttatttagaggaaaatatacttcacatggttggatatttggatgttttctccagtaatgctgaactacaggagaagagctatggaaaaactggagaggttgcttaatcagccggaagagggaggtttttctgagtgagtgtggtgtgatataagaggagaacaaggaagttgaaggcatagcaaaggaatggttagaatgattgatcatagaatttaaggtgggcaaaaacaagaggacaatgggggagagttaatagaattgtagattacagtggggtcagaggaatgttggaggtgaatgtctgctggaaagaggaggtcagaaagacgctgaaaattgggagtattaagcaatcttggtaaagaaaatgtctaggatatgatcatgggtgtggctgaggtagggtggtgggcaagctcactggaggagagttgttcaaatctccaagtgttgaaatctccaggaattaagataagactagtgtaggtcttttggtttccaatctggcatataagaagcttggaagtcactattctgtcctaacaacaagtaaaaaactgaacaaactgaagaatcaaaactcatcttagatccataggagaagtgaggttgcatggcaaactgctgtcccccaaactggagagaccaacaagcaaatacagataatcacaacttcccagagcagaaacccaaaagtagcaacctccacaggagctggtggtggggtagggggacttgaagtcttgttgatgaattgttggaggttccgtgttaaaaactccaggtgggcagggcacggtggctcatgcctgtaatcccagcactttgggaggccgaggtgggcagatcatttgaggccaggagtttgagaccagcctggccaacttggcgaaaccccatctgtactaaaaatacaaaaattagttgggcgtggcagcacgcacctgtagtctcagctacttgggaggctgaggcagaagaatcgcttgaatcctggagatggaggttgcagtgagccaagatcgtaccactgtactccagcctgggcgacagagtgagactctggttttttgttttttttttttgtttttgtttttgacaaaaaactccaggggtatccagtgtgaggtcccaacatttttgtgaattttaccttcaggagctcttccacatggtgaaaattagagaaaaatcacctcatgcttccgacaaggggacgggaaagggaaccattttaaaatatgccagagcattctgttcttcttaacaaggtctgatctccttcaggaggaactgtttaaccagagattaacttgtggggctttatcagagcctaactgacctgaggaaaggtaaatactcaacttcagccattctagccatcctgtcccacctaagggagagagaggaactgagaagcatgtgtaaagttcacagtctcaatatggtcttattgaggtacggtcttagtaaaagaccaagacgtcaccataggactgtagaatgcttcctttcccccaacaccttaccaccatgtaataaaggcttattgacagcacttccttttacccgtgtacatcatgttgggctatcaagaaaatattgcaagatatactaaaaggtaaaagacagtttgaagagacagagaaagcatcagaaccagactgagctggaataatcagactggaaatttaaaacaactgtgattagtatactaaggtctctaatgaataaaaagcaagcaagatgtgcaatataagcagagggctagaaatccacgaaagaaacagaaatgctagagataaaaaacattgtagcagaaatgaagtataccttttaaggacttcttagtagactggatatggccgaggaaagaatctctgagctttaggatatctcagtagaaacctccaaaactgaaaagcgaagagaaaaataaccagaaaaagaaaaaaacaacaacaacaaaaaaacctgaactgtaatataatatctaagaattgtggaacagcttctaagagtataacatgtaatgggaatactagaaggagaagagagaaaggaacagaagcaatatctgactgaggatttcccctcattaatgtcagataccaatccacagatctaggaagctgagagaacaccaaatatgagaaatgccagaagaacttcaactaggcctatcatttgcaaactacaggaaataaaaaataacaaatactgaagccagaggaaaaaatccaccatacctgtacaagagcaaagataataattagatctgatctcttttcagaaaccatgcaagcagaagagagtgtagtaaaatgtttaaagtgctgagagaaaacactcaccaatgtaggattttataccctgtgaaattatcctttaaaaatggaagagaaataaagactttctcagacaaaaattggcagaatatgtcatagacttaccttgcaagaaatgttaaaagttcttttagagagaaggaaatgatagaggtcaaaaactctggtgtatataaagcaagtgagagcattgaagagggaatgagtgaaggtaaaataagttttatttttcttaattgatctaataggtaacagtttaaaataataacattgtattcaattacatatgctcatgtattacaattacttatgtgctcatgtataagtgaaatgaatcacaatgtaagaaacaggagataggaattaggattatcttgctattaagtggtacttgcaccacctgtgaagtagtaaagtgttatttgaaagtggacttggattagctgtaaatgaatattgcaaactctaggaccagcactaaagtaaaacaaaaatacaactaatagctaagaaaagagacaaaatgaaattatttaaaatgctcagttggtggaagacaaaaataggaaaaaagaacaagggcaacaaatagaaaaccgttacaaatatggtagatattaatccaactgtgtcagttattactttcaacatcagtagtgtaaatgcaccaattaaagataaagattgtcatagtggatgaaaaagtaagacccaactatatggtgtctacaagaaacccactttaaatataaaaatacatatacatataaagtaaatgagtggagaaagatataccatggtgatgctaattgaaagaaagcaggagtagctatattaatttcagatggagccaatttaaagttaagttttattaggtaaataaaacctgagttttaatacacttaaagttttaagttctaaaacttacattttaataaaacttaatataacttaagtttcgctgatattgggctccatattccagaaatcacagtgtaagggttaggaatatgggagattggtgcaggttagggagcatgcagagcattatggggatcagtgtatgggttatgaaggataacctttgagtttggggcttatggggacagacataatgaagggcagggtgtgattagtcctggctgactcaagatagtggtggtgaggctgtgcgtttttggaggttgttagttgtattgtctatggctccctctgtccttttcagcttgagatgaagaggcctgaggctcattcttgactcctgctggggaaggggttgttttactccaagtatagggctcattgttgactcctgttgaatgagaatagaaagtctgttaaattttatttgtgaatttgatagcaaatactggttaaaccttcatcttgttatatgaaactctttgtccagtatcttctctttatagtattacaagaggtaatattgtaaaacctttcttcaaaacttgtgaagttattacttaaaggagcattatataatgacattctaaacattatagtgtaaattttatgactgccattttgataaagcatgcagaagagttaagcccaaattaaaatctgaaatacttgggtataaaaagaagttattccttgaagctttctgtataaaatatactagtacttagaattctaaatcaatgtctttgtttacagttatcagtgaatatcctaactagctgaataatagagcttgaaaaaaatgacaaatattttttccccttagttggtgcttcccgtgctgctgttgatgctggctttgttcccaatgacatgcaagttggacagacgggaaaaatagtagcaccagtaagtattgcaataaaatatgctgtgtaaaatgttatggggataagtactgtatgtatttgttgaacagtgatctcagtgatttaccttactcagtgttcctgagcagttagccagtaccatggtgaatatgtcattttcacaaggtctgtgtagttcttgatcctagtaaaatgcccagcagttcttaaatccagcttattattcaagtattttaaagcagtggaacattttatcaaattaagtcatattacatcaaataaaacattgataaaagcagcattttatcaactcagatttataagttcacattgataagatttatttccataaagcctttagagagtataaaatcaatgagaacaatgaacctattttaatgaacagaattttgaaattgggagctgtgaatgacagttttagtcttatatcttcctgaacacctagtttctgtattttgtcttatagtatcaatttcagaaaattctgttctacatagataagtgatactagaatattcttcagttaagcctgtctaaaacttggaagagcaggaaattttggtctcaaagttgaatcacagttgataatgactgtttatatttcttaggtgatacagattttcagtgaataggagtctcagccagtttaaacttgtatagtatgcaggaaaacatgttttttatatatttcaaaacaatatgcagtcttgtccattaaaaaaaaatcttacatcccagtgctctattctatgagatattcattcacagttttaagatgctgtagtcaacattttcaaggcttattttttatttttgaagttttttttgttttgttttgttttgttttgttttgtttgagatgagtcttgctctgtcacccaggctggagtacagtggtgtaatctcggctcactgcaacctccacctcctgggttcaagcagttctctgcctcagcctcccaagtggctgggattacaggcgcccaccaccatgcctaggtaatttttttgtatttttagtagagatggggtttcatcatcttggccaggctggtcttgaactcatgaccttgtgatccacctgcctcggcctcccaaagtgctggaattacagcgtgagccaccgcacccggcctgaagtttgtttcgaagtatttgttcaagtcttttgcctgttgaaaacttgagttctttttctttttcttttctctttgtaggagttttttatataacctacatacaaattctttgtcagatgtgtgttgtatttttcccatgctaggacttcctattcattttcttttgatgagtagagatttctaattttgataacctaatgcaccagtctttcttcttatgcttaatacgttttgtgttactcaacttacttgaagtcagaaaagaagtcagaaaagaagatttaaagcttaaaatacatattagaactattcataaattaagtcacatcatcatgtggcctgtttgcttgtcataccgaattaggctgtgagagtggatttattgagcagatgagcttgagccttccttgacatttaatgagctctagcacacatgcgcatatatatatatatatatgtatatattttaagagacagggtcttgctatgttacctgggctggagtgcaggggttggtcacaggcatgatcataacacaccacagcctctaactcctagcctcaattaatcctgccacttcagcctcttgagtggctgggactgcaggtatgtgccaccatgcctgactggcacacacattatttgtggaaatctttcaattttacataagtagacatctgtaggtctgatttcataaaagatcagcagacccacaaccttcttaaccaaaaatatgtctacaagaaattcaggctgggcgcagtggctcaagcctgtaatcccagcactttgggaggctgaggcagttggatcacgaggtcaggagattgagatcatcctggctaatatggtgaaaccccgtctctactaaaaatacaaaaaattagctgggtgtggtggcatgtgcctgtagtcccagctactgtgggggttgaaacaggagaattgtttgaacccaggaggcggaggttgcagtgagccgagattgtgccactgcactccagcctgggcgacaagagcgagactgtctccaaaaaaaaaaaaaaaagaaagaaagaaattcagagatatacactgaagtgacagagacttattttgactgacagagagtgcttgtggttatcaaatagaagagcagagtggcagggagtggctggtggtatcctttcctatattgaaaataaatggcataccatcagcattattcaatattactcttatggatatagaaccatcgaaattttttttcataaggaaatatattaaatgctttgaagactttgacataaactatacagcctccgagagaattttgattcattaactcagggtgtgtgtgtgtgtgtgtgtgtgtgtatatacacacacatatacgcatatatgtgcatatacatatatacacacgtaatttatgtatgtacattttgttaaggatctgaaactttttttggaaactatatctcaaatttacagaaaacttacaagtagagaacaaaaaacctatatttttatgggccatttgagtaagttgctgtgatcatccccaaataggttatataggacattttcctaataactacaatacaactttttaaattaggatattaacattgatacataataccatctaagcatcagaccctgacattcaggttttgcctgttattccaaaaatgtcctttatagcaaaaggatatagtgcagagtcacatattacattttaactgtcatgtgtccttcaatcttaaatattaatagttccacagtcttaccttcacttcatgagggaattgtgaagattaccagacagctgttttatagaatgtccctcaatttggatttgtctaatgtcttcaatttagattatatatcttgaacaggaatatcacagaagtgatacctcatcctatcagatggtatacaatttcatttggtctttcatttaatgattttcactttaatcctttgattaaggcaatatgtgccaacttctccactgtaaagttacttttcccattgtaatacatattttatatggaggtactttgaaatgatgtaaatatcccagttttcctcaaactttttttttttttttttttttgagacatagtctcgctctgtcgctgaggctggagtgcagtggtgtgatctcggctcactggaacttctgccttcagggtgcaaatgattctcatgtctcagcctcctgagtagcttggattacaggcatgcaccaacccgcccaactaatttttgtatttttagtggagactgggttttgccatattggctaggctggtctggaacccctggcctcaagtgatccgcccaccttggtctcccaaagtgctgggattacaagcatgagccactatgcccggccaataaacttttgatttattcatttgtttatatcagtatggacttatggtacctattttattcaatgggtaaaaatctatggttgtcattattattgatgtacgaattgtcccatgtttggctagtgagaggcccctctgtgtctttttgatgtgttcccatcattctttgaatccttttttacttcctgacaagacaagatgttccaggctcattttgtatttttcctgtcccatctctggaaccagtcctttctccaaggaatcctggttccttttgctgaagaaaagtatttagaagccaatatctcaatgctagttatgttcattgctattgaaatgtcactgctcccatgacatctcagtgaaaaaagctagagaatgtgtgtgggcatgtgtatgtctaggcaaatatatgcatatatatatttacctgcatatacaaacacatttacatttatatttctgtatcagttgtatatgttgaaaaccataagtgtacactggtatctccaattctagtctcataccacagggttaattttggttttctcccttttcctatttgtaatgcctttctcctatggtgagaaacctagaccctgccagtactctaccctgcacagatgccctccttgccccactcaagctccaacacctggaactgaatagtcttcctgtatagataccctccccaccctacttggactctggcatctttgtctgggtagctttttcccaaggtggttgcacaattttacactcctaccaactatgtatgtgggttctagttgctcctcattttcaccatttggtgttttagacattttggtggatgttactggttttaatttgcatttccctgcaattaatctgatgctcatctaatgatgatgagcacgttgtattattggccatttaaacatcttccttatgaagtgcctgttcaaatcttttgcccttttttagttgaattgcttgttttcattattgagttgtagacatattttatatattcctttacaagtttcttgttagatacgggttttacaaatattttctcacagtccatggcttacctatttattttcttaatggtatcaaattgaggaggttcccttctgtttctgatttgctgagagttttaggaatgtgttttgaattttgtcagatgttttctgcatctgttaagatgattggatagctttttgttggggtgatcagacccaacaccaggccatgggggctacaaaatccggaggagtcaaaggaatgagaaaagacaggttaagagagaaagtgggaacagagggccaactctagtatggaggctgcaaaggccccaagctctgggaggccatgctatttattgatgatcaaacaaagaaacaggtggtgaggatgtgggggttgaaaggaagcgatgtatcaagcaaatgagctacagctgtgatggtgtagcattttctttgaaacgtatggctacttgagataatgggtgtgctagaagcaaggagccagcaagtttagacatgttccaaaggccactaggtattttagaccctggaccccagacatattccaaaactcttttatattatgtcagacatgcaagccctgcctcagtttctctcccaacactcagctcttctcccaacatgccccccttttcttttttgtaaaaccgccacagctatcattgcttgttcttgacggcagctttctctccagcggtggcttccgcatctgcagactaaaaggagacagcacaagcacataattattagaacaaaatctgcaagtgtagagcttccaatggccttaatccacttaagaggattgaatgtagacaacccatcggctgtcttgttgaaaataccagttgtagggagcaggttcaagtgagcctgagaggcttcaaaaacctgctattttagttttacaatatcaagggtgagattttcatctctgccctccagatggcatttaagagtaacataacacaactttgaatccaaaaggtcctctttttgtttttgaattaattgagcaaggcaattgcaggctgtgcagctcttaattgcctgttggtgatccagcttcatttttcttagcccttattcaaaatggagtcactctggtttgaatgcctcttacatatttcctctttcccttttacaagaggacccttaattctaagggttgcagaaggatggaggtctgtcttctgtaacttcttcatgctgaataggggtgatgatattcctgcctacctgttagggtctcttgtatttagggtagaagggtagagaggaattcagtcagaaaacattggtccattaagcatctgttgtagctctgaatcccagcaaaaggtaaaatcctggcactccagcagtttctcagcttcctgtgtggttttcttgatctgtcccatgttatgggggttgatgtcagcatgactctggttggtcctcgttccgtcttcgtattcagattgacctggctcatggcttgtactgggggaacccggtccatggttgggatccatgggtccctccagtctcccgctccatggtcatacacaccttgagggcacccacacagttttttcatctcctgcaaaagtacaaacataccctcacccctacattagtaaatctactgaaacagaagcaaaggctttttttttttttttttgctgtagctgggaggcatgccattgctgaagcatttgtaactcagcttctgcctctttggttaattactgcggggtaaaagttaccattggtaatgagaagcaggctttttctgattaacagaaggcatagagaaaccaaatcgaggcttatccttcttgtgcaatagtattgcaaaaaagcaatccttaaaccttcaatttgcactgtacaggtgggtccactagatgctgtggctcatgatagatcttcagatgtttggtgggcacccacacagacacctggttgtcacctggagagacacaagcaaatcgtcttccccatataattatctttcctttttcccagctttttgtatgtgcatccctccatcatatatcttgtccagcctttttattttccttttgtcctgtcagttgttcagctgcagtcgtgggttgatctttttataaatttaaaaactttaatgttaataaagctaaatgcaattgcatttgcagtgtcttatattgctggtcccctcccttttgtatgtgagtttttaaagtaggattagctctttaagcaatgtcagtttgaaaaacttgctgttgaggtcctgcaaattaggcttttccattagtagatccatcagtaaaaacagtaatggctgctccagtgggggctttttgagtaacagaaggcagtatctaggatgttaattatagaaatggaaatatcttagatttaggataataattatcaagaatgccaacaaaaccggccaaattaacttgccattcttgcgaattaatataggcttgttgaatttgttgttttgttaatgaaactataatctgatttggatcatatcccattagctttgttgtgcgcagcctcgcttgtcctactagcacagcaatttgatttaagtacagagtgagcgttttggttgtattgtgaggtagaaaaagccactcaaccagatcatcctgttgaactataaactcctgtaggcaaatgcttagtaggaaaaactaaaaactgtaatggctgtatcagattaattcgttctacttgtgcttgctgaattttttcctcaattgatggaagttcctccaatgcttctttgaacagggagcatttactgttaaggttagaatcaccttgtaaagtagaaaagagatgagacatagtataggtaggcatgcctaaagttggatgaatccaattaatgtctcctaataatttttagaaatcatttaaggtttttaaattatctcttcaaatttgaattttttttttttttaaacggagtctcgctttgtcgcccaggctggagtgcagtggcgtgatctcagctcactgcaagctccgcctcccaggttcacgccattctgttgcctcagcctcctgagtagctgggactacaggcgcccgccaccacacccaacgaatttttttgtatttttagtagaagcggggtttcactgtgttagccaggatggtctccatctcctgacctcatgagccacccgccttggcctcccaaagtgctgggattacaggcatgagtcaccgcacccggccaaatttgaactttttgaggcttaatagcactttgttctaacttcattccttgatattgaaagggagtagaagtttggattttatcgggggctataattaaccctgccgcatttacagccttttctgtttgtagcacatcaattcttccctagtttcagctgcacacaaaatatcatccatgtaatggataatataacatttttttaaactgttctccaactggcttaatagctttcccgacataagtttgacaaatagtcgggctatttaatatgccttgtggcagtactttccaatgatacctgtgcactggtttgttattatttatggcgggaacagtaaaagcaaatttttcataatcttgggcagctaaaggaatggtaaaaaaagcaatcctttagatctatcactataagaggctagtattttggagtcattgttggggagggcagccctggttgtagcttgcccatcggttgaattacagcattaacagccctcaaatctgttagcattctccatttacccgattttttcttaatgacaaatacaggagaattccaaggggagaaagtaggctctgtatgtcccttttgcaattgttcctgcaccagttattttaaagcttccagtttttcctgtttcagtggccattgctccacccaaactggtttggcagttagccaaacaagaggaatgggagccagaggctcaacaatggccactgctaaaaatgatactccaatccagtctgatctgtttgtccttctgaaggttctgattggccatttttgttttttcctagtccttctcctgagcaatatcccatatttttcatcatttgtccactaatatcactatattgatccataggaatagatatttcagcaccccattgttgcaataagtctctaccccataaattgacaggaataggtgtaataataggttggattgtccctgccatcccgcccttgacatggtaaaatcaagggacttgaaaaacttctgaggcagtccctacgccaacgatacccgtggaagtcttttgtctgggcaagtgtcgaggccattgatttaaagcaataaatagagacatcagctccagtatctactagtccttcaaaatcctttctctgaatagttactatacaaataggtcttttatcagacacttgattaacccaatataaagcttttcctgctggattagtactaccaaagcctcctgttctcttcactgtgctgcttcctagttttatgtagggtagcagcaacaactgagcaattcattctcttggggaggcagaccacggagtcgaggaactaataactagttgaatctctctggtatgatcagagtcaattattcccatatgcacagtgacaccttttaaatttagactagaacttccaagtaatagactgactgttcctgagggtaagggtcccctaactcccatggggaccttctttggtggctccctaggaaggagacaggaattgtgctgcagaggtctatggcagcactgtctgctgtggcgggggacagctgtatgtttgttaagggcactggctgtgccggatatgcctcagtttgttgaggggccgaaggcaggcccctcttcctatttcctgaaagaggttgtccatctttgctaaatttagaatggcactgatttgcccagtgattgcctttcttacaccagggacatacaccaggacttttctgttgatggatggtagtggtttttccttttgatttccatttctacattccttttttgtgtgtccaaattgcccacaattaaaccaagagcctgagaaacgggacatattctttcctactttcaatccagccatagccttagctaaaagagtagccttatgtaagttacctccaatgccatcacaagccttaatatattcagctaaatgagccttccctctcaggtgtctaatagcagtttgacactctgcattagcattatcatatgcaagaagctgtattataacatcctgagctgttttatcagttatggctttatatacagccacagcctcttggagccaagcaataaaatcaatatatggttctttaggtccttgtcagacaactgaaagaaggatatttttccccctgtaacatttaccctttcccatgcccataagcacacagagcacagctgaacaatggcaacaccctccattacttcttgattctctaatcgaccccaattagggccaactcccagtaactgttaaaaggaaacaagcacaggtgactgcacttgtgtgttttcccttgcctgagtttgagcttcctcagcccaccatgttttaaactgcaagtactgggacggagtgagaacagattttgttaaagtatcccaatcatatggtattaacctattatcaagagccacatttttcaacaaagttttcacaaaaggagagttcggttcatattgaataatggcttgcttaaattcctttaaaacttaaaaggaagagtggcccaattagctatattctgtccttcttgctgggtttgccatgcttcaaggtctccctcagctctagctttttgaatagaattttgtatagcaccaccaattgctccaggttttaatgttgcaactacaggaggagtaagtttttcagctgattcattttctcacccagtaagggggagagaggaggtggccattcacttaattcagcaggtggagctgatgggctagtaaaacatactttttttagttttcctttcttttctttaatctcctccggtagctgtttctcacactcagaatctgaagttagttttttacactcgtcctcctcttcctcatctgaatctgcctcatcatcgtttgaaatggctcaggagctacctttattagtgcccacactgaccaaatggaaactggaatttttgctctgtctttatacacctttttaaaatctcttcccgttgtctcccattcatccaactccatagtcccttgttccggaaaccatgggcaaaactgctttactgtactaaagagtgataacaaattctgagtactaactttcactcccctttgtaataaatgccttaagaaattcaaataagcaaaatgtttgctttaacttcatcccattgttaccctggttcttccaagcgctcagcttcctcaccgagcttctttcagtcgtccctgggtgtcctctgacgatgcatcctccgctttcacatgctctagcgttccttcactgtggtctttgtcgccccatgttgggtgccatgaatattggggtgatcagacccaacaccaggccatgggggctacaaagtccggcggagtcaaaggaatgagaaaagatgaaagaaagtgggaccagggggccaacgctagtatggaggttgcaaaggccccaagctctggaagcccacactatttattggtgatcaaacaaagaaacaggtggtgaggatgtgggggttgaaaggaagtggtatatcaagcaaatgagctacagctatgatggtgtagcattttctttgaaacatatggctacttgagataaggggagtgctagaagcaaggagccagcaagtttagacatgttccaaaggccactggtgcctaccggggccgtcctgacacatctattcttaggtatagaatttcaggtatagttccccccagcacttttaagttccattgtcttctggtcttcattgtttctaatgagagctcagccattatttgtattgttcctttgtatgttttttgttgttgctttcaagattttatctttatcgtagatctttagaagtttgattatgataggccgggtgtggtgcctcatgcctgtaacccagcactttgggaggccgaggtgggcagatcaccaggtcaggagatcgagaccatcctggattacacggtgaaaccccgtctctactgaaaatacaaaaaattagccgggcatggtggcaggcgcctgtagtcccagctactcaggaggctgaggcaggagaatggcatgaacccaggaggtggagcttgcagtgagccgagattgcaccactgcattccagcctgggtgacagagcgagacaccttctcaaaaaaaaaaaaaaaaaaaaaaaaaagggggtttgattatggtatacctaggggtgtgtctttttgtatttaacctgcttcagatagcaagcttcttaaatctataaatgtatgccttttaccacatttgggacgttttatgttactattttttctgcttcatttttttttcctcacttttgttctgggactctagttacacatgttttagatatcttgatgttctttcccagattgctggagttctgttgattctttttcctcttttttttccctactctatagcttggatcatttcttttggtccattttcagggtcactgactcttgtataattttaatatgcttttaaacctatccagggactttcttattctaggctttatattttttagtttgagatttgcatttagttgtttttaaaatttttatttctctaatttcttatctgtttgaccattacagatattttactttacatccttgcgcataggtatagtacctactttaaaatccttgtgtgctaattccaaaatctggatcatttcaggactggtctcctaggctcaagcgatccacctatcttggcctctcaaagtgctggggttacaggtgtgaaccactgcacctggcctgagtgaatattttaccactttataatattatgcattgttcatttagaaaataatggtttactgagttatgaagatcttccaaatgttgacacatttgtcgatataaaaagtcacattcagccctcctccctcctcactcgtgggccgggcctggcatggtatggcatcaccacagatggtgctgaggcacagcatggggcggctggggctcctgctgctgccgccacagcagctggggctgctgctggcggctctgacttctctgctgctcccagagtccgcagctgcaggcaggtctgaagctcgtgggagtcccggcaaagctgacagtgtcccaggggcagctggtaaagctcagctgcagcatggaggggatggaggagcctgacatccagtgggtgaaggatgggtctgtggtccagaactggttcatcccagtcagcgagcagcactggatcggcttcctcagcctgaagtcagtggagcgctctgacacgggccagtactggtgcaaggtggatgggggcgaaacccagatctcccagccagtgtggctcacggtagtaggtgtgccacttttcacagtggagccaaaagatctggcagtgccacccaatgcccctttccaactgtcttgcaaggctgtgggtccccctgaacctgttaccattgtctggtggagaggaactacgaagatcgggggacctgctccctctccatttgttttaaatgtaacaggggtgacccagagcacccatgttttcctgtgaagttcacagcctaaaatgcctggcctcttctcgcatagccactgttctccttcaagcactgcctgcagtccccttcaacatcaccgtgacaaagctttccagcggcaacactagtgtggcctggatgccaggtgctgatggccgagccctgctgcagtcctgtacagttcaggtgacacaggccccaggaggctgggaagtcctggctgttgtggtccttgtgcccccctttacctgcctgctccgggacctggtgcctgccaccagctacagcctcagggtgtgctgtgccaatgctttggggccctctccttatgctgactgggtgccctttcagaccaagggtctagccccagccagcgctccccaaaacctccatgccatccacacagattcaggcctcatcttggagtgggaagaagtgatccccgagggccctttggaaggccccctgggaccctataaactgtcctgggtttaagacaatggaacccaggatgagctgacaatggaggggaccagggccaatttgacaggctgggatccccaaaagggcctgatcgtacgtgtgtgtgtctccagtgcagttggctgtggaccctggagtcagccactggtggtctcttctcatgaccatgcaggccagaagggccctcctcacagccgcacatcctgggtacctgtggtccttggtgtgctaacggccctggtgacggctgctgccctggccctcatcttgcttcaaaagagaccgaaagagacgtggtttgggcaaggctttgacagtgtcatttcccggggagagccagccattcacttctgggcagcccggtccttcaatcaagaaaggcccaagtgcatcgaggccacattggaaagcttgggcatcaacagcgaactaaaggaaaaactggaggatgtgctcatcccagagcagcagttcaccctggctggatatagggcaaaggagagtttggttcagtgcggtaggcccagctgaagcaggaggatggctcctttgtgaaagtggctatgaagatgctgaaagctgatctcattgcctcaagtgacattgaagagttcctcaggaaagcagcttgcatgaaggagtttgaccatccacatgtggccaaacttgttggggtaagcctctgagcctctggagcagggctaaaggctgtcaccccatccccgtggtcatcttgcccttcatgaagcatggggacctgcacgccttcctgctcacctcctggcttggggagaacccctttaccctgatccggttcatggtggacattgcctgcagcatggagtacctgagctctcggaacttcatccaccgagacctggccgctcggaactgcatgctggcaggggacatgaccgtgtgtgtggctgactttggactctcctggaagatctacagcggggctactattgttagggctgtgcctccaaattgcccgtcaagtggctggccctggagagcctggctgacaacctgtatactgtgcacagtgatgtgtgggccttcggggtgaccatgtgggagatcatgacacgtgggcagacaccatacgctggcatcgaaaacactgagatttacaactacctcattggcgggaatcacctgaaacagcttccagagtgtatggaggacgttcttacactcccactccatccaagccaaggtctccttaggccttcagacgaccttttgtatgatctcatgtaccagtgctggagtgctgaccccaagcagcgcccaagctttacttgtctgcgaatggaactggagaacattctgggccagctgtctgtgctatccgccagccaggaccccttatacatcaacatcgagagagccaaggagcccactgtgggaggcagcctggagctgcctagcggggatcagccctacagtggatctggggatggcagtggcatggggacagtgggtggcactcccagtgaatgttgatacatcctcacccctggagggctggctgagcagccagggcaggcagagcaccagccagagagtcccctcaatgagacacagaggcttttgctgctgcagcaagggctactgccacacaatagctgttagctcacaggcagagggcatcagggcaatttggctggctctgatggccactgtgctggctgacaaagccctgtctgacctcagcccagacagcaaggtgtggaggctcctgtggtagtcctcccaagctgtgctgggaagcctggactgaccaaatcacccaatcccagttcctcctgcaaccactctgtggccagcctggcatcagtttaggccttggcttaatggaagtgggccagtcctggttgtctgaacccagacagctggcaggagcagagtgattatgtttccatggttaccatgggtgtggatggcagtggggggtccaggtccagccctgtaggctctaccgtcccgctgagctgctcctgctgcttaagtgcatgcattgggctgcctccagcctgagggcccagctgttaccaccctcggggtttaaatatccaggtttgcccctccaagtcacaaagagatgttcttgtaatattcccttttaggtaagggttggtaaggggtgggtatctcaggtctgaatcttcatcacttttctgattccgtaccctgtctaggccaggagaagttgaggggaggatgcttccctgcagctgaccgggtcacacaaaggaatgctggagcacccaggctataaggtgtccctcttccaaaggcagcgtgctgagccagcaagaggaaggggtgctatgaggcttgcccaagagcgagtgaggctggagaggagttcaggagcccctctccatgcccacaatctgagcatgctaccaaatttcaaaatatctttatttatttatttatttattattatactttaagttttagggtacatgtgcacaatgtgcaatttagttacatatgtatacatgtgccatgctggtgtgctgcacccgttaactcgtcatttagcattaggtatatctcctaatgctaaccctccccccctccccccaccccacaacggtccccacagtgtgatgttccccttcctgtgtccatgtgttctcattgtttgattcccacctatgagtgagaacatgcgttgtttggtttttttgtccttgcgataatttactgagaatgatgatttccaatttcatccatgtccctacaaaggacatgaactcatcattttttatggctgcatagtattccatggtgtatatgtgccacattttcttaatccagtctatcattgttggacatttgggttggttccaagtcttttctattgtgaatagtgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacattgtaaaagtgttcctctttctccacatcctctccagcacctgttgtttcctgactttttaatgattgccattctaactggtgtgaggtggtatctcattgtggttttgatttgcatttctctgatggccagtgatgatgagcattttttcatgtgtcttttggctgcataaatgtcttcttttgagaagttctgttccgaacagacacttctcaaaatatcttaagactaacaaaggcagctgtgtctgagcccaacccttctaaatggtgaactttagtgccaacttcccctctaactggacagccttttctgtcccaagtctccagagagaaatcaggcctgatgagggggagtccctggaacctgggccccagccttggtgggggaacctctggaatgcatggggcgggtcctaactgttagggacatttccaagctgttagttgctgtttaaaacaaataaaattgaagacttaaaaaagaaagtcacgttcgttaatataggcatgcatcacttaacaatagggatatattctgagaaatgtgtcattaggcgattttgttattgtgtaagcatcatagagtgtacttacacaaacctagatggcatagtctactaaacacctaggctatatggggtagcctattgctgctaggctacaaacctgtatagtatgttactgtactcaatactgtagacaattgtaaaatagtatttgtgtatctaaacataaaaagttaatatgttgtgctatgatgttacaatgtctatgacatcactgaggtgataggaatttttcagattcattataattttatgggaccacccttatatatgcagtgtaatgttgaccaaaaactgttgttatgtggtgcatcactcatcttgttcatcttgttagaagaatcttcaaagctcatagtcatcggtacaagtgttttagaattttgattttcacttaaaagttcaaattttgtccttgataagaaatactatcagttgttatctcagaattgatgaggtcactttattcacagtaagatatctgcgaaaaatgcaaatgcctgtcagattttctttgaagtaaaaattgtgtttcatgaaaaaagtacctggttcagcttgcaactcaaactattaaacaagtgctttccctcgagacaacccattgtactttggtatgaagtggaagtgctttctacattcttcacagtttgtcacacagaatattaaatatacatgtaatccaaggtcaagatttaataaggttaatatttttttttttttttttttttccttgagacggagtctcactcttattgcccaggctggagtgcagtggcaccatcttggctcactgcaacctccacctcccgggttcaagtgattctggtgcctcagcctcctgagtagctgggattacaggtgtgaaccactatgcctggctaatttttgtatttttagtggagataaggtttcaccatgttggccaggctgatctcaaactcctgaccttaagtgatccacctgccttggcctcccaaagtgctgggattacaggtgtgagccaccgtgctctgccaaggttaataattcttactgctttatcaaggaccttaggtgaaagtggctttaaaaaaaaaaaacaacaaaaaactgtgagtatgtggccatgaagaatgcagtgagtttggtgccactgacttgaaactaccactaaggcagtgttacccaccatcattttcacatcatcagtgcaaatgtcaatttggtttttccagaataaaccatgggattccaaaaagctatttaaccttttgagtatttcatcaccacttgtgttcattgccaaggattcatgtaaaaatattcttcagtgattccttgatatcaatactggacaatagaagtaaagcaggaaacacagtcatgtctacagacttgtcaggcaaaagtataattttgcagatgaaatattatcttcatattcatgtttacagctaaatattttattcagcaagttacgtaccactggaatgtgacagtgccatgatttgttttcctgatttttcaaagcaggaattcagcaatgtcacctttattagtctctcagcaactatacttctctaaccaatgaaatatgataacttaagattcttcagtgactttttcttttctagcttgaaaagctaaaataacagcttttggctcttaaactcatgtcatttatgttaaaataaaatccagtttagttttctctcaactctgaatgtttgttttgaaaatagtcatcacttcctttgcataagatagagtaaggtaaattattagcatctgtaaacctaagagaaagataactttttcatatatttatttcacacagtattttttagagtatatttctcttttccataagttagagaactctgttatcggtttcatctttttcagcatctttagacatggttgttgctgcagtgggttgagaaagttagtcttctctatttcagtataaatattatcaaaatagaatagttttagagaaatttaaaaatgaataaaagtttaaaaaaatgtaaatgttattgccatgtaagacaacagtgtatttcttgtgtttccttgcaggcacaaggaaacctttagtatttcaaacattggtttattgaacaataatgaaattatagaaattatagcagttttaactgtaagaacacacactgctgtactgtcctgagaacaaactaagttaatccctatatacacacaaatttatacctaaaatcaactaccttaaaaacttttaggaaacataaaaatacagatgcatacattctattagccatcagagtgatggtttctttaaaagtcttggcacctctgggaaactccattgcgcactgtgagagaatgaaagaaaaaaacggtaaataacatcttagtattactatgaaaataggtttgactttgcagaatccctgaaagggtcttggggctctcggggttatcctgaccatattttgagaattgctggttgtctaatagttttgtaatatattgtacagacactgaatacgttgtagagattatggattctgttatattcctattaagaatattaactttgtgttttagcaggcagttaacttggctgaactcaaattccagactcaatctccttatgttcagttcttttagtcttagcctggcagcctagagctcacctcatacatgcctaatgcgggggtcagccagagttttgagtggagtgtatgtacagagtttgtggttctccctctgtggttctctccttctggaatttttccctcactttccagctggtttggcagtcacgaatactgtcttttgtgtgtttcctcaaccaaaaagactgcaggtttctatccagagtatctcctttcggattggcttttatccctgtggggaatctgcaaatgccccaagggaggaaatggagatatatgctgggctcatttcaatgtgcctccctcccttacaggattctgcctccttcagtgctgcctgcctaagttgatctccattgtacttaaacagttgctatctgtgttttaaccagattttgtagttgttctcagcaggaggattggtctgatacaagctattcccttagggccataagccaagagtcctgaggcccagaattgaatgcattacttcacttgtgctctgactagtgcagagttggattattatctccctaaataatattttaattaatgctacttaataatgcattaggtttttggcagccatatcctactgttggcaagaattacacttgtggccatccaaaatctctcccctcccccacttgaattgcctgctattaaaccacgtctcctttgtctaggaataattcagtatttctttgtttttaaagctgaacgcagtattttcatttattcttatttaatttgggtctgttttctctaccattgaagcctcttgaatcttttaaagcttgatttcgttttctactttcctttcaactttatattgtttgaaaatcctctcattttttgccactttgaatagctatggaaagcatcatcagcactgctctttctgatgatcaatagtaataagttccctacttcataaagtaaggggacacaaagtctgatttggttatcctcacaaaataatattttattaatttgaaaaaaatatgtaatactcaaaggatgccgtgaattttgttatttttttaaatgcttttttgggtcattcacaataatttacatatgaatatgaaagattatggaacaattcctagtatgcttatggattcatgctctctgcaagaattcagacccagtgataggaaaacactagtcagttcatagcttactattgtaacaaagacttcttctcctctttattttttattttgaaatgatttcagacttacgaaaagttgaaaattaaaagcagtacagctgagcaccgtggtgtacgtctgtagtcccggctattcaggagactgaggtgggaggattgcttgaggccagcagttagagactgtagtacactatgatcatacctatcaacagccactgcactccagcttgcataatgcagcaagaccccatctctttaaaaaaaaaaaaaaaaaaaagtactctgtgtgtgtgtgtgtatacacatacattttttctgaactagttgatagtaacatttatagccctttacccctaaagacctcagtatgtatttcctaagaatagaaatattctcttatataaccaaaacacatttatataccatatcccaattttgtcagttcatattctgattccaattttttattttctaatggaatactccagttttatcagttagcctaatacagaatccactttagggccaagtattgcgtttagttgtcatctctttagtcttaagttatatggttgtggtaagggatggttcttggttcttatttagtctcagtcttaggcagatcctctgcacttgggcctcagagtgaggctttctcagtgttcttgcccctgccccctgcatctctacctatggcagccaaagtctgctttatctgtagtgatggtagcagtttgagtcatcctgagaaaattcaggtgaaagataaaggctagaaagataggctgaaacgaggtgagagtgtgtaaataaaaattctggctgtgtgaggtggctcatgcctataatcccagcactggaggctgagttgtagaatgtacaataagtttacctgtgaagtagaaggaaacccaggagttcaagggtgcagtgagccgtagttgtgacgctacactccagcctgggtgacagagtgagaccctgtctctaattatataaaaataaagtcaccttaataaaaaagattctatatggtcctgtccatttgctagatgtgggctgcaaatttggtttttagaagccaattcatattgggaaacaagatcagtgccctgaggtacagtgtcccaacgtaaaaacaaactaatggcacatgggaagtatcatttggcctggtatcaagatcagagagagagatatatcccttgagtccttataaagaaggctctattgattgacatcctcaacaatacctttactgtaaataagacagtggtttcataggactgcgtttttaataatgtccctcagtgtacactaattgcctaatattaagtgcattttcgtgagaggcagaaattatgtgatttcgtatctgctgttcaggcttattctagggtagtgactagtgatctagttgtagaacccttcttcaaaggaaattttatcaggaagccccatgtataatatgggaaaaagtggagttgaagtggggtggtatatctagagtgctactagctcagctctcgccctttctcattttcctgagacagtctgtactacacctgtgcggaatgactagcgccctgagcacattatcagaactactgtccagagaaaattgttgaattgcatagccccagatctctacaaatgtgtctatgggaactgaattctgatttttgtcgtctattagtatttcaactactttattttaaattgtcaccccttttaaaaccccttatttagtatcattatcttactctcagaaactgaccattccttctacttcacaagtaaacttactgtactttctacataagcaaagcaatacaaacaaaaatccagcttatctacatgtggataaaaaaagagggcctccctttttaattttgctaatatgtctgcttttcctctggaccccatcattttgtaccttctttgagacagtgttccattagttaccccatcctccgagtcagagtctctcctctattggccccttttctatagtcttaaaaagaaaaccctttatctgcccagcagcttcttttcctcattacctactgcccctttcacctctcttgctaggctaagcttgaaaatgtagcttatattcgctgtattccttttccttcccattcttttctttttatttaaaagtttatatataaatttatgaaaatataaatatatatacaatttacatagaaataataaacactaatgttttcatccctgaatttaagaaacaatattacagtactgttgaaaacccttgtgtactcttcctttaatacacattttttcctcccctcaaaagtaaccattactggctgggcatggtgggtggctcacacctgtaatcccagcactttgggaggctgcagcaggaggatcatgtgagctcaggaatttgggaccaggctgggcaacatagcgagacctcctttctactttaaaaaaaaaaaaaatttagttgggtgtggtggcatgtagctgtagtcccagctactcaggaggctgaggtgggaggatcacttgagccagggagatcaaggctgcagtgagctatgattgtgccactgcactccagcctgatcaacagagcaagaaaaaaaaggaaaaaagtagccattatcctaaatttgattactattgtttcaagacatttcatttttactttactacatatctacagatccctaagcagtatatagctgagatttttcaatatgaatatgatgaatgatttagaggcataccagatgttgatcctctcagcctttggaacagtggattttatgaccagccttgttcgtgtaccatacaaatgttatcttctgtgtgccatggtataaaaaagttggggagcactgatatataatattattgtgtatatttttgaaattatcattagtaatgtcctatatatgttctttatctttttttcaatccatcttacatttgtgaggttcatctttgttaatgcaggtagcatttttttcatttgtatttcatttatgtatggtattctattatatgaatttatcacactttacctattttcttattaatggttgtttatttaagtagttataatttcttgcttacaaataatgttaccatgaagattattaataatgtttacttgtatgttagtgttttactagagaaatatgccttggggtgaaattgctaattgtagagaatctagctttaccagattttgacaaattgttttccaaagtggttattccagcttatatttaccaacagttttaacagctctctgaactttgcttatttacagttttaaaaaaacttttgcagttcttgagataggcggtagttctgaagatgggtggtgatggttgcataacaaggtaactgtacttagtgtcccagaactatatattttaaaatgattactgggccgggcatggtggctcacacctgtaatcccagcactttgggaggccgaggcgggcggatcacaaggtcaggagattgagaccatcttggctaacacagtgaaaccccgtctctactaaaaataccaaaaattagctgggcgtggtggcgggcgcctgtagtcccagctactcgggaggctgaggcaggagaatggcatgaacccgggaggcggagcttgcagtgagccgagatcgcgccactgcactccagcctgggcgacagaacgagactccatctaaaaaaaaaaaaaaaaaaaaaaaaattaccatggactgggcgtggtggttcacgcctgtaatcccagcactttgggaggccgaggtgcaaggatcacctgaggttgggagttcaagagcagcctgaccaacacggagaaaccccatctctactaaaaatacaaaattagccaggcgtggcggcacatgcctgtaatcctagttacttgggaggctaaggcaggagaatcatttgaacctgggaggtggaggttgtggtgagccaagatcacgccattgcactccagcctgggcaacaagagagaaactccgtctcaaaaaaaaaaaaaaaattactatggtaaattttatgttatatatattttagcacaattttaaaaaagctttgctggcctgatgggaatgaaatctcactgtgctttttatctgcttttctgtgattactagtgagatatctttacatatgcggaatatccatttatggtttttttccctttgaatatttaatgttaataccatttgctcatttttctattaagttatctttttcttactgattcttggaattttttttttttattttttgagacagggtctcactgtgttgcccaggctggagtggagtggtgcaatctcggctcactgcagcctctacctcctgggttcaaacaattctcccacctcagcctcctgagtagctgggactacaggtgccctccaccatacctggctaatttttgtatattttttgtggagatggggtttcaccatgttggccaggctgattcttggaagttctttatgtattctggatacacatcttttgttggttatgtgtgttgcatacattttctttcatttatgtctgtcttttccattttaaaaaataataccttttgatagagcattaattttaatgtggttcaacttatttttttcctttttgatatgtattttttgtgtcttatttaagaaatcattcctaagttagggttgtaaagatattcacctgtatttttttctaaaagttttaaaaattttgtccttcacattttggtttataattataatctacttgatttgatttttatgtttaatgtgaagtgagtattccattttccccccatgtagttaatcaggtacctcagcaccatttattacacattccctctctcctccactaatgcacagcatcatcttttacatatcaagtttatatgtatgcaggggtctatttctgggccatctattctgtcccattggccagttgtttattactgtacccctactacacttaagctttataataaagttatctggttgggcagtatctcccttctcagttctccaaaatgtttttagctgttggttccctgcgttactttacagttttagaattcatttgttaagcttcacagttgaaatattgatcggaaatgtaggtataactcattatccagatgtagactattactaaaattgtatagatactaaagcttcagagaactcagacctatattttattatcttaatagggagaattaataactggttcacagtctattcaaaacctcaaataattttccctcaattacaaaatcttaaaacacttttataagaatcccagttcatgtaaaaatctgcattatgcatgtaaaacaccagttacttaacacttattacactcattatttggtatgtttttggacagaatagtgtggaaactgtacagtatcagttatttcttctacactgctccaaacacgtaccataatgtaaataagcaatgagaaaatatgttaaagatacatgatgaatgcaaataactcttagtgaataaccaagaccacgtaaaaaaaaatgtactgattaaagagttgcctgagttagatttggtggtgagaagtgggagaaggggctgttatcatggttgcggttcagtggtgagtcaaaatgtatggaaagattctagcaaaggagcttactattggatcctaagaagtgatggacagttttctccactcctgaggtccagaaatagatggctgtgaaccattgtctgcagtcttagatgaaaaaaaatctaaaaaaatgtatgtctccttgtgttccttttgctcgtggttatagaatgtgagcataagatatggtcctgtcaggaaaatagctgagatacagctgctgagtagactggatggtctctcttagattcataagcaccttaaatgtgcactcctacaaatccttgatagttgtttttttaaatttgaatagtgactcctgggtttaaaaagtacatattgtaacaaatactcagatagcgaaaattcttcaagtgaggaacattggatgtatagattaatttggaaagagtcaaaatctttgcaacatttgatcttctatctgtgaccatgattttatttctccacttgtttaggcagtttcataatttttgttataaaagtatgtagatatataggaatgcaattgatatttatatactgctcttactaatttatctgtagattttcttggatgttgtacatacacagacatatcttctgggaataatgaataatgaaattttgcttcatctttttatttaattttcttttcttttttttttttgagacggagtcttggctccgtagcccaggctggagtgcagtggcatgatctcggctcactgcaagctccacctcccgggttcatgccattctcctgcctcagcctcccgagtagctgggactacaggtgcctgccaccacgcccggctaattttttttgtatttttagtagagacaggatttcaccatgttagccagaatggtctcaatctcctgacctcgtgatctgcctgcctcagcctcccaaagtgctgggattacaggtgtgagccaccgtgcccaaccaattttcttttcttattgtgttagctgtggcattgttgaacggaagtggtgaggataaacatccttgtccttcatttcaaggaaattactccattgtttcaccataggtattatgttggctgtctgtttttagtggataccctttatcagattttaaaaagttccctacaataggcagtgtcatagaatagttaagaatccagactttctagccaggttgccaggattcagcccttggtgttgccacttgctggctgtgtgactttggacaaatcacttaacccctctgtagcacagttttctcaactatacaatggtgataataataattcatacttcatactgtagtattaaagattaaatgattttaaagattaatatgtaaaacaggcttaaatgagttaatatttatataacacttaaaaactgtgcctggtatatagtaagtgctgtgtattagccatttttacagtactgtcataaatccttgttttctaagagattttgttttattttgttttgaaattatgaacaggtattgaattcttatttctttacctgaggtttgacacacttactggattttgttagcacattaatatttgttgaacttaatagagtctcagatttacgctacaactagcatttaatttctatggccttttaaaggttggcgtatttggtggtagtttccatttaatacttatttctagattgccttctattagcttttttgatggtgctgaccttaccttcctaaccacctgaacatataagcatattgcaattattaaagaatctgttttctaatgccagggaaatgtgttcttacgcttagtgcaacttcttagtgggagtagattattttgtgtatattttggtattttactaacagaccaactgtccattcataatggtgagactaagtgaatagaagtcagtttaaagttaccaggtgaataagcagtttttgaaaaatgtatcaagataataaattttgtttctgggttctcttttgaaaattcactattgttgaaaagtctgtgtaggaacaaactttatagacttacttgtatacagctaggactgaatttatgggctgcctttctaacttgctaaaaagctgaagattgacagctgctttcatagtgctttatctagcttggcttttaactccaagagaactgtgttcacaaattgatgctctgttcctttggggttggtatagaagcattaaattgtactaaaatattcatatgtgagtgcatttagctgaaagcaattgatgttttgttcccaagaggacagagagaaatgctgtatggacctgtactccagaaaaaaccctaagcatgcttcttaaaggtaattacatggcctggattatcaaagcccatacagtgaagtttaaaacgacaaagaagaagttgtagaatttataaactgtggtttgtatatataaattatttggttgtacaatagttaaaaacttaattgccaaaaaactaggagttttaattatatctttggtttgtcttctcagctaatttttactagactgattgctctaaacatttattccagaggtccaatatcagtgaagttctttatccattatcattttattatataaagttaaaaattgtaagtttcagagagtgttgaattcctttttacatatatatggtaactgtttaaaagcatgccaccaataatgataaattgacatgtcttgtagatagtgaatctaatttaacagctgacatgaaaatcaataagagtagacagcagtctttgtcgtagctgtgttggtgtggtaacttgaaagaaataaaactattctaaatttctattcttattctatgtaattttgttttttttttttcctataaaaaccaatgtattttctcatatagtttcaggtatgataaatgggcacatgaatgtcaaagaacatgagacactttactagaaaatgttgattcaatggataattggtcatttagcatatgtaattcagtactgtgttcacctcaaggccaaagatacaagcactgaggtgtagagaagaagagtttaataacatcgtttaactatatattaatattaaccaaacttagtctgaaaggaaatttgggaaatagtatttgagacaggagggtatactccacttccttaaagtgagattattttagaggatcttaggttgtatagtaaatttatttttaactggcattactattttccatattacaagctctactccaattcttacaattttagaaggtgcttaaatgagtttttcataagtctttggtctgaacttcacaactcagatagctttctcttaaataaacattttgagggctggatgtggtggctcacgcctgtaatcccagaactttgggaggctgaggcgggcaaatcacccgaggttggcagttcgagaccagcctgaccaacatggagaaactccatttctcctaaaaatacaaaattagctgggagtggtggcacatgctgtaatcccagctacttgggaggctgaggcacgagaattgcttgaacctgggaggcagaggttgcggtgagctgagatcgcaccatcgcactccagcctgggcaacaagagtgaaactctgtctcaaaaaaactaataataataacaataataataataattttgagaacggttttggattttaagaaaaaaactttgttttttttttgtttgtttgtttttgtttttttgagacagagtcttgctctgtcgctcaggccagagtgcagcagcatgatctgggctcactgcaacctctgcctcccaggttcaagtgattcccctgccttagcctacctagtagctgggattgcaggtgtgtaccaccacgcccggctaattgttgtatttttagcagaggcggggtttcgccacgttggccaggctggtctcaaactcctgacctcgttgtgatccacccgcctcggcctcccaaagtgctaggattactggcgtgagctactgcgcctggcctgaatttaaagtaaaattttgaagacagtacagtgaatttctataaatcctatacctggttttccttattatttttaatgtaaataatttttaataattaccacaagattctagaatgaagttttttaaacatgggaaattctgtgatggtttctgtcaaggtttctagtgattttttttattgtggtaaaatataaaatttgccgttttaacgattttttttctttttcttttcttttttttttgagatggagtctcactctactgcccaggccggagtgcagtggtgccatctcgggttcaagcaattctcctgcctcagcctcccaagtagctgagactacaggcatgtgccaccaagcctaactaatttttgaattttcatagaaacagtgtttcaccatgttgacagtctggtcttgaactcctggcctgaagtgatccacccaccttgtcctcccaaagtgctgggattataagtgtgaagcaccacacccagttgttttaacgatttttaagtgtacaatttaatgacttcaaccacattcacaacgtgcagccatcactactctatttctgaaagttttcatcaccccaaatagaaatcctgtacccattaagcaataacttattacgttctaccttggccccttgtaattgctaatctatttctgtctctatgaatttgcctattctagatatttcataaagttgaatcaaacaatatttgtccttttatgatggcttttttcatttagcacattttcacatttcatcatattgtatcatgtatcagaacttaattcctttttatggtccagtcatctgtaaacattttgcttatccattcatctgtcaatgggtacttaggttgttttatttcaccttttagctatagtgaataatgctgctatgaacattcacatgcaagtatctgtttgagtccctcttgtcagttcttttgaatatatacttaggattggaattgctgagacatatggtagttctatgtgtaactttttgaggaaccttcaaattggtttcctctggttgctttgtagctctcataaacttcttgacatagaagttatgattaaatgtcaagaaaagctatgtgtaagcaatggccagctcttagtgatttgggaaaggaggcagtttggtgaatggaaagaatactacttggaagtcaggagacctaggtttgggtggcagctctgtttcccagggccttgatttttatcattgatgaaataaagagatcgcatagataatttcaaaggttccttacaactccaaaattctacgtagaaatgtataatttagcatgttttgacttggatcaattaaagaactttgctgataaaaaattttgatagttggccaggcgaagtggctcacgcctgtaatcccagcactttgggaggccaaggcggggggatcccgaggtcaagagatcgagaccatcctcaccaacatggtgaaaccttgtctctactaaaaatacaaaaattagccgggcgtggtggcgcacacctgtagtcccagctactcagcaggctgaagcatgagactcacttgaacccaggaggcggaggttgcagtgagccgagatcgtgccattgcactccagcctggcgacagagcgagactccatctcaaaaaaaaaaaatttgatagtcaaataaacttttttttttttttttttttttttgagatggagtctcactctgtcgcccaggctggagtgcagtggtgtgatcttggctcactgccagctctgcctcccgggttcatgccattctcctgcctcagcctcccgagtagctgggacttacaggggcccgccccccatgcctggctaatttttgtattttttagtagagacagagtttcaccgtgttggccaggatggtctggatctcctgacctcgtgatccgcctgcctcagcctcccaaagtgcttggattacaagtgtgagccactgcgcccagccaaataaactttttttgagacagggtctcactctattagctaagctggagtggagtggtgccatcacatctcactgcagcttcaacctcctgggctcaagtgatcctcctgcttcagcctcccaagtagctgggatcacagatgtgtcccaccacacccagctaatttgttttttattttttgtagagatggggtcttgctgtgttgcctaggctggtctcaaactcctggcctcaagcgatcctcccacctcgacctcccaaagtgctaggattacaggcatgagccactgcacccagccttcaaataaagtttttatttgacctgctaaaatgcaaagctttgtaatagacttgattacatgttcaagtattttgatatcatagacacaaatatttcaatgtaaattaactgtctgaatagttttaggtaagtatataataatatacttggcttttcataatttcaggtacacttaaagtgtattttcccacaatggaaaatctctgaactggtatagaagcaaattaggtaaatgcaaagcatttaattataaaattgttaaatataaaaattatatttaatttattattattaatatttttagaggtggggtcttattctgttgctcaggctggagtatggcaacatgagaccatagttcactgcagcctcaaatttctggactcaagaaatcctcctgcctcagcttcccaagtagttgggattatagacgtgagccactgagcacagctgaagttatatttgaatgtgaaactattctcttaagaaaaaaaaaacttgtttcaggtcctatacatcttgcataattgaaatctacaattagaaaacattgaaaggccaagggttgaaatttcactttttttctgatttacatttaaatttttgaattgtgtttcacaatatagttaatgtccttgttttaaaaaaattcttttaactttgtagttgagcaactgggttattaaatttacattttgaacaaaaaatgtgacgtacataatgaagtgtgtgctagtgatatacatcccacctgctctggacatattagactagatgtgaagaagacatttgcttagttccctatatgtcctgggagaaaaggtaggctgattaaaagaatatggaggagcttatatctaagaatgaatttgaatttaagatttcaaagaatctttgactacatattctatcactaaaaagaaccaagtccatctactgagccatggaatctccattcatgtgaaaaatcttcagaggctagataagggcccctgcttttcttccaaatgcattttctggctttgcctctagacatttccctttagcagttatttggaaccagatattgacttcactgaaagccagatcaaaatctttagctggaaagtattaattttcagtgcaggttacataaattaaaagaaagaaacatcatcaacaacaacaacaaaaataatttcggagccttgcctcttttgtgagtcagtctccttgaagggcttccagctggtgcatgtgtgtggtgggtgtgcattagaggctttctaattgacatgcaagtggttgatagagcaataaatctaaacagtgtagcttgtcattattcatgataaggagacacagagctaatgtacaaactgatacttttagcaacatggagtaaaagctaatgttagctaaaattgacaatactttttttttttttttttaatatgtacaaacttcagttggctcttcaccaggtctcatcttgttttagggatctttctctaagataaatatactttgtggacttttaacagactggtgacttcagctaaagcatattaccaatacagtaataatattgagtcatatgtggtatagaaaaagtgctgaatttagaatcaacctaggttaagaagcctgccttttgagagtagaatggtggcttccaggggctgggaggtgggggaaatggggagatgttggtcaaaggatacaaaatttgttatgctggatgaataaattctggggatctattgtacagaatggtgactatagttaataagagtggattgtatacttaagatttgctaagagagtaaattttaagtgttctcaccacaaaaagtaattgtgatgtgatagatatgttaattagcctgattgtggtaattatttcataatgtttacctatatcaaaacatcacattgtatactttaaatatatataatttttatgtgtcaaatatacctcagtaaagctggggagggagaacctgccttttactaggtgtgtataattttggacaactcagcaagcctgcctgagactctgctttctcttctataaaataggaatcatttctaccctatagagttgttgtcatagttaaatgaggtcgtgtgtataaagtacagcatagttactggcgtaacatagacagtacatatagctgtgatgactagtgtgttgtcttgaattctaataaaacaggagctaatcttagtaaaggggtgttgtctcatggatgggatataatttcagcttcaaaccaagagtatgggtaaaatcttcccttcatgtgaaactcagtttagccagaatcccacctgagaatttcataatacgggcagagagctgtttgagaaaagagccacagatagttgtgctttgagttttggggcctcttccaaaaagagaagagacttaaacaggatttggcaaacaaaggaaatagtttggccttttaaatgagcagcaggatgaaatatagcaatattaatgcacaggaggctccaataattagaaaatatagtttggttaatctacttcccaaagacacattcattatttgctatgataaattcatttaactcctaacctggcatttgttatgtatatgtatattatgttttatctataacagttgctgtttaaggttatggctgtgtagtctattgagaaaagaaggttgagaaagcatttgccattctgtataactcttgtcctgattgaggcagtcttaggggtattgtttttttgagcacataacattggatctctgaattctagatagaaccacttacatgatgtgtttaaatttttatttatttaaagaaatgtaagttttcatgttccttccctacctctatctagaaaggaacacttttggcagaaaagtttaaaacttgattttttaagagaggaaacaatattggcatggtatttctgctctgaatgctccagatttaaccaccctactcatattcgtatttcatataaacaaaaagtaaacatttaaatctctccattctactgtgtttaaagtaaagcagatctgaagttgctgcaggcagaatactgttccaattccagaaaaacatgaatttatgattttatatcataaactcacataatttcaacttcatatgtattatatttttaatatgatcaacttgatatgtcttagtacttgcatctgggatatgtatccttgcacaaagattgtgttagaaatctgtaaagaaatcatcccaacttcctaggcaagcactggctaggaagctgggcagaaattctaactgtatggtcagtactaaatgcaaagaagaaactaacagctgtcaaagaaaatttttcccagtacactcccctggaagaattgtatcaagttagtaacaactttcttgactatagatatatagatagtaatagttaccattttaaagtgaaatttttgacagttggctgtctccttttctgtttagaactataacattaaaaatgccttctagtttagagatttgatgatcattttagaaataatagcattatagaaatattttgagtactttatgtgcatcttattttcatcatcacaacaatcctattagctgcaggtatttgtctccattttacacataacagcagttgagcctttgagagattgaataatttgctcaagaatgcagattggtaagtgggagagtcaggatctgaacccagctcttatttatttaactgtaatgattgaataatgtagtagtttcttttacctcctcattttcaactttcttgagttgagatctgagcttactaattttccatcatccttgttttctaatatgtgtttgaggttataaatccttctaagtatcggccaggcatggtggctcatgcctgtaatcccagcactttgggaggccgaggtgggtggatcacctgaggtcaggaattcgagaccagcctggccaacatggcaaaaccccatctctactaagagtacaaaaattagccgggcgaggtggcacgttcctgtaatcccagctactcaggaggctgaggcacgaaaatcgcttgaacccaggaggcagaggttgcagcgagccaagatcgtgccactgcactccagcctgggcagcagagtgagactctgtctcaaaatcaatcagtctttctaaataccactctagctgcatcccacatgttctgatatacccttccttttttggtgttttgttccatgtatttttaaatttccattttaatttttttgactcacatatttcagatacttttaaaatcttttttagaactgtgagtttttgaggaaatatttttcaggtccatctagagttttaagaactaaatataagttactggagaacaaaatttgatagagagttgctttttcagagtataaactgatcatgttaaaccagtagttttcatctgcttttggttttcctataatgggccacaccacctgaaatttgatagatttttgtcatctatttgtgactctctatattggctactcttgtttaatgttgctgcctctaatgctaatcttcagctctgccacactgctgactttcctttttggttcacgttcccattgagcataatagaacctgtaaatggtcttgttctgagccaacagaagcaacacagacacataagacaatgccattctgtctttagatctgttgtcagaccatagtccacggttccctagtggagtttacaagaaggctctttagtttgttctatgattattttggatttgtgctgcccagtatgataacctctaagccacatgtgattattgggtacttgaaatatagttagtctgacctgagattacattattaaaaattaattttacctgtttatttttactttaatgtggccactagaaaatttaacattaaatatgtggcttacaagatatataagtatagatgtatcgaataactctgtttggggcttaacagtgatgagcgaaaatgcaatgtagcagaggacagttttccccttagcttctacatgaaattctggaaaagcagagctcagataatacatcttagaattccaggtttgggcacgtgttttgggtaaagcaggagtgatgttagtatatacttactttctgaagaaagcagccaaaaacctaatcatccaccagagaacactagccatgttgaatccacaggttggttagatttctgtaaaagtctgaagatttcattccaatcatccctctaattctcagacatgcagttttatcattaagccaggaccattaaaacctgctttaaaagcttgttttgtctaaaggacttaagggagcaggaacagatggggatagatggcaaaagtgggcccctgtttgtcagaaggtaaagatattgtcccctaatctgttttctgctcctaacggcttttccacttctcagtggcaggtaggaaagtgaggggctgatgagagactgtagctctatcacacctcttttccattttcctttattggattacagatttttgtgaccttgccgtaacctgtaattgttagactgtgagcttcttgaggacagggcacagagaattagtcatctttatattacctgtaaggtacagtaagaatatcaacaacagtaaaatcagttacccagtgctgctcaactctttcctattatggtacacttagacagttagaatatttgtaccacaggggattctggccacccagtacttcaagtccacacaactcttttgtacaaattataaagtactggtgtctcaagttactttactgccatctgttggaaagttattgtaataaaaatgcagggctatagtgactgttaagagtggtgccctccttcagagttattcagtgtgcagcctgctcagctgtacatggtagtcctgaggctacctcaggagcccacctggccacctagtgggctgagaaaatcaatatttgaataaacctcaacccgtgagtgacacatcaatgtgtcttgggaaatctgatactatgctaaggacgagcctcaacagtaaccctataaagcaggagttcttataattccagtgttttggatgagcagtctgaggcatagagaggttacatgaatggcccatggtcatgcagctatcagatggcagaggtgggatttgaatggaggcaatgaggctacagagcctaggttcttaaccacagtgatacggtaaacctgttaaaccgcatcagatgcaacagtttctcagtcctgctgccctttctatctcagcccactgtaactagtttagacctcagcccctgagttctttgaatgagtctataggttttggcaaaggaagaggtatttgtgcttttttctgccagtacttgtttgtgttaaggttaagtgctatcccttctctatatttcagaataagctctggtcctcttcccatcctgtggctttacttctccgcacagcccctattcttggcatcacagagtgatcaactcagactgctatcagccacctggggttgatccattctcttctaaattctcactcttctagattctaaagccacgaggcctatctctaggactctccctccttctttctgtttctgttggttcctttaatccccaccgtcccccaccacgccttgtataacccttaattgctgtactccctggcaacatctctcactttctctccaaatggtcttactatctgatttagaaggaaagtgcctcagggaagggattgtcttgttatgttgtgaagcagcatctgaagtgccccataaattagcatctgtagagagttttgtgtatactaattattattattattgaaatacaaaaatgctttctgaaccatgaggaattagactaagatattagtctaattgcctgtacatgttttttaaaaaggagggaaaaagcctctcttcctgagagagctatcagagcctcagagcagccgccaaaatccctatacttgttctgggttattgtttcagtgcttttatgtttattcagaggaccatgtttgcaagacagtaaaataaagtcctgttggtcatgtggatccatttggaccatttattgtgatcagaaaggtagaaatggccctggagcaactgccttcagtttgttttggcccagaatctcttatttccttagtgacacttatggttaaagtcaatggaattcatttttggggacacagggggttttaagtaatttcatttatattatgtttatgtttactgccagagtgaatcaacatttttattagcattttataatgcacatggagcttttaagacttgaatttgctgtagacatgtatgacagaaagactcgtttacaggactactggtcttttccaatgcttgctttgagaatatacctaaaagagtggtgtctagctaaatagcttgctttaaaaatctttatgttagaatttgtttgccgggtttttctgaatatgaatgttagtatattttgattaacagtttaacaaatgtccctttatgaatgaaatgctagtcagaataaactgaggtgaccttaaaattacctattgaaggctgggcgccgtggctcatgccagtaatcccagcactttgggaggccgaggtgggtggatcacaaggtcaggagttcgagaccagcctggccaacatagtgaaaccccatctctactaaaaatacaaaaattagctgggtggggtggcatacacctgtagtcccagctgctcgggaggccgaggcgggagaatcgcttgaacctgggaggtggaggttgcagtgagccaagactgtgccattgcactccagcctgggtgacagagtgagactccatctcaaaaaaaaaaaaaaaaaaaaaagcctattgaattacttctaaatcttaaatagaaagtagtggaagaagtttactacttatgcaagtgtccatgtctgagagacagtatgatgtcagggcctccttgcattgtccgactatgtagggtcacaattgacacactggatacattgaaggtagaatcacagagcatgcaattgctttttatcctcatccatactttctgcagcattcctccccaccctaagacacagtcttattacgccaaattgttcttgtcttcaggcttttggtaactatagaacaagttgattcaaaaaacaagctcatctcatttttagatgattaactcactttggggactagattgtttccttttccaggttacatggtgctgctctaggagcagttggacactttatgcttgtaaagatcagggagtactgcagggggctagacagttgtcagattcaggctgccaaagagctgagggatcacttattgtagtggttctccagctctggctatacatcagagtatcctggggagctttctttacaagcaccagtgctggaggtgtacctcttctgtttacaattggaaaaagtgagcccctgagaggtgaattgacttgtatgtggccatatacaattaggtgctatgaaaaatcatgacattaggaggtaataacattattttcagatcctagttgaaatgctctcttattttggattgagcaattgttaaatgagatcataagcagtgcagaaaacaaggtgggaccaccttgacactgtcattggcttttgaagtatctgccctgtaataaaagtaagtataacagaaccaccttcagtgccttccacatattattcatattgaggagagactttactgtcagttgtgacaaaaccttagtgtcagtctggttacatggtagttatacctcctacccaggccaggacttgtttgttcagtttttctgtgggaaaaggttttcaagtgaagctttaatcatacctggtaaacagaatgaagcaggtaagctcttctaattaagcacttattaaagtgcttaaagtttttcataatggaagtgtgtttttattttcaaacaaaggcactgtaaaaattttagataaggagacagaacagtgtcagtcatcattccctttgtaattattgagggcagaggggcaggaagaggtacaaatatcatcaacatttaccaaaaaactgtggtatggaggcctttttgttaggctctggaaacacaaaggttcagcccatacctttgagaagtttgttattttttattcagagagaatgtgtgtgtgtgtgtgtgtatgtgtacgtgtgtgtgtttaaaatctcttgatagtaatttgtatttctggtttttctaaatacaaagtttaataaacatatcctaattaccattttaacaaatatccttttgtgataaggcgaacaactaagccaaacaactaagtcaaaaattattttaatatatttgagtatatgtgtttatatgttaatatacaatgtgtgtatgttgttaatttttaatgggtatgtacagcatgtatgggttgtgcagtgattttcaagtgagtgccacagatgaaaaatgctacctcacaggtaattgtgagattgagacacttgatgtaaaatgcttaacactgtgtctggcacatagtaaatgttcagtaatcctcattatccacatatttattttactaccattgctataggaattcataggaaaaagagaactgtaggttaaggagatcagagaaaaagaaaagcataatttaagcaatacattttgcctctattttatttaacatatcttttgcctaagacttaaattgctaacagcaaacactttggaaagtattatataatataaatacatattaataatgtgacctcttttatttcaggaactttatattgctgttggaatatctggagccatccaacatttagctgggatgaaagacagcaaggtaattgtacatcagtgatgttaaaagaaaacgtttccacattttaggatttggcttaccttgtatgtttccatgtagttacaatgcatgtagtcaagccattcacactaacgtagatctgggaactgaaagaaataaaagctaccgttcactgccttaaaaattattggtcacagaggcagtgctgtgtcatggaaagaggcctgaacctgagttatagctccactgctaacttaatgcatgatgagtgctgtctgcaaactcagtttctttgtctactaaatagtgggtattgaatgatgatcactaagttgcccttcagctatcacaatctgtggatagaaaatatcagacttaaacaatttgatgaggttctgaacgtgtaacttatttttgaggttttgatccctgattctctctctgtctgcttcactttggtcctgtaaccctcacaatctcatatatcagcagggccccacttcttgggttgttatcaaagtataaccaacacattttgggttggagcatcaggccatcttaatatctcagtatctcagtaattatcaaaagtgcaataagtatggggccgggcgcggtggctcacgcctgtaatcccagcactttgggaggccgaggccagcggatcatgaggtcaggagatcgagaccattctggctaacacggtgaaaccccgtctctactaaaaatacaaaaaaaattagccaggcatgatggcgagcgcctgtagtcccagctactcgagaggctgaggcaggagaatggcgtgaaccgggaggcggagcttgcagtgagccgaggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaagtgcaataagtagaggaaggaaacacttgatttttatttatttatttatttttttgagacaagagtctcgctctgtcacccaggctgaagtcgcccaggctggagtgcagtggcctgatctcggctcactgctagctccgcctcccgcgttcacgccattctcctgcctcagcctcccaaagtgctgggattactggcataagccaccgcgcccggccaggaaacacttgattttaacttgctacttggactactctgaaagtcctgtgtaatgattctgaacatatatttcagaatatgacacattaattcatgcataataatatatagtttgaattatgaacttacctttcatgaagtcagagatgcctctgacattcctgcatttatccattcagatggaagcttgatataaaagattataaaacttttaacaggcttaacttcttctaatttgaaatgcatgcactacctctttgtagcttctaaatgaactggcccaaaaccagtcagattttacagttggatggtaggtttctttactgaactatgaaaacagcagtgccaatggggaaaatgtgattgctgcattaagaaaaaataaataaataaaagaaagaaactccaacaccagcagccttaaagtatatttttagccagaccagttcagacatagctagaattctgcttctctaaaaataaaagattctgcctgtcaagaagataccagtgaaaattctcaccccatgccaacagggctggattgtgggagagacactaggtagtgtacgtcagagcaaatagggaacagttgaagtaaggagactggtgttgggggtcagccaagactttgtatctccatctagtcaacagatgtttattaagaccattccttgtactagaagctgggaatgcttaaaaagatatagcccttgttgtcactgtcttatcctgttgtctgtgtcgtcctgtgttgtcatagccccattatctgcataggagacagtctttagttctaaaatgggatattagaatggtttaaatctgacagttgcattccctgcaagctgcaattttaattagaatcctggtttagttgaaggaattcaagatttgattgttaaatcaaatgaatctaatgaaagcactttctgaactaatacacagtaatatggttgaggccacgtgcaatcccagcactttgggaggccgaggcgggcagatcacctgaggtcaggagatcgagaccatcctggctaacacgatgaaaccccatctctactaaaaatacaaaaaattagctgggcatggtggcgggcgcctgtggtcccagctacttgggaggctgaggcagaagaatggcgtgaatccaggaggcggaggctgcagtgagccgagatcgcgccactgcagtccagccagggtgacagaacgagactccatctaaaaaaaaaaaaaaaaaaaaaagtaataataataatatggttgaatacaatctatgcatttcaaagcttagtaaggaggaagaacttgagcttgtgaggagctattgagagagctttggatacaagcaagactttatcatagttctttacaattgattatttaggaatattattttaataatctgaagaacaataaccagccccacatcttttttgttaaatactgtagtggttccttgcccacagttatatgctctctctttaaaaataacttttaaggcaggcatagtggcactgtaatcccaaggcactgtaatcccagcgctttgggaggccaaggcaggaggatcacttgagtccaggagttggagagtggcctgggcaacacagtgagaaccccatctctccaaaaaatgaaagaattatctgagcatggtggtacacccctgtggtcccagctactcaggaggctgaggtgggaggatcacttgagcccaggagatcaaggcttctgtgagctgattgtaccactgcactccagcctgagcaacacaatgagaccctgtctcaaagtaataatgataataacaattgttatatagtataatgaaaaagctttcggatgattaaactcccagatgtctgactaagtggcctctagaagaataatttaccatcaataactaaacaaatctctgcttatcgccgtgaagcaggttacacattcccaaaagagaaacacgccaatgcaaatcaacacctgcaattcagaatgtttgttcttgtgcctttggatttgaggctcacgtttgaaacttgtttattgtctctgactatgcatcttaatgtgtgtagcatgtttctctggattagcagttacctggactataccatgttccaatcttagacattctggcatcttctgcacatctctctgaggaacccctctaagggaaatacacagatgttggatatcctgtagcctgtattttaagtcaggctacatcaaaatacttaatgtattttttaataccagctgttttcacaacatacaatgccaggtaggtagaaacttaattttacttctagagatttgaattatttttagtccacaatctattaaaataatactacattagagtctaactgcagtggtgttagaagcatctgtggggaataccaaactatttgtactgataaactatctgatattaataaaagaatgatttgaatgatagcttttcctttttttttttttgagacagagtctcactctgtcacccatgctaacatacggtgcacaatcttggctcactgcaacctccacctcccagagttgagcgattctcctgtctgagcctcccaaacagctgggagtacaggtgcgcaccaccacacctggctaatttttgtgtgtttagtagaggtggggtttcaccatattggccaggctggtctcgaactcctgacctcaagtgatccgcctgcctcagcctctcaaagtgctgggattacaggcataagcttttattttttattgtagagatggggtctccctgtgttgcgcaggctggtcttgaacgcctgggctgaagtgatcctcccacttccacctcccaaagtgctgggattataggtatgagttaccatgcctggcctgcatttaagaatatttttatagcaaataagagaaatgtttgacagcttttataagagatataagtaatttgcttcttttattaatctatttgctatgtacataaggacttaaagctgtttaacgtcccttactaacaggctgacaagatactttagctttcatattgttagaatatcccagaataattgttttattttattctattgtattttattttatttatttatttatttttgagacggagtctcactctgtcgcccaggctggaatgcagtggcgcgatctcggctcactgcaacctccgcctcctgggttcacgccattctcctgcctcagcctcccgagtagcttggactacagatgcccgccaccacgcccggctaattttttgtgttttttagtagagacggggtttcaccgtgttagccaggatggtcttgatctcctgaccttgtgatctgcccacctcggcctctcaaagtgctgggattacaggcgtgagccaccgtgcccggcctatttatttatttttatttttgttgagacagagtctcactgctggagtgcagtggcgtgatctctgctcactgcaacctctgcctcccaggttcaagtgagtctcctgcctcagtctcccaagtagttgggattacaggcacatgccaccatgcctggctaatgtttgtatttttagtagagacaggttttaccctgttggccaggctagtctcgaactcctgacctcaggtgattcacccgtcttggcctcccaaagtgctgggattacaggtatgagccactgtgcctgtcctccagaataataattttaaaataataaatgaaggacaaaataatttgcactacaaaggctgtggatttgggtatagatttgttactttttcacctaaaatcaaatattttttttgtaagtcaaaagaagaacttttaaaaaataatgattttaaactctttaatactgagatgggctagatgtgggtaagagagaattttattacattccaacctggaaatttctaataaatttacagtgttgacacagatgcctcaaatcttatttggtagacattttaagaatattaatatattggaagttaaaatagaactatcagtctgtgtgaaatgttttcttggtaaaagtcaaactctttgtttttatttcacagacaattgtggcaattaataaagacccagaagctccaattttccaagtggcagattatggaatagttgcagatttatttaaggtaagctggccttgagagaaattgctattatctagattgtcatccgagaaactctcagaaatggttagggatgaagctattaaaagaaaacattgtgtgtttgtgtgtctgtgtttgtatgtatactgttaatatatgtacacaattttgacctacttaaagttaagttgctctaagagtagatatgtgttgtttatatagagcattataactttccttttaagaaagagtccaaattgtctttaaaatatccacatggcggccgggcgtggtggctcacacctgtaatcccagcactttgggaggcggaggcgggcggatcatgaggtcaggagatcgagaccatcctggctaacacagtgaaaccccgtctctactaaaaaatacaaaaaattagctgggcgtggtggcaggcgcctgtagtcccagctactcgggaggctgaggcaggagaatagtgtgaacccaggaggcggagcttgcagtgagcagagatcgtgccactacactccagcctgggtgacagagtgagagactctgtctcaaaaacaaaacaaaacaaaaaaaacccacatggtttttggcatctcatgtgctaagttaatgcacaatgtgaagtgattcaagtaatttataacctggaatcatatttggcaggtaccctaaagaaattaacatcaaacccccttattcagggatttgccaagaatgctagagcttttcaggggagagtaggcacccatatccagcttatctgtctcaataggaatgctctgcttgctgtgtttgtgggttaatggccttccttagctgacgagtgtagggagagcacttatttctcactcctcacactcttcacttttgagtgttccttctctcttgccgtcacctccatatttgaccttcccatgagaaaaattactttcatgatattaattagtgaattacaggtgatgagcacctgatactcatttggctacatttaaaggtcatgactcatgcgtggcctggtctcttctttttcctgggtctgcctacacgtttctaggttatcttatgcagaaatcacttatgcaggaattgacactctgaaaatagcatccaaccctaggagaagtgggtttgctggggtgaggaacccctcatgtagaaccacagcgaggggctatgggccttagtggagaggcttcagcctgagaacagagctacaggtggttccctcagcaagaggactggcccatttctgtgacttcaccagcactgcatatgatctagaggaacctagtgagtgtgcttggagagtacatttgtactttgaagtatgttcatgctcagtgaaggatggaaataggacccttgagccgattactccgtgatggctcagactgcatgcaaagactaggatggggctcttgctctggctcagtgttgggcatacttcccctcagaaggcccccgccaaagagcttagattttggcttgggaaaaacattacccctcttcagtaaccctgaagctctgtatttggtatttgggattcaggtaggtcagctgctcatgttgcctggcccaagtgtgtaagaacaaacagtaatgccagtcattttcccactaagatgttccagtgggaaggggggctggtatgaaaaagagaatttttttttctctgtgtaatgataactttgttcacgtagtaagaattcagttcttactattggtgtgaatagggggtaaatattatttttatttaaaagcaaaattaaatactttctgaacctcatccatgtttgcaagtagatgtctactgtggttgccttttttcctcaagagaatattttaataaacttgtaagtaattttgttacatttttctgtctgcctgtgtactatgtattaaaactcacatgggggctttcatgataaaaagataaactgttaagcagttggaaattttcagtgttcttccagtggacacctgccttggggcaggagcttctttgtagtcattattgatagaatggggtcacacacattgtgctcctgcattaagggcagctccaaggtttggcatgagactatgcatgtgtgtggacacggaggtttctcagtgagaaagagtcctaagacagtgaagtggaacgaggccttaaaaatcatctagtcagctgacttccagtttcaggttctcaggctccttttggtattttaggaagcccacattggactagagagagacttcagaccaagatatcatgtttatgttcttttagctagaattgtgttaaggcaatgactatctcctacagcttagaagttctgaagtacatggccaggagcggtggctcacacctgcaatcccagcactttgggaggccgaggcgggtggatcacccgagctcaggagtttgagaccagcctgggcaagatggtgaaaccctgtctctactaaaactgtgaaaaacacattagccgagcatggtgatgcatgcctgtaatcccagctacttgagaggctggggcacaagaatcacttgagcctgggaggcagaggttacagtgagccaagatggtgccagtggactccagcctaggcaacagagcaagactctgtctcaaaaaaaaaaaaaaaaaaagttctgaagtacagttatatatgtatttgattaatacaaaagtagagaagttaatcactccttaaaaaatgcagtttgggaggccaggcacaatggcttatgcctgtaatcccagtactttggaaggccgaggaaaggcggatcacttgagtccaggagtaggagaccagcctgagcaacatggtgaaaccccatctctacaaaaaatacaaaaattagctgggtctggtgacgtgtgcctgtggtcccagctacttgggagactgaggtaggaggttcacgtgggcccaggagattgagacttcagtgagccatgattacaccactgcacttcagcctgggcagcagagtaagaccctgtctcaaaaaaaaaaaaaattcagtttgggggaaaaaaactaaagattataaaaatattaaacatatggcagactcctctttgttaccatgtgagtaacacaagccaggtgcattctttttaagttgcctgtcccagagagatgtgatttgggacaatccacaggttatgggcacaactaagccagggtcctgcttctgttccccttctctctcatttctctgcctctctggctcagcaggtactacagctgggtggctcaccactactattgtaccttggataaggtgcagtaaaaatcgcacctttgacagactctaggaacctacagagtacgcatgaagttgttttctcagctgaaatcagaatgagcttattgtaggtgaatactgtagtaattctgacacaagagcacagacaaagtggtttggtgaatatattccttactggggcgatctcgtttttaaaaaatcaaatatttaaaatattttaaaaatcaaatatttaatacttttgattaaaaaataaaaaatacaatatttgtataattatatttcttaatgttatatattttatatttttaatattttatttttattttttgtattttatgtattgtaattatattttaaaattataattttaaaaaatatatttatataacattaagaaacatataaggtaatatctttatataacattaagaaatacaattaattatacaaattatgggtgagaattaattagcattacctattttggcttatgatctaaagaaaatagaagtcaaataatagcgtacagaaaggacttttttagcctaatttttgtgtgaaaattttaaattgcaaattgtatcatgtataacatgtatatacagctgttagactaataattccctaggtgatattttgctcaccaagtagaaccgtatctggagtaaaaatgaatatgcataacattttattctcttatattaattgttttgcttgacccttcaacaatcattagttataaaggacaagtttgtttttccctcagaaataatatgttatagtaattaagagctttaattccaattctgccttggccacatactagttaaattatcttggctaagttatttaatctctggacatcagcttgcttgtaagtaatgtaaatattacactacctctttaaaggttgtaatgaagattaaatgagattatactgtacctaatactaatagagtctgtgacaaatattagcctgcctgttctgtccaggtacatagtaggtgctggtaaatattataattgtagtcacagtgatagggcatagggcaccacctgttttttgtttgttttagtataacagctttactgagatataattcacgtaccataaaactcaccatttaaaaatgtacaattcagtgggttttagtattttcacagttacacaaccactatcacacatttcatcatgccaaaaagaattccatacctgtcagcattcactccctgttttacattctgcatctccagcccccagccccagctcctggcaaccactaatctactttctgtttctatacattggccagtcctggatgtttcatataaattgaattatgtaatatgtgatctttgtgattggcttctctcagttagcataaggttttcaaagttcatccatgttatagcctgtgttagtactttgtttctttttcttgccaaataatatccattgtaggggtatgtaacattttgttcattcatttatcatttgatggacatgttgggtttttcccctttttggctattatgaatgatgctgctatgaacattcacatatgaggttttgtgcagacctatgttttcatttcttttggatggatgtctaggaatggaattgctgggtcacctggtaactctgagtttaacattttgaataaccgtcaggttgttttcaaagtggctgcccccttttacattcccaccaaaaatttgtgagggctccagtttttctatatactcattaatgtatgttattgtctgtctttttaaatatagcccttctaatgagtgtgaggtggtatctcattgtggttttgatttgtatttccctgatggcaaatgacatttagtatcttttcatctgcttattggccatttgtatattttgtttggagaaagtttatttagatcctttgtaatttttaaatcacattatctttttgttcttgagttgttagtgttctttatatattatggatataagtccctttttgaatatttgatttgcaaatagtttctcccattgtgtgggttgtcttttcactttcttaatggtgtcctttaaagcatgaaagttttaaattttgtcaatgcctatgaaaaagggggagaaaaagttttaaaataaagttttaaattttgatgaaatccagcttaccaattttttctttgttgcttatgcttgaagtctcatatctaaaaaaccattgccagccaggcatggtgactcacacctgtaatcccagcactgggaggccaaggtgggtggatcactcgatgtcacgagttcgagaccagcctggccaacaaggcgaaaccccatctctaccaaaaaatacaaaaattagctaggcatggtggcacgcacctatagccccagctactcgggaggctgagatggaagaatcatttgaacttgggaggaggcagaagttgcagtgagccaagatcatgccactgcactccagcctgggcaaaagagaacccatctcagaaaaaaaacaaaaaacagaaacccattgcctaatctatagtgtagtgaacattggcctacaagtatctgctcaagcccctgctttcagttcttttgggtatataactaggagtagaattgctggatcatatgataattctgtgtttagctttttgaagaaccttcaaactgctttccatagaagttgcatgattttacgtttccaccagcagtacacaagggttccagtttttccacatcctcagtaacacttgttattttctgttttttaattctagtcatcctagtaggtgtgaagtggtgtctcattgtgactttgatttgcgttttcctaataactagtgatgttaagcacataagcatatgaaaagatgttcattggccactcgtatatctcttttagggaagtgtttatccacctcttttgcccattttcagttgggctgtttctctttttgttgacttgtgtgaattctttacatattctggatactaaacacttatcagagatatgatttccaaacgttttctctcattctgtaggttagcttttcaccttcttgagaatatcctttgatgtgcaagagttttagattttgatgaagtccaatttatctttttttttattttgttgcttgtgcttttggcatcatatctaagaatccattgccaaatattgggtcatgaagattcacccctgttttcttataagagttttatggttttagctcatatatttaggttgttgatccattttgagttaatttttgtatatggtgtgaggtaggagtccaacttcattctttggcatgtgattatccagttgtcccagcaccatctatctgttcaaagagactattctgttcccattgaatgaacttggcaaactacttatctttctaaaccttcttttgtttcctcttctcccctgtagtcactacaatctctttactatctctggaacctgcagttgtttatctctgtctgtgcctcattttttgcctagaatccttttcttctttagtttgatgttctgaattttcctaatccacactgatcttcctcagaactcctgaatttggagcttttaatgctattctcttctccttctcctacattccagtataagctgaggacacttctgattgggtggttcataggcctctctgtctatgcttgccaactaggaggcagaactcctctgtcactcccacagtgacagagagcttctctgtttcccttagtactacctggaggaagtactaagtgaatgagtgaaacatacttgtactgtgatttatatcagtaggttgtctttttttaaaaaaacttaagtgacttttattgggtcttactgagtagggagctgcctctgcaatatctaaaagagaacagaaacaagaatccagatctttcagtgtgctcaggccatcagacactcaatgaacctgagttagcatttcctttttcctaaataaggcatcatgtggtatgctttaaaggtgtgcagttgggctgggtgcagtggctcacgcctgtaatcccagcactttgggagcctgaggtgggtggatcacctgaggtcaggaggttgagaccaacttgaccaacttggtgaaaccccatctctactaaaaatacaaaaaaaattagccgggtgtggtggtgagtgcctgtaatcacagctacttgggaggctgaggcaggagaattgcttgaacctgggagacggagcttgcagtgagctgagactgcgccattgcactccagcctgggcaacaagagcaaaactctgtcttggaaaagaaaaaaaaagtgtgtggttgatctaataaaaaaagacagatgatagagaaaatcctctcaaccctttcatggggagtgtggtaaggatatattcggtaaaattttaaaaagttatatattctaaaccaaattagtgtttcacttcgtggtaaaagtagttgggctttatcttatttttcatgaaatatacaggtcccgtgtgaaactcagttagcatgtcatctgtgtgactggcatgagctcatggtctctccactgaggaaagctgggagaagtggtgccagcacttaatgccacccctgagcaaatgcctgctggctccatggtaaacatgggccttttaataggctggagacagtgacattcggaagaaacaacatgtcgacaatttccttaataaattttgtacgaacacattatttccacctaatggaaatgtagctctcttaaataattgagaggctgtattcatcagtggtgagttcagctggaatctttgtgagctaaggcagccgaaagccccttggaagactgggtaattgatactttgcacaagtggctggaccagttttcagagtatctgtgtgacattccctgcagcccccttggacagctctcctctgtccaagcagtcacaaagcagctctacactggaagctccagttgcagccactgcactgccacgactaagggttagtaattaatcctttttaaaatgggagccaactcaggccatttccccttgctgtggtttcttactgtgtctgctgaccggccactgcattagcacacaaggtcttgattttaataaagagtgatgatattgaatgttcagcatgtagcacatttctgtgtgccagatgatagtagcatgctgctgaaaaagcaaccaatatgtttgtgaaatgaacaatgaatgaatgaacgaacagtgagagaacaagtataaaggaggttggcaggagtcataattgcagtaagctagagactttggtgtggacttggaaggaaagtcaggaatgcagttaagggtgggaagaatgccaagcaaaacatgaaggtaaatacacagtactcttcacccagacaagaaaaattgggcttcctgtttctagggtgccttcttgaaatttgtggttgggtcacaaagccaaaaggtagcagtgtgtgcagtggttcacgcctgtaatctcaacactttgggaggctgaggcaggcagatcacttgagcccaggagttcgagactagcctgggcaacatgacgataccccatctctacaagaattagacaggttggtggctacttgggaggctgaggtgggaggagtgattgaccccaggaggtagatgctgcagtgagccataattgtaccactgcactgcagcctgggtgacagagtgagagcctgtctcaaaaaaaaaaaaaaaaaaaaaaaggcaaaaggcacctaggcaatgagtgggctgtaagccctgtcagccctgggtcctgggtagtcgccctgggtgggaagagagactaccggagaacagggggttcctggtggagaggagggggccctcgtgcctcaacagtgatttgtgttgtttcttttggcctccctgtaatgcttacggagctgtgaccatatcacagtgaaggctctagttgcttaattactttttgtttttatttgcaggtagttcctgaaatgactgagatattgaagaaaaaatgaatcaggatcatgccttaaaaagaaaacttttgttaaagtattccactgaaatcacagatatttgtgggtattataacaatcattggaaagcatggagagctacatttcataatttgagggaaaatttctaacagatgccagaatgcttgtttatgggattgctgtgtttccttttaattatttgtggttccaaacaattattgtttgaactttttaaattctgtactaaaatctataataaagcttttccacagctttaaaact

SEQ ID NO: 36019 - DNA, 25203 bp, Homo sapiens
ctaccagccgcaggcagaggttaggggtagctgatgtttgcacccgaggaggctttgctaagaaacatccccttagtcataccacacccaagtataattgatctaggagtttatctaaaatagtagctcctaagagacttggaaagtgtgctaatttcttcgaaatttctttagaataattcacattcttccccatatcgcttatggagccgtcctaactgctgaccttttcaagatggcggtccgcgggcgacactctcgggctcgcgcacctccccaagatggcggcgcccgaggcctggcgcgcccggagttgctggttctgtgaggtagcggcggcaacgaccatggaggccacgtcccgggaggcggcgccagcgaagagctcggcctcgggccccaacgctccccccgccctgttcgagctgtgcgggcgggcggtgagcgcccatatgggggttctggagagcggggtgtggggtaagtcgcggggtgaggggctacctctggctaagagcaaggggcggcccagcggccggggggcgcggggggcgaggccgggaggcccggggcaaggcccagcctggggcgctgaaagccagctcgtaggatcggagaatgaattttgtgactgacagggctggacagagtaaagacggagacctaaatgggcaggctgacccgcaccgcggcctggctcgggggcgcggggggcgaggccaggaggcccggtctggagcgaagcaggctgggcccgggcgactgaggctggattgcggctgtgggccgcgcgaactgacactcggctgggccgggcaggagagtctcggatgtcgaaccggtgggcagcgatggcccggctgccctagggcaggggccgaggttaggaggcccggcctaaggcaaggccaggccaggcccggggccaccgaacctgactgatggccccggggctccagcatctgcctgacacgccacgggggtcgagattccggaggccaagccgatgggcggaggggaggacagcagattggagagcgagggaatggggcagggggagaggccgaacgaaagggtcggggcgccgcggcctgtctgacggcccagggctgacgggagcgaaccgacaaccggggtctcgggtgccaaactgactaagcgaccgagcgaccgtgcgacccgcaggacagggagcgccggaggccactcggatcggctcgagcggcgaggagggaccggagagcgagtggaggggggcccggagcggcttaaacaagcgagggaggctcgaatgacggacaggcgggaagggccaaggaggccccaagcggggcgacggcccggggatcccggactgccgggctgccgtggcagggggcgcggcgccgccaagaggccttgggctgaatgggagtgaacgggggccccaggcctgaaggcggccgggaccaaagggccgggcctggatggagggcggcctggggcgccgggatgaacggccggggagggcgaaccggccagttgggctgggaggcggggctgtgggttggggaccgctggccgcggcctggccgctgacgagggaaacttgggtccgacgtggggcaagtgaaagaggggaaagtgaggctctgccaagcaggcctagccgcgctggggacaggggaggcctcgggcctgagaggctgctggctctgtgagggtggggtcgggaggccggggttggagttgggcgaagaggtggcaggcccggccgaggcctgctggggaggggggcaggagagcaggccccgggcctggaagcggcgcgggggaggttccaccaggaggccttgcgggtggccgtggcgtctttgcaggaggaaggccctggtcaggacaggagtgaggactttgaggactcgaggttgcagggcgcggagtttgagttatgccatgaggagggggtgtggggaaaaggccctggagtttggggggactgaagctccgggataagctggagggtggtcggggaggcccttggctgtgggagtggagcccagtaccatgaggcctgagtgtcctgcatagtggtggtggaagaggcttttagaagtcggccggtgtgcggaggggacagtggaggccccaggccagccagcggctgagaagacaaggggcaggccgacccatggggaacaggaggaaaggctccgtagagctgagcagggagctcagaaaagtcctagggcatggggaagaaggcagagagggtctggcttttccgcctggagcttctgggatgctaagactggctaaaaaggaagatgactgggtgcggaggcccaggttgggaagcagcagcattaaaggtgcaggctagaaagaagcaaggaaaatcccggcttaagaagaatggagaaaggaagagaggagtttgtgggtaactggggatgagaattcctgtggctgcaagaagagatggctaactagaggggagcaggttggagggaaaaggggtaaggctctggaggaacttcttcccgtgtggcctcttccccctaaaacaattgacagtttactgaatctccctttccccttctccctcccctaccactgctgtacataccaccatcccattactggctgagcccccagccaagttgagaggagacaggggaggaagagctcctgtgggcctagaccagaaaaagctgaatcaagtgaggccttttaggagaatagccaaggaagaggcctgctaagcattgctattttagaggaaggtctgtgtgggctaacagccaggaaaggcttcctggaggtagtggactagcatcgctttgtgtaaggagttggggcagcgggtgtatagaggcagcaggaaagggtacaatgaggaaactttaaaataaggtatattataccttgaataccaggatatggagtttggactttatcatgaatgcagcagagagacctccaagggttttgaagagggtagtgtcatcaccaagagcaggatgaagagggactggatggagactgaagtgaaggagagcagttaggctgttgtaatagaccagatgaaaggtgatgtggactacattcgtgtaaaagcatagggaattaacactttcattcagcccgtacatcgaggacctactatgtacaaataattatactagattcttggatgtcaagattcagttattctgtaagtaaagataaaaagagaccctggagcggaagttttggtatactccaagatcttagacttgttctttttctttgagatggggtctcactctgtcacccaggctgcagtgcagtggcatgatatcagctcactgccacctctgtcttctgggctcaagcaattctcccatctcagcctctcgagtagctgggaccacaggcgtgccccacaacacccagctaatttttttttgtatttttggtagagatggggttttgccatgttgcccaggctagtctcaaactcctggacttaagcaatgccccctacctctgacctccaaagattacaggaattacaggtgtgagtttgacttgttcttgattggacagagatgccattgacaggataaaaataaccaccaacatttagcgagcttattatggctgggcattgttttaaacagattataagcatgatcttcacaacaatgtcatgagttaattactgttatctccattttattttattttattttattttatttgtgagacagagtcttgctctgtcgcccaggctgaagtgcagtggcgccatctcggctcactgcagtctctacctcctgagttcaagtgattcttgtgcctcagcctcccaagtagctgggattacaggcgtgcatcattacacctggctaatttttgtatttttagtagagatggggtttcaccatgttggtcaggctggtctcaaactcctgacctcaagtgatctgcccgccttggcctcccaaagtgctggtattacaggtgtgaaccattgcatcccacctattttttattttttgaggcagggtcttgctctgtcatccaggctggagtgcagtggtctaagcacagctcacttcagcctcaacctcctgggctccagccatcctcccaccttagcctcccaagtagctgtgaccacaggtgcacaccatcacactctgctaatttttgttttgttttgagatagggttctcactgtgtcacctgggctcaagtacagtggtgtgatcatagctcactgtagcctcgaactcctgggcttaagcgatcctcttagcctcccaaagtgctgggattacaggtgtgaaccactgtgcccagcctccatttttttccagttgaagaaactaaggcttaaagaggcttaaataatttgtccaaggattcacatttaactaagtagttaggattgcactcagatttgtcctactctagaggccaaaccctttagacactatactataacagctcttagaactagagaagttggcaagagcaggttttgtttttaagatatattgactttagagacacgaattgtttctattcttcataggaaagtactagttcagaatatagcagtagcccaaaggatggtagtggttaatctggaaaaatggaaaaggaattcaggaaagacttaataaagggcatgtgatacttgaaagatgagtagttgatatactgaaagtggcaacgacattcctattagaacagcatgacaaaggacattcctattggaaagaacagcatgacaaaggtacaggggcagaaagcggcataatatgttaggtaaatgaaaaagtagttaagtgtggctgaaatgtaggaggcaaagcagggagctgatactagcagggcagattatgaaagaccttttatcacacatattcagtaggtccttttcaatgccaaatggttcattttgcttgggcagaagtgaactgaccagctcctaaataagcatgtcaagctcatttagcatgtcagcttgttttgtgggatgatctcacccttgcccctgaaattccagcttccaactgagtggctgaagataagtggactagagtttggaacagatctagattagcttctagaggttccatttgtcaaatgagaagtctacccttccattttcctttccagtagaataaataatgcttggaaacctcttgggtgggagggggaggggaggaaaagtaaacttttgttttgatttttgtagccctcccaggcccaatacttcaaagcatcctacctctgctcaatatatattacttggagaggattgaggaaactgccctcaagaaaggtgagtatctttctgtctctttctcagtcaatgattatgagcaaggcaccataatgttcttccggtaaatattacccctgatacctgctagaacttcgtgcttttcaaaaagtaccttcacacctatttttcttcctcattcctcagtgtcctatgaaacacaaagccaagtatatgatctttattatactgataaaagtgagacacaggcacaccacaattaatagcaaagccagaacaacaacccatatcttgtgaatcttagtttctctattttaccaagcttcctcccctcattagacacatctgttaacaggtaacatttaaccctaatgtgtcaagcattgtcctaggcactttacccacagaaactcatttaccctaatcctttcaacaaccctatgaaatagctgttattaacattttacagatgaggagactgaaccacagagaaattaagtaacttgcgcaaagtcacatagctggagtgtagtttgctgatattcacacccaggcaatctgtctttagagccagtgcccttaatcactctgccatattgctcctgtgaacccagaagacaacatgaaaggttgatgtactttactcatggtggccagtaagcagccaagtgtgatatttctccttacaggcctctcaactcaggccatctggcgccgactctgggatgaactgatgaagacaaggccttccagtttggaagtaagttaaggtatcaggtagaatgctagcctgattttgcatggtaaaagcaggaatagcacacaaacacaagctgggtactgataaagtgcagaggcaatgatggaatggatttgggaggagggctctgatggcttgtcacaaggttttggtccatttggcatttgtcactgaattgcttgctcactgtatttgcaggggacacaaaacagggaaagttagtgatcacaatggatggcagagccaggattcctagagttcttgatggtgttggtgcagtggtcaaatctaacaaaatgaaatttaatagaatacaccaatacttcaatgagttttaaaagttccaattgcatggtatcgggatgagggataaaggagtatgattagtaacagcttgtataaaaaagattaagggagtttagtcaacaatgtgttgaagccacttataacgactataccttgagctgtgtgaactaatgtaaatatagtataggctgaaggacaaggtggacaacagtcctgcctagctctgcaatggtcaggctacccgtggagattggagaaagtcaaagccacattatgtgagtcacattgggacaactggagatgtttttcctgaaaaagagaagacttgggaaacatgacccatcttgaaatatatgaatggctgtcacatgaaggagggattaatagacttgttctggatggaagctaatggaagatacatttttgctaacctgaagtttacgtaaagcttaaaccctgagcttatgaaacaagctaattctagaggtaataaacttcccatcactaagttcaaatggagtctgtgtaactccttgacactagggtgttctgcaggggattcagcattgtaaaaggggttgcacaagatgacttttagagctccttttagacctgagattctattattcactgatacagatataaatcactggagctctcatttaagcagtttcttttgctgccccataactaggtgatggggtagatttaattcaataaacatttactgaaacttaaccaggtaccagatcttacactagatattggaagaatagatgcagcctctaatcttaaagacctaacagttttgttttgttttgttttgttttgttttgtttgagacggagttttgcccttgttgtccacgccggagtgcaatggcgcaatcttggctcactgcaacctctgcctcccgggttcaagcaattctcctgcctcagcctcccaagtagctgggattacaggcatgcgccaccacacccagctaatttttttgtatttttaatagagacagggtttctccatgttggtcaggctggtctcgaactcctgacctcagttgatccacccacctcggcctccaaaagtgctgggattacaggcgtgagccacctcgcccggcaaggacctaccagtttaatagggaaatctacaaatagatcacatatgataggataagtggtgtaatagaggatagtaagaaggttgagagagaagagaataagaaagtctttcctaggaagtagtatttgaactgggccttctatggtgaatgaggccaaataacaggtggaaaaaaagctaatgtcaggaattggagatttaatttctggggatgcactgggttcagtaacattgaaccccatctccttcggcttattcacttccaaatctggactgcaacccttggcgttcagaatgaggacaacagaccttatgaggaagagaagcagactcaagaatattagaaaacagtaactgctttttgctatctttaaggaaacatcagattcactttgttccagtatttcacaagcactagagttgaccagcaagtgataaagattatatttttctcttggagaaagctttctgtcttcttggctcaaagcatttcagagcatttagaggccccaggcttggtggcccaacagtcagttaggcagaggtcctaacttggagcatgtccattccagagggtgtctttccgcttcccacttttgcatgacaatagccttcagctcataagtcacaaacagttattcagtgcctgctcagttccatgcattatgctaggttccagggatacaatggtgaacaagataaatatagaatgcttataaagcaatagtatttcaaactgtgtagtactggggtatataaagagatctgtaaggtcaggcacggtggctcacacctgtaatcttagcactttgggaggctgaggcaggtggatcacttgaacccaggagctcaaggccagcctgggcaacatggcaagactttgtctctactaaaaatacaaagaactggctgggcatggtggcacatgcctgtagtcccagatactcgggagaccaaggtaggaggatcacctgagcctgggaagtcgaggctgcagtgagccaagatcgcaccactgtactccagcctgggcaacaggagagagaccctgtctcaaaaaactaacaaataaaaaaagatctgtataatagaatagatactctggagaaaaagcaatgaataaattaagatttacccaataaattattctctagcaattggttagctatttggaaaaagttaagttagagcctcactttacagtatactctaatgacttttgtataaacaataaattgtggccgggcacagtggctcacacctataatgccagcactttgagaggccaacgcgggtggatcacgaaatcaggagttcaagaccagcctggccaacatggtgaaaccctgtctctactgaaaatacaaaaattagctgggcgtggtggcacgtgcctttagttccagctactcaagaggctgaggcaggagaattgcttgaacccaggaggcagaggttgcagtgagccaagatcacatcactgcactccagcctgggcaacagagcaagactccgactcaaaaaaaaaaaaaaaaaaaagaattagttgtaaaaagtaaaggcacaagagtcgggtacagtgactgacatctataatcccagctactccagaggctgaagtgagaggaatagcttgagcctaggagttggaggctgtgatcatgccactacattccagcctgggggacagtgcaaaaccacgtctcttaaaaaaagaaagaaagggctgggcgcggtagctcacacctgtaatcccagcactttgggaggccaaggtgggtggattgcttgagcttacgagtttgagaccaacctgggcaacatggagaaaccccgtctctacaaaaaatagaaaaattatcctgttgtggtgttgtgcacctgtagtcccagctactcaggaggctgaggtgggagggagcccaggagacagaggttgcactgagccgagatcacaccatcgcactccagcctgggcaatagagccagaacttgtcttaaaacaaaaacaacaaaaaagtttcaacaccaaagaatagaaaaaaataatttaaaaaagaataaaaccaacaggcaggtgtggtggctcacacctgtaatcccagcactttgggaggctgaggtgggcagatacttgaggtcaggagttgagaccagcctggtgcatatggtgaaaccctgtctctactgaaaatcaggcatggtagtgcatgcctgtaatcccagctactctgggattactacttgggaggctgaggcagaattgcttgaacccaggaggcagaggttaaaatgagccgagatggcaccactgcactccagcctcggtgacatagtgagactctgactcagaaaacaacaacaacaacaacaaaacaaaataaaaatacaaaaattagccgggcgtggtggcacacacctgtaatccaagctccttgggaggctgaggcatgagaatcacttgaacccaagaggcagaggttgcagtaagactagatcgctccattgcactccagcctgggtgagagtgagactctgtctccaaaaataataaaaccaataaacaaaaaaaagtaaaagcacaaatcaggccgggtgtgatggctcatgcctacaatcccagaaaaacgttgggatgccaaggtggtcagattgcttgagcccaggagttcaagaacagcctgggcaacatgacgacaccttgtctctacaaaaaatacaaaagttagctgggggtgctggtgtgcgcctctagtcccagctattagggaggctgaggcaggaggatcaattgagcgtcaggggtcaaggctgcagtgagcaatgataatgacactgcactccagtgtcataacctgtcttaaaaaagagcacaaaacaactaaagaaataataaaagtgaccatcctaatctcaggatggagagagtactaatttttttttttttttgagacgaaatctcgctctgtcgccaggctggagtgcagtggtgcgatctcagctcactgcaacctctgcctcccgggttcaagtgattctcctgcctcagcctcccgagtagctgggactacaagtgcgtgccaccatgcccagctaatttttgcatttttagtagagatgaggtttcaccatgttggccaggatggtctccatctcttgacctcgtgatccacccgcctcggtctcccaaagtgctgggattataggcgtgagccaccgtgcccagccgagagtgctaattattaaatgcacagaaccaagaaagaaaatacagacatatttaaccacataaaatgctaacactatcttcaggactttgtattgattaaattaaaaaaatgaaaatgccaacaccataaccaaattttaaaaggtaaatacactgggaaagaacatttgcaacaatatttgcaaaacaaagggacacaaaataaaaagacaaatatcccagtaaaataaaatgagtaaggatttggacacatcatgaaatacacaaaaatccccagtaaagtgaaaaatgttgtctcatgataaaagtgagaaagtaaaatccctatttcacctcttagtttagtaaagtcttgttttgatttggttttcatcgcaaaggtaatgcctaggtttggccatggcgaaatttgcattttactatgctattggagggaacagaaattgttgtaactttcttggtaggcaatctggtaatatttgttcagactttaaaatatctaggctggctggatgtggtggctcttacctgtaattccagactttagaacaccaaggcaagaggatcacttgagcccatgaattcgagaccagtctgggcaacacagggaaaccccatctctacaataatttttttttttttttgagacagagtctctctctgtcacccaggctggagtgcagtggtatgatcttggcccaagtagctgagattacaggcgcccatcagctcggctactttttgtatttttagtagagacaaggtttcaccacattggccaggctggtctcgaactcctgacatcaagtgatccacccaccttggcctcccaaagtgctgggattataggtataagccactgtggccggcctgcaataatttttaaaaattagctgggcgtgttggcatgtacctcccagctaattggtaagctaaggtgggaggatcacttgagcccaggaggttgaggctgcagtgaactataatagcaccactgcactccagcctggctgacagagaccctctcctccccagaaaatttaggctgggcgtggtggctcccacctgtaatcccagcactttgagaggccgaggcaggtggatcacctgaggtcaggagttcaagaccagcctggccaatatggtgaaaccccgtctctactaaaaatacaaaaattagccgggcgtggtggcgcatgcctgtagtcccagctactcaagaggctgaggcaggagaatcacttgagcctgggaggtggaggttgcagtgagccaagattgtgccattgcactccagcctgggcgacagagcaagactccatctcaaaaaaaaaaaaaaaaaaaaaaaaaccagctggggcaacacagtgagaccttatctctacagaaaaaatttaaaaattagctgtgcatagtggcatgcgtctatagtccctactacttgggaggctaaggcaggaagattgcatgagccccaggattcaaggctacagtgagctatgatctcaccactgcactgcagccctgggtgatgggacaagaccctgtctcttaaaaaaataatttggctataagttctactccttagaatttatagtatataaaaattgagatactcatgaagatttatttccagatgtttattacagaagagtttaatataaaaaagctagtaacagggtcaggcactgtggctcatacctgtaatcccagcactttgggaggccaaggcggcggatcacttgaggtcaggagttcaagaccagcctggccaacatggcgaaaccccatctctaccaaaaatacaaaatttatttgggtgtggtggcacgtgcctgtaatcccagctacttgggagactgaggcaggagaatagcttgaacctgggagatggaggttgcagtgagccgagatcgtgccactgtactccagcctgggcaacagagcaggaatgtcttaaaaaaaaaaaaaaaaaaaaaaaaaaaactagaaacaggccgggcatggtggcttacgcctgtaatcccaacactttgggaggccaaggcaggtggatcacctgagctcaggagtttgagaccagcctggccaacatggcgaaaccctgtctactaaaaaataccaaaaaattagctggacatggtgttgtgtgcctgtagtctcagctacttggaaggctgaggcacaagaattgcttgaacccgggaggcagaggtttcagtgagctaatattgtaccactgcactccagcccagaccagggcgacagaggaaaaaaaaaaaaaaaagctagaaacaatggaaatattaaatacagcaagtattattacatatggtacacattttcaaaataaaatattctaaaaatatttgaatacatggtatgttttaaaagcccagcatttgaaactgttcagaattgtctcaatgttgtaaaaacaaatatatataggtactctcatatatgtaaatactccagagttagtttacacttttgagacggtctcactccagttgcccaggctgaagtgcagtggcacgatcttagctcactgcagcctcaacctcccaggctcaggcgatcctcccacctcagcctcccaagtagctggattacaggcatgcaccactatgcccagctacattttttctatttttagtagagatagggttttgtcacattgcccaggctgatcacaaactcatggactcaagcaatctgcccaccttggcatccccaagtactgcgattacatgcatgagtcaccatgcctcgtccatgatttttcatttgcttctctatccacacacagtatttctggtatcagcaaaataatgaacaaaatatagtttctgaatattgttggctctaacaagttagcacaagatgtttagccctccctagtttgtacaaatacttcctcttcccctaccagcccactgaggatgggccaaggattgtgttgttgggcaaacatcacttcacctcattgatcatgcctcatttcccttaccctcacagaaaacaaagtactaaatcactttgcatcgtgatagcatacgagtccataaaatgagtggtctggactagatctcaagcatctctcagcttcgaattttagcatagactccttttttttttggagacggagtcttgctctatcgcccaggctggagtgcagtggcgcgatctcagctcactgcaagctccgcctcccgggttcacgccattctcctgcctcagcctcctgagtagccaggactacaggcacccgccacctcgcccggcgaattttttgtattttagtagagacagggtttcaccgtgttagccaggatggcctcgatctcctgaccttgtgatcccccccgcctcggcctcccaaagtgctgggattacaggtgtgagccaccgcgcccggcccatagattcttaagagtggtgatggaataaaacttcatgatctcttgtctgctcgtacgttaatttgtgagaaagaagccactgagagctgtcataactttactcatttaactgtcacaaaaatgctgtgatgtcagtatagtgatcttccactttatagatgatgaaactaaggcagaaagaggtgaaatgacttgcctaaattacagttagtgaatggcagacccagattcaggttgaagcagtctgcttctggagtgcatgttcctgatcactgtgtcatgctgctcactgcagttgtgtctggggtgttccaaatattctgtctcccattgtcttcatcaaccattaacatgtctgaaaaagtccagtatttacctatctaacctatatttcccctgtgcctcttatagccagaaacagccacaatatcttgactcaccatctttgtccatattttaggcacagatattgtaataaccatctgactcactcacttataaagctgaagccttgctaaggttacctgcaagtgtttttcaagactgggtgtgggccagcaaatctgtaggaaaagtgctagtgtgaggtaggaccgaaggataccttctttgccttcactcaaagttgagcagagatttggttgccaggtattgtttttcctgctcttaatgtcctgctgctgatgagcaaggcctttctgtgttgctgctatgcagttatttcaagcaggaagtcattcctaactattaccacagtaagtggagtctggggaaatagctaaggcaacaggaatgacacttttgcttgaggacagcagaggcctagttccttctaagaacctcaaataggaactgagagtcactccagtatggaggaatgcatggaggcagggtaaggatcaaagaaatgttttagtcttggggaacctcaggcccccacagccttggctttagtctgaatgagcaccatgcttaacaggctctgcctccatttcatatcccagctaggctaatagcagtggcagcagtaacattttttatatcttacagtttacaaagtgctttaatttgtactacttcattttgatcttcacaacaatcctgtgaagcaggttatctacattttgcagatgagggaagaggttcagagaagtccagagtatagtgaaagagctgggacctgactttctactgcccctgagatgacttagggatcatcttaaattagaaactttggggtctggtacctgtctttgtcttggtgtgcccttctggatcagcagtaattcctaacctctgatatacatcagaaacatctgggatggttcaaacaataaagatgtcttgaccttacctcagatgtaacatagaatcaccaagtctgggtgtctggtatatgaattttggggaagaaaagctccacagggaattctgatgtgcaccaaaggctgagaatcacttgcattcagagttgtattaaacacatcagaatagtctgatgaatcgcttctcggccttttggctaagatcaagtgcagaatagtctgatgagatttcctatccgtcaaaataaataactgttgccttggaagaaacaaatcaagatttggtttctgctttctaagaatttctaatctggctgggataagacatgtacacaggcaaagggactcaacaccatgagacaacataccagcctcttagtcttgagtagtcagagtgtcagaggagtcccaacaagaatctcaaatgacatgtttctaagttctttcaggaagtctaattcagcaatggagacatttctggtagatgtaggaaaggacataggcaggttcaagtccgtggggtgaccagcttggctagagcaaagcattctcataagcaagatgtgggaaataaagcttctcaggcagagggtggaagggcagtagggagacattagggttttaaagcagtatgatgtaattagtgttttacaacactactttggggacagggaaagcaatcaggaagctagtggtcaggtgtgaggtgataaggggctggtggtggtaagaatcagaagttggaggccaggcgtggtggctcacgcctgtaatcccagcactttgggaggccgaggcgggcggatcatgaggtcaggagatcgagaccatcctggctaacagggtgaaaccccatctctactaaaaatacaaaaaattagcctggcgtggtggcgggtgcctgtagtcccagctactcgggaggctgaggcaggtgaatggtgtgaacccgggcggcagagcttgcagtgtgccgagatcacgccactggactccagcctgggcgacagagtgagactccgtctaaaaaaaaatgaagttgggataaggggctaggtgcggtgactcacacctgtaatcctagcactttgggaggccaaggcggacggaacacttgaggtctagagttcaagaccagcctggtcaatatgatgaaacatacaaaaattagccaggtgtggtggcgggcgcctgtaatcccagcttctctggaggctgaggcacgagaatcacttgaacctgggaggcagaggttgcagtgagctgagatcacaccactgcactccagcctaggctacaaagtgagactctatcttaaaaagaaaaaaaaaattgggataaggttctagaaacaaacatggaagaacttacaggggtgagtgtttcagtggagacactataataaaagcatggtctctggaaccagatttccagggttcaaataatccaaccacttacctgtgtggccacctctttgtgcctcggttttacctgtaaaatagggctaataataatacatacctcagagatgtgaagattaaatgaatttgtagtgttgcctgactcagtaaatagtgtgctattggaagagagggaaatttggacagtttcatggatatatcatggctgtctggcatgttttctgcgtttcagagtgtgacatgttggcgagccaagtttatggaggcctttttttcccatgttctacgtgggaccattgatgtgtcttctgacaggcgtctttgtgatcagcggttctcacctcttctgcacagctcccgccatgtccgacagctcaccatctgtaacatgctgcagggtgcaaccgagctggtggctgagcccaaccgcagggttctggagaccctggccagctccctgcacactctcaagttccgccacctgctgttctctgatgtggctgctcagcagtcacttcggcagctgttgcatcagctcattcaccatggggctgtcagtcaagtgtcgctatactcctggcctgtgcctgagtcagcccttttcatccttattctcaccatgagtgctggcttctggcaaccagggcctggtggcccaccctgccgcctctgtggagaggcctcccgaggccgggccccatcccgagatgaagggtccctcttattgggctcacgtcggccccgccgggatgctgctgagcgatgtgctgcagccctgatggccagccggcgtaagagtgaagccaagcagatgcccagagctgcacctgccactcgggtaacacgccggagcacacaggagagcctgacagcaggcggaacagaccttaagagggagctgcaccccccagccacctcccatgaggctcctggcaccaagcggtcaccttctgctccagcagccacctcctctgcctcttcttctacatcctcatacaaacgggcaccagctagctcagccccacagcctaagcccctaaagcgtttcaagcgagctgcagggaagaagggtgctcgcacccgtcaggggcctggtgcagagtctgaagacctgtatgacttcgtttttattgtggctggcgagaaggaggatggcgaagagatggagattggggaagtggcttgtggagctttggatggatcagatcccagctgcctggggcttccagcactggaagcttcacaaagattccgcagcatctccaccttggagctattcacagttccactctccacagaggcagccctgacactatgccacctgctgagctcctgggtgtcactggagagcctcacactctcctacaatggtgagcaccctggagtggcagggattgggcttagattgcctagcagcaccagctgtgtgcctaattctagggaggtgggaggggcaaattgggggtatgatcaggaggttagagaggaaggcttgtatgcctcatagcaggggagactgtcattgctagaagagaggaacataaagtctatacacttgattagttgttgaaagcaggggttcctgaggggcagtgagacaagccagctggaatctgaagaatgaatacattttagatatggaaggcagtccaagggcaggtgggagcagtatagtatatgcatgctcaggcagggctagagtttgacctcaccacctcaccagtcatatcagagtagctgtccagacaaggtgtgggacacaatttcttatcagaccaacaacctgcaaagcagtcctcagtcctcatttccctcctgcttgtgaccagctagcaaaacctcaactctggctaaatccagcaatccgcctaggttgctgagcactgctagagacaaatcatacaactatgcaaatcagtgttactatatgatcactaacctcgtatgaaccttcactgtgcttgcaacatcagctcccattcctaccacttccaaactctccttttcccttctcagggatgacctcacctacttcacagagaaaatagaagccatcacacatgagtttctttagcttgctaagcagcctataaactctccatctgcactcatccttctttaccagaatagaagagaccaccatcctttctaaggctaattctcccacctgtgctctagatgcatagagcttcacaacaaagtatataaaaattaccagtttgagaaacaagcattctaccttcttagggaagcttgtttctcaaactaatttttatatactgcttagtatgtgtctggcatattttaagtattcttgataatttgatctaacaatcctcacaaccctatgagggcaagtgacttcctcaggataacctagcaattatagagctaggattcaaaacccaggcaaccagactgcagattcatgctttcaaacaactatgctactctcctttccaccgtctctctcctatcagcattttaacaggtctccatcaaaaactgccaccaccacctccctctatgccatattaataaactgttatctcctgttcttcacaaccttagttatctgtactgtttccacttctcttactcacagccccttccagcctcttatacccctaccactgcactggcaaggacctatgtcatcagggtcctccttgttactagatccaatgtatacttttcagtaactcttcttggcaggatttactgctgttcattaaattttttttcactaccttaaaaaatgttttcttggccgggcgcagtggctcacgcccgtaatcccagcactttgggaggtcaaggtgggtggatcacgaggtcaggagttcaagaccagcctggccaagatggtgaaaccccatctctactaaaaatacaaaaattagccaggcgtgatggtgggcgcctgtaatcccagctactcagtgactggagatcgtgccactgcactactgcactttaacctgggcaacagagtgagactccatctcaaaaaaaaaaaaaaagttttctcctcctctgtttattcagagttcctcagagctttcccactttatgcacgcttcttggacaatttcatccattcctgtggtttcaaaggccaactatgctaaagactccccattatgtgacattaccccagatctttctcttgaacttccagacccatttatccagctagtagacatgacaacttcataacccacaataccccacccaactcattacatccaacttgaatgcatttttatatttttagtaaggacagggtttccccatataggccgggctggtctcgaactcttggcctcaagtgatccaccaacctcggcctcctacagtgctgagattatagtcatgagccattaagcccagccctatctttacaatttgttaaatacatttatttctctatctccacatccttaattcaagctaccattacccactacctgaactaatttcagtagttcctccggactccttactcttgccatacaaatccattatctgcactgcagcccaagcatcctttgaaaaatgcagtcttgattctttaaaaaaatcagtcaaaaatgaccctgtcattcatttatgcaaacacccttcaatggcttaattttacttagtggtcattcatattcttactcctggttatctctatagttgtatcttttttttttttttttttgacagggagtctctgttgtcacccaggctggagtgcaatggtgcaatcttggcttactgcaacctccgcctctcgggtccaagcaattctactgactcagtagctgggattacaggcacatgccaccatgcccagctaatttttgtatttttagtagagacggggtttcactatgttggccaggctggtcttgggctcccgacctcaggtgatctgcctacctcagcctcccaaagtgctgggattatataggtgtgagccaccacacctggcctatagttgtatcttgaatgcttccccccttcacactctcacaccagccattatgaaatttttttgttctccttcaggcctctacatatgccaagttgcctctgccacaatcattcttcctaaattttagcctgtcccctttatgttctttaggacttagctggagtgcctttactgatgtaagctggactaggtactcatcctttgtaatttcatagtactttattcccccagttcccatcgcattatcaagctatgtaagaaaaaaaagcaatgtgctgctcactagtgtctagcaaaaaacttgatatttagtaggcactgggtagttgaatgaatgaacaggagcctgcatagtccaaggaattatttgcctgtggcattaagcaaccaaccttcctggatcctagtccatgctgtgggatttggttatcttttcctgccccattcccacccattgattcttttaagtatcccagttgggtcactgtcactctccatagtttttaggtgctccctattgcgtctaggttaaaccatccctttgcctttccataatgtggcctccagtgccctgccctctagagctgtttcctgagcctcatgtagccaaacaagcaagcgtctcattcatgccttgcactctcctagctgtgattttttttttttttttgagacagtcttgctttttcacctaagccggagtgcagtggcgtgatctcagctcactgcaacctccgtctcctgggttcaagtgattctcctgcctcagcctcccgagtagctgggactacaggcatgtgccacccagcccagctaatttctgtatttttagtagagacagggtttcaccatgttggccaggctggtctggaactcctggcctcaagtgatctgcccaccttggcctcccaaagtgctgggattacaggcgtgagccaccgctcccggctagctgggactcttgactatgtcttctccctctatccaaaacttccttccttcaaggccagtttcttcagaaaactactcagaacccagaaatccagagaactgctactgtctgtgcctgtcattcagctagtagccacatgctgcctcaccatattgtatcttctcaattttgtgactctgccctgactggtgcttcttgtgggcataacccaaaacagcagacctcagtttgctggttacctaaggaaaaagcaagacatggatgagtagttaagacaaatgggtttaaataagctgagccaaagcccaagagatttgctagtaaccaaaagtatttggagttgtatttgaatatattacccctgctgacactcccacatggttctgacttaatctctttcttgccataggcctgggctctaacatcttccgcctgctagacagcctgcgggccctgtcaggccaggctggatgtcgcctccgtgccctgcatctcagtgacctgttctcaccactgcccatcctggagctgacacgtgctatcgtgcgagcactgcccctgctacgggtcctctctattcgtgttgaccacccaagccagcgggacaaccctggtgtgccagggaatgcagggccccctagccacataataggcgatgaggagataccaggtgaagcactgtgtgtgtgtttgtgtgtgtgcacgcacgtgtatccccacacaaaggtgcagatgcattcgtatggggaaaggggaaggacctcttctatcactcattcctggcttatctggaacctatcccccctttagagcctaccactaagatactcttgagctagacagggcctaaaccaccataagaccagcagagagtgaccaaggcagcttggtctccagaaaaggaaaagaactgatctttagactggattagttcccctgctgtatgttcccttagttcttgtatgtctcctatcccaccactctgcatactttatttgcttgtgtctgggtagcctgtcttcctggtctaaaatttctacaagggcaaggactaaatctcatatttagtgctcaattcctagaatctagcacagtgctgacatatggtaggcactcaacgacaagtgaatgaataaataattttttagatgaatcccttaagaacaggatgggacctgctatgggagtgaggtagagatggccagctggaatcttctttccccaccatatccagaaaactgcctggagcagttggagatgggatttccacggggagcccagccagccccactgctgtgctccgttctgaaggcctcgggttctctgcagcagctgtccctggatagtgccacctttgcctctccccaggattttgggcttgttttgcaaacactcaaaggtaggacccagccagaatggtgaagggagaggagtaggtggggacctagcactgttctctaggaaagctaaggtccatggtccatggtctctgcctcctatccagagtacaacctagccctgaaaagactgagcttccatgacatgaatctcgctgactgtcagagcgaggtgctctttttgctacagaatctgactctgcaaggtaagttccttattcagaacctggacatttcctgggtcttcactatggttctgccataatctgagtgagcaaaccactgttcctttcttggccttgtgtcctcagctataaaatggatatagaacctgcatgattttccttctaaaagccccaacctcaattcctcctctactaaacatgagaaatcgctcttttagagtgcttcacccaaaagttgctcttacctttcagaggtggacaaaatggtggtggtggggcaaaataaatgtactgtgccaggctcccctcatagacttttctctgatccccacccccgcatagagggtggccagtgttagggaaagaaggaagtgaatggagaattgtccatgcagagaaccttcttatagggaacatttaggttcagtctttagtttggattctgatttagttccagccttgcttggagtctagacaaattccttcctctttttgggcctctataatgttaataccccttgctagggccaactggggcaggaggggcagcaccagtcctaatgcagccatcagaatttactataatttttcttgacagagattaccttctccttctgccgtctgtttgagaagcgcccagcccaatttctgcctgagatggttgctgctatgaagggcaactccacactgaagggcctccggctgccagggaaccgcctgggtgggggccagaccctggggagggagaggggaaaggagctaggcctttgacctaaaaactcactggataaaggcaaagacctctccactgggaacgtgggagttggaatacagatatttctgtgctggggcttcaggaaccagcagggctggttctgccagccatagttgggttgggatacccttgtcccctgttcttgggtggaggtgataggcgttctccccttctctccagggaatgctggcctgctggccttggcagatgttttctcagaggattcatcctcctctctctgtcagctggacatcaggtacatgaggggaggggcaagacaagggatggggctacagagatatagaccaggaattcactgcttcctggatatctaatccatctcaccctaccagttccaactgcatcaagccagatgggcttctggagttcgccaagcggctggagcgctggggccgtggagcctttggtcacctgcgcctcttccaaaactggctggaccaggatgcagtcacagccagggaagccatccggcggctccgggctacctgccatgtggttagcgactcatgggactcatcccaggccttcgcagattatgttagcaccatgtgatggggcccgtacctcacagtctcatgctcggtaccatcagcttgcaggggctgaagcatgggctgcccagaaccccaaccaccagttctatctttctctttctgtcaccttttttctcttttttccttcttcccttgcactgaggtcctggaggccttgatgaggcccagcaaacaggcattctcacagctgggtttatagtctttgggccccttactcagtatcctgggaaccctgggccaggaggttacagtggtcatcataattgctgaagagatcccctcccctgcccctgggttcctgccttccctcctcaagcaggcacccaggctttagagaagtatagggggcttcttccctgctgggcttaccacactgctctcaggcctcaaaccctttcatacctttattcttttttttaaccaaaaaagtttttcttataaaataaattttgggcaaacatc

SEQ ID NO: 36020 - DNA, 23426 bp, Homo sapiens
ccgctgccttccccagccgccgccatgaagctgaccgacagcgtgttgcggagcttccgcgtcgctaaggtgttccgcgaaaactcggacaagattaactgcttcgatttcagccccaacggcgagacggtcatctcgagtagcgacgacgactccatcgtgctctatgactgccaggagggcaagtgagtgcggcggaggccctgggcccgagtctcagtgcctccctccggtggcccagcacaggtccctcggcctgccctccgtcccgacttcagcccccagcctattttgcacgcgttcctgccagggccgcctccaccccgcagccgtccaggagaccttttatttttttcttcttaaaaaaaaaagataacgatagtcataattttataatattatttgtatgtcttcggtctcctttgagcgctatgcatcacttgccaaaccccaccttgaccttgacctttaaacgcccggtccgcccaccctgggcccaccaggtagcgttttcagctcctcaggctgtcaaaggtgctggtctgctccggcctcgacgcaggactgcaggggctgcttttctgcctccttcggcagcgtcagctctctcttgtgctctctccactgtgacctcgattccgccctggcactccgcccatcccctgcccctcagcttcccgcggcctttctgccgtcagaccgcgtgggttgcacttcttagctgtcaggatttatttgttgtgcccctttgagcccccttgctttttcttcctgctcctagcctttctcttactcattcagacttggtgcccacgttcataagtgaacttttcagcaacatctaaaacttcctttttgccacacacaaacgaacttggtcgtcccatcctgacctgaatgtgagcttccgttaaaacaaagcaagcatcgtagaacaatttcaggtttcctttcatacttttttttttctattacactttttggtccactttgaattccaattctgatcatgaaacttttatgttgccacaagtcatctggagacccaccatacctgcatcttttcgcaaaatctaagcacagcactttgcctttttccctgggggtccttgtcagccctcctcaccgcacgcctgtggacttgcagctccttggagccaaaaactagtttagattaaattcgttttacccttagccaccttccccaagaaggcttgctgatgtttggtttaattcggtggaccctggttttttcagacttgattttgtcacctagtaacagatattattattattattattattattattattattatttgagatcttgggtttttctccaccttctccagctgttcctttttcctttttttttttttagactggtgtccttcttttggaacatatctcttcatttgtgaatttgattatctgaagtaatgctagtttggactgagctataatggtatccccccagtttttttccccactggggctgtgagaaagtattatgtaaccggctctggatctgcctgcagtttgtggcagagtggtctgcagtggtggtcttaaggaagagggaattgttagctggacaaatagttatttgagtcagtgttactcattgagtagatggatttctgtcctggtctggtcacttgaatcagtttagaagacgaagtaacatttaaaggtgtggtagtagggtcagcattgtggggtcctggaggagtaatttgaagctggcttgcatgaaatgtatagtgcttatgcacagattagaacctcttcccagaacctgagggtggagatgtatatcctcatttaaaggaaatgaaggttgttatagcatttctttgcagtttgtccccaaatttggcgtaattttgatttgggaaggatgaccttgacatgaagtcctgtctttcttttttttgtttttttttttcgggtgggggacggagtctctctccgtcgcccaggctggagtgtagtggcgcgatcttggctcactgcaacctctgcctcccgggttcaagcgattctcctgcctcaccctcacaaatagctgggattacaggcgcctgccaccataccctaacttttgtatttttagtagagatggggtttcaccatgttgaccagactggtcttgaactcctgacctcaagtgatccacccgccttggccttccaaagtgctaggattataggcatgagctgctgtgcctggccaaatcctgtcttgttaaaagtaaaatgctagttttgtgacataaggcagtttatttactcgtagcatttttacataattagaaactaacaaagttacagtgtttcaaagaactcccatatgattcaataactggttacattttctgcatttgcttcatgactgtaggtaaatatttatatgtactgtgtgcctccccccacctttagagttggaggtatcaagcccctttatccctaaacacttcaacatggattttctttcttttttgagatggagtctcgctcagtcgcccaggctggagtgcagtggcgtgatcttggctcactgcaacctccggctcctgggttcaagcgattctcctgcctcagcctcctgagtagctgggattacaggtgcatgccaccatgcctggctaatttttgtatctttagtagaggcagggtttcaccatgttggtcaggctggtcttgaactcctgatctcgtgatctacccgcctcagcctcccaaagtgctgggattccaggcatgagccactgcgcccggctcaacgtggattttctaagcacaaagacattcttatgtaaccagagcacagttatccaaattaggaaatttagtactgatacaatactacagggcatgctcttgagttttctctgatcaattaattgtaaccttgtttcattatctgtggtgaaggagtggcctggtagttaggagggaactgggtactagtttggcctgtgactaggtatgtgacattggtcagattacttctttgggtattagacaacctctttagtttccattctaggcaataatatgatgaaaaattttgtcactagtataggtcaaaccgacctcagaagaaaagaagtatttccttgggaaggcatggtattgtatcttttatttatttatttttttgatagggactttcgctcttgttgcccaggctggagtgcagtggctccatctcggctcactgcaacctccgcctcccgagttcaagcgattctcctgcctcagcctcctgagtagctgggattacaggcatgcgccaccacacctggctaattttgtatttttagtagatgcgggatttctccatgttggtcaggctggtctcgaattcccgacctcaggtgatccgccgcctcggcctcccaaagtgctgggattgcaggcatgagccactgcgcccggcctttctttttgtttgtttgtttgttttgttttgttttgtttttgagactgcctcactctttcctaggctggagtgcagtggcgtaatcttggctcactgctgcaacctcgctgctggattcaagcgattctcgtgcctcagcctcccgagtagctgggattacaggcacccatcagtgtgcctgctaatttttgtatttttagtagaaatggggtttcacaatgttggccatgttggtctcaacatcttacctcaagtgatctgcccacctcggtctcctcggcctcccagagtgctgggattacatatgtgagcctccgcacccggccctgtttttttgttttgttttgttttgtttttttgtttgtttgttgttaagacaaaggtcttcccctgttgctcaggctggagtgcaatagcatgcttatagttcactaaagccttcatcttctgggctcaagtgatcttcccacctcaatctccaaagtagttgggcctacaagcactcgccaacttacttggctatttttatttttagtggagacaagttctcaccaggttgcccaggctggtctcaaactcctgaactcaagcgatcctctcacctaggcctcccaaagtgctgggattacaggtgttagctactgtgaccggccgaaggcatagtatctttattagatgaccctagtgttagaatttgggagtttgaaaatggctaaagcaagattttgtgtgcttagtattttccagtttactggtcatttaaattttctttacaatggagttcgcccattgagtgatatttcaatttggaagagtataaaggatattgtttgtggtaggtgaagcaaattactcaaagtgaaaggttaatattattttccttgttgatgcttgatcaccagaattatagtttgaggaaggaagcttaccaaaatatttgaaaaatgttgtgcatgtattttgtaagacccacatggatgcagtacagtataatcttgctttcaagttaggaaatgagtccaggtgtggtggctcacacttgtaatcccagcactttgggaggccgaggcgggtggatcgcctgggtcaggagttcaaaaccagcctggacaatgtggtgaaaccttgtctatacagaaaaatacaaaaattagctgagcctggtggcaggggcctgtaatcccagctactcaggaggctgaggcagggagaattgcttgaaccggggacgcagaggttgcagtgagccgagatcgtgcctctgcactccagccagggtaacagagcgagaatgtctcaaaaacataaaaataataaaaatcaaattgggaaatgaaatgaggcagtagatttctgttatcaggaaaaaaaatctcaggttagtgtttttgataaatttgagacaaatagaccagatctaagtggaaccagaaattttccttacactattctctttcaacttgtcaagttagagttggctcttcatgttctgtctttttttttttttaagacggagtttcgctcttgttgcccaggtcggagtacaatggcgcgatcttggctcaatgcaacctccatgtcccgggttccagtgattctcctacctcagcctcccaagtaactgggattacaggtgcccaccaccacacctggctaatttttttaatttttagtagagatgggatttcaccctgttagccaggctggtctcagactcctgacctcaggtgatccacccaccttggcttcccaaagcctgagattacaggcgtgagccactgcgcccggccagtttctgtctttgctattgtagatgggatgaaataactgatataaacttcttccactggtagcagagtcaactatgtagagagtaagtatacagccacacactgagactgcctcactggttaccacacagtaaccccacatcagaaccccagacagtgcacttggcaaagtagcctttgctgatctttttaggagtgaagtgttatttcagtaaaggtaagaatgtggaaaatccagtgtatttgtagtgagaagtctgttggaaatgggtttcatgtagggaagcccttggcctcactttaacaaaaattgaaagtgcaaataactgacttcttaaagactgcttgagtcgtgattgtttagtacctagattctgagaggattttacattgagaggattagctttccttttcataaattggaactcttggttaacattagtacaggatttatgaaatctttctaaagaactaaatgtaggacattatgttaaaggctttcctgttttttcagttgatcgtattggagagttattttagcatttgaatctagatttacatagatatttaagtctcaaatttttatttttcttttttttttttttgagatggagtcttgctctgttgcccaggctagagtgcagtggcgcgatctcagctcactacaatctctgcctcccaggcttaagtgattctcgtgcctcagcctcctgagtagctgggactacaggcgtgggccaccacacccagctaatttttgtatctttagtagagatagcgtttcgccatgttggccaggctggtctcaaactcctgacctcaggcaatccaccctcctcggcctcccaaagtgctgagattacaggcgtgagccaccacgcccagcctaaaatttttctaacttaaccagtatgtgttagagtttttggttaaaggttctgttgagaccagttttagccttgctcttcaaggttctgtaaagggagacatttaaggaacttcaacaaatggagattgataacctctagcttggaaatgtgtgattttttgtctgttattgaggtggagtctcactctgtcgcagaggctgtattgcagtggcacgatcttggcttactgcaacctctgcctcctgggttcaaggaattctcctgcctcagcctcttgagtagctggaattacaagtgtgtgccaccacacccggctaatttttgtatttttagtagagacggggtttcaccatgttgggctgctctcgaacttctgactacaggtgatttgcctggctcggcctcccaaagtgctgtgatgactgatgtgagccaccaccttgtggccagaaatgtgtgattttgctttaaagtaaaagcaaaggaactatttaactggttttgctagagaaagttaggcttgccttctaaaaggctcagcaagcgcttttgacctgtaggataggaaggatggatgtcttctgcaagagcaggttacattagcaaaggcaagcagttttgcatctggtttcagttttgaggaatcactgccgtcttgaaaaaaaaaaacacagagcttctttctaaatggatgtcttgagaagaaaagtttggcctcttgggtttgacatattctcatatccctctttgttgtaagttaagacttgttttgtgtgcctttcttcccaagtagatgtacagccatgcatcacttagatggggatcatcacgtgagtttttgttgcagcagcatcatagagtgtacttacacaaacctgacggtataatctgcacacacctaggctgtttggtatggcccattgctcctaggctacaaacctgtacagcattttacagtactgaatactgtaggcaattataatatagcgttaagtgtttgtgtatctaaacatagaaaaggtgccgtaaaacagtttaagggatttaaaaaatgaaacatcggttgtagagggcagctctattataatcttatgagaccattaccctatgtgctgtctgttgttgataaaaatgtcatcacatggcacatgattgtattttttctcaaagcttttgaacattgtagtaaagactgaattgaatccccagatttacttttacttcccacctaaccttgccactaggtgttctaaggtggaaagcttcttcagatggctgttgcttgagcgttgttttttcccttttggaagaagttgtttctttccagtgttagaacttaccaaaaatcctcacctttgccacatcattcaagtgcttctctttatgtggagatcccagattttgatgatggagaatgttcatgattttctgtctctattttcttatcagaccaaagagaaccctgtacagtaagaaatatggtgtggacctcatcagatacactcatgcagcaaacacagttgtttacagctctaacaaaatagacggtaagcaagcctttttaggaagttaaggtcatggtttcctttgttaaatagttcatggaatctttgtgactacttctgctttgtgactactttagtttaagtattttcatataatgttagtaatgttaattgcattgttttgactgaaggaatgctggaagcaagccattggcacttttgaaggacttgggactgagtatgaaaagtcttcaattcagagtggggagtggaaaaaggaaacaactaattgtgtttatgatttgtacttcctgacacttaaaagaacgcttttaaagccgggcgtaggggctcgcgcctataatcccaacctttgggaggctgaggtgggcggatcactgaggtcaggagttcaagaccagcctggccgatatggtgaaaccttgtctctactaaaaatacagaagttagctgggcacagtggtgcacgcctataatcccagctacacaggaggctgaggcaggagaatctcttgaacccgggaggcagaggttgtggtgagccaagatcacgccattgcactccagcctgggcgacagagtgagactccatctccaaaaagaacacttttagaacaaataaaaggaaagaacacttgatacacagcaagtgataaacaacaggactttttcttttaaaatgatagagatttgagaaaagtttcacaaatgcttgaactatgatagtttaagggaagttagaacagttttggtgttttcccaaccttagtcacttctgattccaggaacgttttttgatctaaagagtagagttacttttagaaattgaacttgtgagtttctttctataataaacaatctctgtttttgcctgcatgtctcgagataaatcctaagttaacagattgtcttggtaactgaactgtaacacttattttcatgttagaattctttaattttttaattttgtttattttcttttgtttgtctgtttttattttttgagacagagtctcactctgttgcctaggctggagtgcagtggcgcgatctcagctcgctgcaacctccgcctcccgggttcaagtaattctcctgcctcagcctcccaggtagctgggactacaggtgcatgccaccatgcctggctaattttttgtatttttagtagagacagggtttcaccatgttagccaggatgggtcttgatctcctgaccttgtaagccaccgtgcccggcctattctttattcttttgagacagagtcctgctcttgttgcccaggctggagtgcaatggtgcaatctcggctcactgcaatctcagcctcctgggttcaagcgatgctcttgcctcagcctcccaagtagctggtattacaggtgcccaccaacacgcccggctaatttttgtatttttagtagagttgggacttcaccatgttagtcaggctggtctcgaactcctgacctcaagtgatctgcctgcctcatcctcccaaagtgctgggattacaggtgtgaaccaccacgcccggccaggattctgtttttaaacttatttcagtggattattgatgatcatctcacattttgcagtaaggttttttttaggccggtggctacatagtggctcatgcctgtaatcccagcacttagggaggcctaggagagtggatcacttgagcacagaagttcgagattagcctgggcaacttgggaaaaccccgtctctacaaaaaatacaaaaattagccaggtgtgatgggacgcgcctgtagtcccagccacttgtaaggctgaggtgggaggattgcttgagccctggaggtctagggtgatcacaccactgcactccaacctgggtgacagagcgaggctccatctcaaaaaaacaaaaaagatttttctaatgtcattccacaaggatagcttatactgctattttggctgtgcctatctcagagcagaatgggcggaagtccttttttccatttttttttttttttaatgagactcttctgcctgtattgatttttagttaagtatgtcatttctacttttcatgcctgtatttcagaagtggttttctaaggaagcagtgtagttaatgattttggaaaagaatgtaaaaccttaggatcctgaggaaacatgtctatgtgatcatccgaatgactggtttatttcttctgttgggatgtttttctgagtgattaaatgaggattctccaaatgtggtgcaagatgaggcaaatgtgtggcacttgtagctttgctgccaagcctctgctgtgaggatgttccctttcctgtctcaagtgcatcctgaagagttcctccagcgctccgtttccttttgcctgattccaggctgaggtagtagtttgtacagtttgagggtctatgataccacccggtacaggagataactgtacaggccactgccttgccaggaacagcgcgccagctgccaagtggggctgagaggatggcgtcaccctgctcatctctgggaaaccaggtaatggggaggaagtctttttcttcttagggcaggtgagtcattgttagcagtagaataactagaaatacttcgtagttgtcattcaagaagtttgaagatgttttcaaggaaaattgtgtagtgttcaagttatggaatatacaaatatccctattcccctattccccctcccaagttaaatgccctcttattagaaagcacccctgtgaacccctgggatgactcgatgctttcaacccctttattcctatgttctgtttgccttcagaatgttctttctatggttttctttctgcattttggtaccattttcccttagctgtttctcaacaatttttccttattcctagtctttttaaggggataatacttttctattttgcagttttattctttatggcacttcatttctctaccgccaccatgttttttgtttgtttactctttcagatagaatcatttggttaagagtgtcttatttttccacaagcacaaatctctgattgttcctttctttaatattgtcaaaatctcactgctattactcattggtataagaatttgatttttttaatgtcttaagatctttttaacccagatcttgacatcacttctctgacgttttgtttattttcattgtaatttgtgtgtccaattgaagaatgttcaaatgagttgagggtgggtcaacatactgatggagaactctagacaaaaattgctgccagggttcaacctgatcttcagtttaactgccatggctgctcacctctttaagtctgttagctcaacagccacatatttttctttaaggtttgccattctgtggacactagaccagtatctaaaattattatgtgtgctttacttgtttttgttttttgaccagggtatatttgcagggtgggagttgcattgtaattatgaagaaaccaaattggtaataaaaggtcatttcaaacattgctttctatgctgtcaacttaagaactctgcttttgagttaggtgaaatctacatacccactcttcagctgcagagtagaattattcaccattatttattcatgccttgcttgggatatagaatacaatggattatttgaccttgtctttttaagatgaaaatgtaaagtaaatttcttttaaatagtatgatatcatcataccttgtttgtctttttacagatactattcgttacttgtccttgcatgacaacaaatacatcagatactttcctggacatagcaaaaggtaagacccacgtattatagaagcagatagttcttttatccctgaggttacccagagaatagaaggctagagagagcttattagtgaactgaagctacttcctcactactgcttggcattcttcatcttctcttaaatagtcaactcttgatttactgaggttatagaggtgcagaggtaggtgttcagagatacctcagttaaaatataactaggcccagtgcagtggctcacacctgtaatcccagcactttgggaggccgcggcgggcggatcacttgaggccgggagtttgaaaccagccaggccaacgtgtcaaaaccccatctctactaaaaatacaaaaattagccaggtatggtggtggacacctgcaatcccagctactcgggaggctgaggcaggagaatcgcttgaacccaggaggcagaggttgcaatgagccgagatcgcgccactgcactccagcttgggcgacagagtgagactccgtctcaaagatatatatgtatatatattttttctagttataggtatatctatttctagttagatatatatatttctagttttatatatacatataaaactagaaaaaatgtggattaaagatattcagtgaaaacttatgtagtaaaaattagatttggcatttaggaataccaaatctcacatatcccttaataaaggactgtttgtgtttatgaggccttccaatatatgtggcccccatttcagtgggcccctatgtaaaaatgttccatttaaagatcttaatgagaatgcaaaagaaagtcctttttttaaaatcaagaagtttatctcctttttctgtattgtaatgcaggttgcttctctctgttcttcaccccaatgcccctagttacttttttctctaatttttcaacttttctttgaatgttaaacacgttttcccctggataatattttaatcacttggggtattttttcctgcatccatttgcaaatgtacagtaacccaggatggtttcgattggtatggagccctgacaggagatggcctgagagcctcctgttagaaattgcacttccaggccaggcgtggtggcttaatgcctgtaatcccagctctttggaaggctgaggaggacagattgcttgagtgcaggagttcaaaaccaggctaggcaacatggtgaaaccctgtctctacaaaaaatacaaaaattagccaggagtggtggtgtgcgcctgtaattcctactacttcggaggctcaggcacgagaattgcttgaacccgcgagacagaggctgcattgagccaaggtggcgccactgcactccatccagcctgggtgacagagcaagaccctgtctcaaaaaaaaaaaaaaaaaaaaaaagttgcacttccagttgggcaggccatttgtgttgctgaaataaaggtgaaataaggtggcaaccagtggtaactggtttcagacaaaggatggctcatgataagtagatgttttgcttgtttttattcaaattaatgttcacaaatgtactatttgtaattaagagttgatgcagttgtttgacgtgctttccagtcttcccaattattcaacctcttgacctcctgattcttttttttttttttttttttttttttttttttttttgagacagagtctcgctctgtcgcccaggctggagtgcagtggtgcaatgttggctcactgcaggctccgcctcttgggttcacgccattctcctgcctcagcctcctgagtagctgggaccacaggcacccgccaccaagccccgctagttttttgtatttttagtagagatggggttttaccgtgttacccaggatggtccctgatccgcccgcctcagcctcccaaagtgctgggattacagacgtgagccaccgcacccggctggccgacctcctgattcttgatagatgactttgtccctccttttatgagaaaatcaaggctatacaaaatgagttatttcagctgggtgtggtggttaaggcctgttatcagcactttgggaggctgaggtgagaggatcgcttgagtctgggaggttgaggctgcagtgagccatgattgtgccactgtactccagcctgggtgacaaagcaagaccgtgtctccaaaaaaaagagttcttttaaacatctatcccttccacctaaattctgtcttccttggaatcctttccttgagaaagctgttgtctttctttcacaaaacagaccttcctctttctgcttgcttccatctccttaattggcctttcctttgttgcctacaaatttacttggtctttcttatcttaaatctacttattgaccctatcacccactccttttcactatcaaacttgaaagaagaatctgtacattcccatctccacctcctcacacatgttcactgttgaaatcatttttgcactagtcccagaatcgtctatggggctttatccaaacctttatccttcattccctgctgcctctagttaaaaagccactggtttgggcttttcttggtgcttaacctctcagtaaaacttactttcccgtggcaggtgacttttcccatgtcggttctgttcttgtagttttcagcctctgttttgactctaaaataaacaaatattttatccgctttcttatctccatcgctgatttcatttacctccattcaggtggcttcccaaatcagtatttttagctcatgtctattatcagtttcagacccgccttccacctacaggttttgtttgtttttttgttttttgagatggaggctcaccgggtcacccaggctggagtgcaatggcatgatcttggctcactgcaacctccacctcctgagttcaaacgattctcctgcctcagcctcccgaatagctgggattacaggcacgcaccatcatgcccggctaatttttgtgtttttatagagacagggtttcaccatgttggccaggccgctgtcaaactcctgacctcaggtgatccatccgcctcagcctcccaaagtgctgggattacaggcatgagccactgcacccagcaccacctacatgttttatacacatctttgtagctgtctcttctgtccaatactctttctaatactcaggtccagtactctgtccatcattgttaccttttttgggccagcttctctctgtcttcctcatatttattcatctctgtctcttccaattctggctcaaagcatctgttgttagttcactctttttcccctgccatcatattcagtgagttgttaaactatttagttctccctaggtttaacctcatgtgtcactttcctctgtgttctctcctttgcttctgccctggctcatgccctgtgaggtaaattattgttagctcctaattaatcttcccatctcttaccatcctgtttcagcttcctggattgcagtttgattgcttcacaatctctcttaatggttctctatattttcattgctccttccccttgtagtcaggttctgtcccttctggctctgacccattttctcagcattttctcccaccattcccattaaggtgaactctgggctacttctttgaaatcctttctacctcagatgttgtatctttccagaagccttctctggtcctcttggagtcatgtggactggacagttaaaattccttacggtcggggtcttacttctccatgtgttccctgtacttctcagcatagagtcttgtgctgagctcttgggctgaatgccatggcataaaattacatgtccacaacgtgttctgctcattctgatttttgttttttgagacggtgccttgctctgtttcccaggctggaatgcagtggtgtgatcttggctcactgcagcctccatctctggggttcaagcgattcttccgcctcagcctcttgagtagctgggattacaggtgtacgccaccaggcctggctaatttttgtatttttattagtggtgggatttcaccatgttggccaagctggtctcaaactcctgacctcaggtgatcgcccacctgggcctcccaaagtgctgggattacaggcatgagccaccgcacctggcctgctcattgtgttttattacctcctcagcattctcaggaaattttggcttttaacaataccttttaaaattttaacttgaggagctggtgcagatgttagttgagttacattggaagaaaatgtttttcagtgagtgtctcttgatggtataaccacaaaagggaaccaaaaaaggaatacagttgctgttagcataggcttgtggttctctaggtgtggtgcccaaaacagcagcctcacccatcacctgggggctagttagaaactcagattcacagaccccaagtcaggcctactggattagaggctctgggagcagatcctagcagtctgttttaacccaccctccaggtgatgctgatgccacttaggtttgagaatatctgtgtagtcctcacacatcttgataaggaatcatgcttttttgtgtttttttaattgagatacagtctacatactgtaaatgattcctttaaaaatgtacagttcagtggtttttactatatttgcaaagttggacaactatcaccatcatctaacttcagaacatttttatcactccaaagagaaactctgtacccattagtaatcactccctcagcccctaccaactgctgatctacttctgtctttatagatttgcctattctagacattttgtgtaaatggatcagttcatatctgatcttttgtgcctggcttcttttacttagcatggtgttcccaaggttcctccatgttgtcacatgaggcagtactttattactttttattgccaaataatgttccagtgtatagatacagcacattttgtttgtccatccattagttaatggaccatttgggttatttctactttttggctgttatgaatagtgcagatctgaacatatgtgtacatttttgtgtggacatatattttcagttatcttgggtaaatacctaggagtggagtttctgggtcacgtggtaactttttttggaaaaacttttccaaagcaactgtaccatttttacatttccattagcaatgtatgagggttccaatttctctgcatcctcaccaacacttgttatctctcttattatagctatgctagagggtgtggagtagtatttcattgtggttttgatttgcattggaatcatatatttttattttgtagctttaaatttttttttttatactagttgcctttgtttgttccagatatggttgtggtatgtgtgttttattgtgtttcttaaaatggcaattttgggagaacaggtatatatatgtatagataggcagagtggtttagaattcacatccaatttttgctaatatttcgcatcaactcctatttatctcgatgtattgcagggtggtggccttgtccatgtcacctgtggatgacactttcatttctgggtctcttgataagaccattcgactctgggatctccggtctcctaactgccaggtaatggtacctcacagttatactttttgagcattttctttggtaggcactgtaatgaactctacctctcaaagaagggagaaaacagtggttccattctgggatcacagggtctttttaaactttggagaaaatctgtttttttagttggtagctgctaagcacataccctaatctagtgcagattgcattgtactctgtggcttaattgttgtgggttttttgttgttttgttttgtttttgtttttgttttgagacagggtttcgctcttgttgcccaggctggagtgcaatggtgcaatctcagctcaccgcaacctccacctccagggttcaagcgattcttctgcctcagcctcccaagtagctgggattacagtcatgcaccaccatgtctggctaattttgtatttttagtagagacggggtttctccatgttggtcaggctagtctcctgacctcaggtgatcctcctaccttggcctcccaaagttctgggattataggcgtgagccactgcgcccagctggcttaatgtttttaaaagtgttcctagagcttttagcttcaagggatttatttttatttgaattctgtgtctgtaatattgtgcagttagagttgatcagaaattgttgtctggagacctgttttttaaaagcttcattttagttttatgttttttttgtgtgtgttctgtaggtaggctgatatttgtttgtatgcctttcttagttttaattgggaaaagtaaattatatagtggtaaggtcctggattcatttttttttccccattgtaccagcagtctttggttattccacgtatggttgtggcatgtgtgttttagtgtatttcttatttcttttctcttagggcctcatgcatctgcaggggaagccagtttgttcttttgatccagaagggttaattttcgctgcaggtgtcaactctgaaatggtcaagctttatgaccttcgttcttttgataaggtaaatctttgaatctttgagatctttgagctgttttttgttttgttttgtttttgagacagagttttgctcttattgcccaggctggagtgcagtggtgtaatctcagctcactgcaacctctgcctcccaggttcaagtgattctcctgcctcagcctcccaagtagctgggattacacgtgtccgccaccacgcctggctaattttttgtatttagtagagatgggtttcaccatgttggtcaggctggtctcaaactcctcacctctggtgatccacccacctcggcctcccaaagtgctgggattacaggcgtgagccaccgcgcccggccctgtaagagccttttctacaaaaggaaaaatgtggtagatattagagagtggcagagaagtagctcattctctgctttccttagtcaaaaagtaatctaaaggaataggatgggaattggctctagcagaagaaattattaatatgcctggggctactgttttttatcttttgcaggggccatttgctacctttaagatgcagtatgatcgaacttgtgagtggacaggacttaaattcagcaatgatggcaagctcatcctcatttccaccaacggcagcttcattcgtctgattgatgcattcaaaggagtggtgatgcacacatttggggtgagctgacagccttcaagcatggctgtttccatgctcatacttcctatgctaagaattatgttagctggttggtggagaccaacagttactcttgacttactcatgaaggcatgcacttgtattttcttcctgctcatgaacttacctctcttggatttcgtagatgttcatttctcaccaagtgacccaagtttggtatttagatataaaataatttcctaacaataaagttttcttgcccccttgagtatgccttgaatacagagttgagggtgggagtggattgtcaacgatggcaaccacatttggaagcttggtggtgtagtacatgacaaggaaagggtttcatggaaaggaaggtgatgcatgtgctgagtcagtgtttgtaggcagctgtttttattaatggctctgtaagaacaaaagaactgctctgttttgttttagggttatgccaacagcaaagctgtcacactggaggcttcatttactccagactctcagtttattatgattggtgagtttccttttatcccctgtgggggttatttctctggtactatgcatttctttgtttaaattattaactgagacattattatctatttgatagatgttcttagatttctgtatagcacattatgccaaggacatagtgtcttttaactgccctgactggaccaaaatttgagttaaactccacaagcactaccttattagtaatgctaatgtcctggtgtaaccctacattcagtcatcttagtggctgcctgttggtagggtaatggtattcggccccttttttagatgagaaaactgaagttagaacggaagtgacatgcctgtgaacaaatagctagggtcaagataaatttccaaagtgtccttccttcactgcctctcctccctctcaattttgcctgagggatgggtcctaaagcttggcgtatcctcagatctcaatccatgtctcatttccagttgtctttgtattgcgccttgagctgttacattttccgtgaatatcctctttaggttcagaggatggcaagatccatgtctggaatggagagagcggtataaaagtagctgtgttggatggtaaacacacaggcccgattacctgtttgcaattcaaccccaagttcatgacttttgccagtgcgtgttccaacatggtatgtgaacagtaagaggtatctgctactcagggacccttcccagttggggtggtgggtgcctcaacaagcacagcaagctgtgttctacataggtacattacaagcatccaagtacatgtttctcaactggtggtttccctatttcatctcctattatttgatctctggctgggctggtcttgcctttcatttttattcttcctagaggtgatcaggaatcatctttgagttccaaggagatcataggccagtttttgctctggaccctaattttaggtccaaactacctgggctatgcttggcaatttttttgctccttaaaatactctgaaccggccttttgtggtttcagttttccattcctgttggtttacgccaaattcccagaaatttctacagttggtcataactcaccacttagaattaactccaggcccttatctcttcctagataatactaacagaacaaaggatcagtgagtctcagctccagttttcccttgtgatctcctaaacctgcctgggtattcggggatgagacatttcattactagcctacccggagcacattgccaccttgctttttttttttaaccaagaaaaaaatgttagaaaaaatacagcaaaaccatccagttccttactttttacagcccaggaaggtgggggcctgttggaggtaacctggtggattagcaatgaggacaggttacttattcacccacctcccaggcagcactcctttttttcccttcctttaaaaaaaagggggcggggggtctgctttggtggaaggtggacagtgattattggagaaaaacagaaccattttactttcacatagaggaaagagtgtttctgtctccttagagcatcggggttggttggttaggagagagggctaccagagccactggggttgggcacatttttgctgtggggtgggatgtgaagaaccgttggcagtgaggagatgcttggctttttaaagttgatttatgttctccttctaggccttttggttgcccaccattgatgactgaccctgttgctgcttggctatttctgtatagtgagggcggccagcaggaagaaactcagagggaactgagataatagtgggattggatcatttgactgggctggagaacatccttttacatggccttcccatggatgtgctgtacatctgctcaaaagaaaataattactttgatgagcgtcttcaaaaggactcttggtgcaacagactcaattggaactcagcttttctaactgtcactgcaccaagctctgctggaggagtgaccagactcacgatttggtatagtggggctctcaagcatcttcaatttgaatgtacatgctgctgaggagccggtgaagtcatcagttccgcacatcccttctaccctccaactgcatgggaagccaaagtcctggttttgaaatgcttgggcagctcagccgcttgccctcaccctgcatgtcttgttactgggtctccctgtgtacttgtggcattatccacaaccatcatgtttcttaggtgccaaacatttacagaaacattttcatatatcttggggtcagagaaagggacagatacagaaggaccttgcttgcaggaagccatgcagttagtttctgcagttagtcgtgtgaggctaggtggttgggcaggcctcgggctgtaggtgttgggtgggaaaaagacccaagggcctgaaagggagggaaaggggagggtagcgggagggtagcaggtgagttcctagggctggaaggtttagcagcagcctggtgcagtgccctgtcatcaagacaaacccacggtcctcctgggtgcctaccaagcttggtttgtacaaaagcaaggtgggagtctatttttgtacatgagatacatcacacttacctgtgggccagtattgtgaagtgagtctgagttgtttacactgatgccttccctgcccaccacaaattgtgtacatagtcttcagatgataccacccctttccccagctcccaaccaagagctggttctaggcctgtgttatatgtcatatttagcgtttttatatatgacctttgatttctgttgtttgtattttagcacagtgtatgcaccttcatttaaatacatctgtgtgcatacagatacgcatatatgtgtgtgcgtatgcatatatctctcatctgtagtttccaagagttcagctgaagcagatggagtcctgcagcccaggagacaccctgcatccctgctaatagtgtttgccacaagtattagtgagtcttccttattaatattttcatttcagaagactgaagcaaagctgatagtgtttgctgtttctttggcagctaagtgagggtcttgggatgacttgctgtgttcctcaagctgcactttggggccatctctgcagtattagccccctttttgcttggtggtactctgtctgtgcctgtgtgtgtgtgtgatagtcactcttgcatggcttccatgtctggtttgtggcatttggggataaggtgctgaagccagagcatttgcagtttgtttgaggcctcgttgccaatgatagatcactcctgttgacctggtatgtctgcttgcttgctgcttttccttgctttctcttggaagaggaaaggactctggtcaggcccaggctgagtgagatgagctgcagctggctcatggccttcttagagcagagagaggagtatgtcattttactaagttcctaaacaaacatttatgcaggcaacactccttgcagatccagaaactgaggcacaatagggttatgacttgctcaagaatatgtagctgctagggggtaaatcaaggcatcacaatttctgttcagcgggcaggaataggctgtgaattgctagcactttttttttttaagcaattactttttgacttgttcctctgaaagtgcaagaggcgtacacctttcccaaatgtagactagaatctgcaggatgccacccactgtatagttctgctttcccagagaggaagaacttttagaaaccaaatgatcttaattgttattgcccacccctggcttttccgggtagaaaattcacagtaggaatgattgttaagagagagtgcttggaaccatgggttaacaggaaaggctacctaacttcacatatctgcaaccagagcagccaccaagcattacttagcagcaggaaaatgattgtatttgagttcctgtgtgtccaaaactgagcaccatgttctttgaaaacatgccacctcaaggctgggcgcggtggctcacacctgtaatcccagcactttgggaggccgaggcgggcggatcaccggaggtcgggagtttgagaccagcctgaccaacatggagaaaccccatctctactaaaaatacaaaattagccgggcgtggtggcatgcgcctataatctcagctacttgggaggctgaggcaggagaattgcttgaacccaggaggcggaggttgcggtgagttgagatcgtgccattgcactccggcctgggcaacaacagcaaaactccgtctc

SEQ ID NO: 36021 - DNA, 15205 bp, Homo sapiens
aggtggctgtggcgagagacagcactttgtaccgtacccgtcggacccggtgagctggaggggcgagctttttattggcctcgaggcccggggcacggggaggcgggccgtccgcggctgtcctagcacctccgcggcagcagagggccctggcggcggctgcgggtcgcgcggcgtgggtgacgggggtgcagggcggggcctaacgagcagcccccgcaggggcggagacgagggcgggccggaggcggaggcgcggcctggagagggatggggcggaagcggggcgggcggtgcagcctagcgaggggcggggcggacgaggaagcgtgacgagcggcggggcgggtggagcagcctggcgaggagcggggcggggtgggcggcacggcctgacaaggggcggggagcgcaaggaggcctgacgaagggcggggcggagcaagggcgggggcagggcgagtagtggggtacagcgagggccggagcggatgggggaaacctggtgaggggcgggacaaagcggggagggcggtgcagcctggcgagaggcggggcggacgaggaagcttgacgaggggcggggcgggcggtgcagccctgcgaggggcagggcgggcggtgcttcctggcgaggggcggggcggggcgggcggtgcggccaagctaggggcggggcaagggcggggcaaggcgggtggtggtgcccagcgaggggcggagcggacagggtaagcccgccgaggggcggggctgaccgaggtgggcggggcggatgccgaggggcggggagaggtgggcggggaggccaaacatggggcggggcggcgcggccggggaagcgtgatgaaggcctacgagtgcggcgcggcctgaaggggcacgcgggggacctgcaaagctagtgaggggcggggcaggcggcgcggtgggggcgggccgagcccggaggccagatgagcggacacagccccacgcgcggggccatgcaggtaagtggctcccgacggccccacttgaatttcgatcccagaccgggtccggcgccctccggggcccaagcttagcgcggtgctgcagtggggccgcctgacccaaagcgaaaccgaaagccccgcggagggtgacctgacgactttcccgggactggaagggggagtcctgcgagagactaggtgggtgcgagagaggagtcagggtgctccttggggtacagggctttggctccgggctgggtacgcgcacgtgatgcaggccgcctcagagtatggggcccgcttgggatcccggagtttgggagcagaacaggatttcctagctgggcagggacatgggggcgggacttagggagtcgggctaaagttcggattaaggggcgggcctggctcatgatcctgggccggcgggctgaagctttcaacggagtttcagccctgggtttgggtctctcggtggggacgggcggaagcagaggtctgtgccttagagtggtcacttctgggggtggggatgggagaatcctcggaacctgggtgaaaggtcaggggtcccagaccttgtaaaagtctgagcatccccctcccctaggtggccatgaacggtaaggcccgcaaagaggcggtgcagactgcggctaaggaactcctcaagttcgtgaaccggagtccctctcctttccatggtaagcggtggccagggcaagggaggagggtggaggctgatgcgcccttcaccagcttccatcgctgtgagagggtgcttttcccacagctgtggctgaatgccgcaaccgccttctccaggctggcttcagtgaactcaaggagactgagaaatggaatattaagcccgagagcaaggtactgggggtggggtgggggtggaaaggcaggtccctaggctggtctccaagccctgtgtgccagctgagtaatgcaactcacacccctgtctttcctccccttctcctcagtacttcatgaccaggaactcctccaccatcatagcttttgctgtagggggccagtacgttcctggcaatggcttcagcctcatcggggcccacacggacagcccctgcctccgggtaaggaactcggacggtgttggggtgggaggagatgtcagagggagtacagggcaaaagagaactaggaggtacaaactggggcctctatcccctggagtaagggagaaggtaaacttgttggccccttccttcacaccttgagcctttcatgtgacactaatattcgctgtctgttacttatgagtagccaaagtctcatctccacatatcgtcatgaagccttctctgacttctccatctttacactcaggtgaaacgtcggtctcgccgcagccaggtgggcttccagcaagtcggtgtggagacctatggtggtgggatctggagcacctggtttgaccgtgacctgactctggctggacgcgtcattgtcaaggtgggaaccgaggttggggatggcggagcctcctcagaagactgactgccacactcctcagggtacccgtggggaagaggggtgggggcagtctggtcagaggaccaccctgcttagtctgagtgaagtaaagactgaccactggggtaggaggcaccctgggctgacctggcctggctggctgcagtgccctacctcaggtcggctggagcagcagctggtgcacgtggagcggcccattcttcgcatcccacacctggccatccatctgcagcgaaatatcaacgagaactttgggcccaacacagagatgcatctgtgagactggggcagggctgcggtggctgggagggatggagaatggtaccaggtgattattacctaatggtagccattaggtcacattttactcttgggacccagttaatttctaagggtcctcacagccttgtgatttggggagtgggctgggaattgaagggcagaggcagttgcccatcaggaggcacctgaacttatggatgccgcactcagctgtgccctcctcgcaatccccccacaacccacgtctccccacagagtccccattcttgccacagccatccaggaggagctggagaaggggactcctgagccagggcctctcaatgctgtggtaagagagtctcctgatcatggggagggcggcagagtcccctgagaagtggggaggagaggaggaatggactcttcccagcatctttctgctcttcaggatgagcggcaccattcggtcctcatgtccctgctctgtgcccatctggggctgagccccaaggacatagtggagatggagctctgccttgcagacacccagcctgtggtgaggactggctgtaggaacctgtgggtgaagggcctccaggatcctggccacccctagcccgtcctgctgaagcacccatcacctccaccaagccctcagtaactctcatccccgtttttcccagtagacacatcccccactgcttctagggcggtggttctcaaaaagacaagttccctaccccagacctgcccactaggactatctgggaattggccctttttacagattcccaaagagtttcttctacaggtgggccctgtctgctttgacccacactgacactgaactgcttagggaaagaggcctggatgtggccatctgttctctgtctcccggttgctgatggtcagagattgctaaatctttggatgctgtgtcctgcttgaacacgtactaagtttctgttttttggctggtttcctctgtttacttctttggcctttttgatgacaattcagcccttccttttcttgacccacaggaagaggtcaagagctattggcctccacccttttgttcctcagcaccaacccagcccccttctccaatctctgcttggtcctgcctagcaaggaatcccagcactttgggaggctgaggcggggggaatcacatgaggtcaggagttcgagactagcctgaccaccatggtgaaaccctgtctctaataaaaatacaaaaattagctgggcctggtggtgcatgcctgtaatcccagctactcaggaggctgaggcacgagaatcctttgaacccgggaggcggaagttgcagtgagccgagatcgagccattgcacttcagactgggcgacaagagcgaaccttcatctcaaaaaaaagaaaaaacaaaatagtgccctaagccaggggtcagggagaggttgcgcaagaaaccaaggagacccttgggagcaaaagaaaggtgagtgggggtggagggttgaaggtcgggctgactgtcttacctctctaggtcttgggtggtgcctatgatgagttcatctttgctcctcggctggacaatctgcacagctgcttctgtgccctgcaggtgaggagccggggcgccccaggcagcacataaccaccagcagaggtggtatgtttggggtcgggggagctgcctaaagccccagcaggttgtgagagagggccattgtctacccgctcagtctgctggtgctggatggaccaggagggggccctaaatgttgcagcctcagcatcgccacctttggtctctgcccttgcactatcagggtgttgaggcaagaagaaggaggagaagttgtttcaggcaccatggtctcttgtcctagccttgctcctgctgcttttcctgaagttaacaacctctgcctcagggaaaggctttatcatccacaaggcagtatcatccacctccttctgcttcctacgccactccccaggcttaagaccccagccttctccctgtttcttgggatctcagtcaggtagcctctcttcctagtcaccttgatattccccaccttctctccaccctagtcagttccctttctttctctcctcttgcccttgatctccctctgcctttttctgcctttccttccctgtaatcctgtggctggagataggctttgggctgtaattgagaccagagctggacctgggacctgcatctacttctgcaggcaaccagccagtcatgtcaccttgatggagtctgtcacctctttgaacctcagtcttttccctgaggccaatcagtttatgtgatgtgtgtagccttttggctttccaggactctcagctcttcctctctgtcctccacatcttctactgccttttgcatgggaaggtagagaacaacacccaaaggatggtgtctcctgtcccagttgaaaaggtttctacctagctattgatctggccaaaaaaaaaaagaaagaaagaaaaaaagagaaaaaaaaggtcctcaccacaccttaaaggtttctacctatgtagctatttatttggcaagaaaaaaaaggtccccaccacaccctctgccaggcagtgccctaattgataaaagtcatggccatggaaggcagacaggggaatgtgcacacccaaggtgctggtggatgggggagcgtgcacacccaaggtgctggtgggctgagttccagcagaagcaggttggagatgatgctctcatttccttccctgaaccaggccttgatagattcctgtgcaggccctggctccctggccacagagcctcacgtgcgcatggtcacactctatgacaacgaagaggtacgtggagggttctggggagggtcacctctgcggagtcttccacagccaacttgttgtgccaggcatccaccgtgagccagggctcttctgggggccccaagacaggggagatgctgcctgtgcctccttagcacttggtgtctcctctgactcaacatagatctgcttattcgagggtgaccgtctctcctgtatctctctttgtgccacatggtgagcttcttcctttaggacagggactctacccagcccatcctcgtagccccagggctcagcacagagtaggtcctcatgatgcctgcgtgtgtgaggctgcagtctcagctgcataacagagcttgaacagctagtgctctctcatgtaacaacccaggtcagagttagcagtttaggaggggtccctgccgtcctgaacacatgacttccatttcaggattcagggtggccgttccagctctggccatcatgtctacactgagttagtaggaagggaagagagggcaaaggggcagtagacaccccctggctttaagggcatgatccagaagtgacattcatcactgcttacattccacagaacttagctgcaggggagcctggaaatgtcatctctagctgggtagttaagtgcttagctacaacttgggtgttctaaaagatatcatggacagttagcagtctctgtcatacacataaaagaaaattgaccagtgtggtggggcacctgtgctgagccccagatgtgagggtcacgagaggaggaaggggagcagtgcaggaaacccaccagtactgttaagaatgtgagttagtttggtctcagcccactgtctggtgttcagtgacgaccccaggttaggggtgttgctaagaacacccagtgactcagtggggttttgggccagttgggcaatgggcccctctcactggcttccaagatcaggcccctaagcccagattcccagagtcaggactctactgtcgccaggtggggtctgagagtgcacagggagcacagtcactgctgacagagctggtgctgcggcggatctcagcctcgtgccagcacccgacagccttcgaggaagccatacccaagtccttcatgatcagcgcagacatggcccatgctgtgcatcccaactacctgtgagtctctagtgccagtcacacagtcttcacatagctggagacccaagcataacctgccttgaggctctgccttggccccagcctcttcctttctcccttcttcattctgccgggaggttcacgggcacttccttttcactactgcgagaccaacttggtcaaagtcatgcaatgcctaacccaggtgtgtggaatacacctttgtctacaaacttgtttccatctattgctagaggctgcccggaaccctgtgtgtggaatgactctgaagtcccactgggctgggcgggaaagagtggtgatctattagtgatgtctgccatgggagggtggtgagtgtcgacaggcctgctcctgtttgctatgtctggcccttatctgtctcttacagggacaagcatgaggagaaccaccggcctttattccacaaggtgagacgtgccatttctccctagggacttggaggtctggctgttccgagcgccgactcattccctttgggcctgtcattacctctgcctcaccttgactctccccagggccccgtgatcaaggtgaacagcaagcaacgctatgcttcaaacgcggtgtcagaggccctgatccgagaggtggccaacaaagtcaaggtccccctgcaggtgagggtgggccctgcctgggaaggtgtgatggagggagcttggtgggggcacaaacagatgggccccccatgaacagggaacctggtagatggccttgagtggaggggggtcccagtagagtgagaaaagcagggattttggatacagctggattccatgctggctctgctgcagtgctagctgtgtgaccttggactagtctcctaacctttctgagtctcagtttccacatctgtagaataggggtgatagtgatgcctactttgctggatttctatgaagactgaaggtacagtgtgctcctggcacatggtaggcctgtctttccctgcagcacccccacttcccctgtgtctcctacacaccctgggggcttccacagggaaagttcagggctggggagtatggaactccaactactcattttctctcttgcctgagaaattagacatctagtcctttctcctcagtgtgtgtgtgtgtgtgtgtacatatatatgttgtatacatgtatgtatataacacatgacagtattgtgtatacacatatacacacatatatactgtcatgcattgcttaacaacagggatacattctgggaaatggcatcattaggcaattttgtcattgtgtgagcatcatggagtatatgtacacaaacctagacggacagcctgctgcacacctaggttgtgtggtgtagcccattgctcctaggctacaaacctgtacggcttcttactgtgctgaaaactgtaggtaactgtaacaaaatggtcagtgtatctaaacatagaaaaggtacagaaggccaggcgtgttggctcacacctgtaatcccagcattttgggaggccaagacaggcagatcacttgaggtcaggagttcaaaaccagcctggccaacatggtgaaaccccatcctaccaaaaaatacaaaaattaggcaggcggagtggtgcatgcctgtagtcccagctacttgggaggccttccctacttgggaaggatctcttgagcccgggaggtggacgttgcagtgagccgagatcgtgccattgcactccagcctgggcgacagagtgagaccctgtctccaaaaaaacaaaaccaaaaaaaaaaaaaaaagaaaagaaaaagaaaagttacaggaagcatatggtataaaagatttaaaatggtccacctgtatagggcacttaggaatggagcttacggcactcgaagttgccctgggtgagtggtgagttaatgtgaaggcctaggacattactgtacactattgcagactttatcaatgccggacacttaggctacactacatttattttgaaaattgtatttcttcaacaataaattagtttactgtaactttttaactttatttatttatttatttatttatttatttttgagatggagtctcactctgtcacccaggctggagtgcagtggcacgatctcggctcactgcaacctctgcctcccaggttcaagcgattctgcctcagcctcctgaatagctgggattacaggcacgcaccaccatgcctggctaatttttgtatttttagtagagacggggtttcaccatgttggtcaggctggtctcgaactcctgaccttgtgatccgcccgcctcggcctcccaaagtgttgggattacaggtgtgagccactgcacccggccaacttttttactttataaccttccatttttaaaatttttgactcctttgtaacaacagttggcttaaaacacaaacacatagtacagctattcaaaagtattttcttttttgtatccttattctgtaagcttttttctatttttaaaatttttcgttatttttaaaatttttaaactttttggttaaaaaccaagacacaaacatacacattagcctaggcctatacagggtcaggattatcaatgtccctgtcttccacctccacatcttgtctcactggaaggtcttcagggagagtgacatgcagggagctgctatctaccatgataacaatgtgctcctaaaggacctgcctgaggctgttttacagttaacttttttttttttttctaataagtaggagtacattctaaaataacagtaggctgggcatcgtggctcatgcctgtaatcccagcactttgggaggccgaggcgggtggatcacttgaggtcaggagttcaaaaccagctggccaacatggtgaaaccccgtctctactgaaaatacaaaaattatctgggcatggtggtgtgcgcctgtaatcccagctactcaggaggctgagacaggagaatcgcttgaacccaagaggcagaggttgcagggagccaagatggtgccattgcactccagcctgggcgacaagagtgaaactccatctcaaaataaataaataacaataaaaagcataatatagtaaacacataaaccataacatagtcatttattattcttaggtattgcatactgtacataattgcacgtgttatgcttttatacgactggcagtagatttatttacgccggcatcgccacaaacaagtgagtcatgcattatgccacaacatcgcaacagctgtgatgtcactaggcgacaggaatttttcagctccattataatcttacgggaccactgtcatatgtagtctatctttgactgaaatgtcaccatgtagtgcatgactgtctatttctatatttatctgtctacctctctatatcagggactcaggcatgggcggtccagtgacaatcatagcaggtgtagaaccgtggtatcctgactcccagcccagggctctttctgctgcacagtgttcactcttcctttcggaaagctgaattgttctgcccccaggaagccttctctgaggacgtgatatttgagctgagacctaaccactgagaaataggcagctatgggagggtcccagccagagggcacaagtagaaaggccccaaggggggccaggaatgagctcgtcttttaggaggagagaaaggcaggatggtagagccaggatgagagcaggagagggttaggggagaggcccagctcagtgatgatacaggaatacctaggccatggaaggacatttcaattttattctaaggcagtgagaagacattgggagatttttctttaataatttacagcagaagtaggacacatgtattttagaaaattagaaaatacagatagagatgagaaaataaaacactaatctgcagaaatttggtatagtcttccagatttttttctatgcataaacttcatatacacttttttaaaatgatattatattggatatatttttgttgcctcttttcactcagtcatcttcacctttctatttgagtttggtttttttttttaatgtttttttaaaattagaaacagggtcttgctttgtctcccaggctggagtgcagtggcatgatcatagctcactgcaccctcaaactcctgagctcagaagatcttcctgcctcagtctcccaagtagctgggactacagatgcatgccaccatgctggctaattttctatttttagtaaaaatggggttcttgctatgttgcccaggctggtcttgaactcctggcttcaagcagtcctcccaccttggcctcccaaagtgctaggattacaggcatgagccaccattcccaaccccatttcaggaaattgttgtttcagtaaacttgtacctcatctaatgcacagatcactttccgttttccccagttatcctcaaaatattttttttacaggtatttggcccaccctagtatccaactcaggacaatgcgttatatttggctgatatgttgcttaaatgtcttccagtgtagcacagttccccccacccctttttaaatagcattggcttattcaagaaacttctggatatgtctccttgctgccccatggtgtcatttagcttgtctgtaagccccgtatttcctatcaactggaatttctaaagacttgatggattcaagttaaacttttttttttttttttttttttttttttgacagagtgagagtttcactctgtcgcccaggctggagtctaatggcgtgatctcggctcattgcaacctccgcctccctggttcaagtgatccttctgtctcagcctccaaagtagctgggattacaagtgtgcaccacgatgcccagctaatttttgtatttttagtagagacagggtttcaccatattggccagactggtcttgaactcctgacctcaagtggtccgcccacctcagcctcccaaagtgctgggattacaggtgtgagccaccgtgcctagcctcaagttaaacattttgggctagaagacatggctggtgtattcatatggcatcacacacatgatatctgggtgggccacccttagccttgcaaagattgaccactggaccaggaatggcctcttatcctttcattatatagtgcttttcccctattgacctgacagtgacccatacaagtgatgagttccctattaaccagatacctaatggttttaacacttacaataatccttgtctaaatcagtaatttcattagaatttaccgaaaaatgcccgcttcccctgaattctttcagtcttccattcttctgtgaagtggaacttcttccctccaatcaactagggttctttggttatcatggaatatcattcctattgattggaaagcaggataaatgctaattctttctgttatccacttttcaaggtgaaatgtcgtctcaaatagtgacaaagaaagatttttccttttcctttttttttctttttctttttttttttttagacagggtctcgctctgttgcccaggctggagtgtagtgtcgcaatctcagctcactgcaacctcctccccacaggtgcaagagagtctcatacctcagccacctgagtagctgggattacaggcatgcaccaccatgcccggctgtttcttgtatttttaatagatacagggtttcaccatgttggccaggctggtcttgaactcctggaatcatgtgatctgcacaccttggcctcccaaagtgctgggattacaggcgtgagccagcacacctggcctgcttttccctttctgactatcttagaatcatggaatttcatttattcagtgtcctctataattattatatttgatttgtgaattgccatggctttgaccagtgggagccccttcagcataactcctgtgccctttgactcttggaagtctccttgctttttggcacaacaaaaattgtagacatgtcttgttcatttcgccccccagacttggtagtttttggcaagcagtggtattagagaccatagcctggcactgcaagtgttcattgttcttgggggaggggacggtgctttgggtccatttccatggacatagcaagaaaaaagtacatattttaaaaatcatgaagccaggtgtggtagctcaggcctgtaatcccagcactttgagaggtagtggatcacttgaagtcagaagttcgagaacagcctggccaatatggcaaaatctcgtctctactgaaaatacaataattagctgaacgtggtggtgcgtgcctgtaatcccagctacttgggaggctgagacaggagaatcgcttgaacccaggaggcagaggttgcagcgagctgagattgcgccactgcactccagcctgggcatcgcagggagactccatctcaaaataaataaataaaataaaataaaaatttttaaataaaaatcatgagttaatactgtaattcttattcataaaattattcttatttagttaaatagttactacctatttgattttgtaattctgttttctcttacactgaaaaccttgatatctagcatcatattttcattttcttatttttttaccataatataaagaaaatcatttcaaaatgtcagtagcaatatttttaaagacactgataccactgagtgatttttttctgtgagtgtggatattaagcaagagggtgacaaggatggatacttttaaaaatcccccttcctgctgtgtggagaatggattggaactagggtggtggcaatgcagatagaatgggaccaattcagaatatattgtcctttggggtctgccatttagcattggctttgattttatgctccgaatggaccatctcccaggccccttcccaccctgcaattctaagatggcgtcctccttggctctgataagcacacactgcatgttgctcatgggtctcctgctctccctaggatctcatggtccggaatgacaccccctgtggaaccaccattggacctatcttggcttctcggctggggctgcgggtgctggatttaggcagcccccaactggccatgcactctatccgggagatggcctgcaccacaggagtcctccagaccctcaccctcttcaaggtaacacccaccccagaccctctctggcagctgggctgcttcccctctagtgcctggattggttgctgggacaacatcgccatcacaaagtgactggcctgagtaatgggggctggttgtcatgctggggccatgtaggaaaacaagggtcctggccaaccacagtggctcatgctataatgacaacacttggggaggtgggaggattgcttgaggccaggagtttgagaccagcctgagcaacatggcaagtccatgtctctacaaaagagaaaaaagagataaaacaacggtccttattcttctcaaggctcaggggccctgacccaaagaaatggaaaatgaggggatgggaagaggggatcagggctgagaagactggggtggctgtcaagaacagatgaaacctcggtgcttctcttgctggaacatatgttggtgggaggtgggtggcaggacatctccatctggtcactcactaattccaaactccatgttgcctcccattatagggcttctttgagctgttcccttctctaagccataatctcttagtggattgagccctcttggaaagacttctctgccatccctttgcacctgagaggggaagttctcagctgagctgaagctggattattaaagtggattgtcactcagactctccgtgctacgcttatttggagactagaggagtgggagttgagcctggcttgaacctttggaaccagaaaagttggggagcaggtggaggaggccacactcctgggagctgatggttttaaatctggttttaaatctcttctctgtctcaagtccatgtctgaagtgggtgaagggtggactggatcctcaagcagaaggtcacttctcccacccctagtcctccacctgggaaatggcctcaacggtcttccctctttccatccccagaatgggtgtcccgctctgccttcagagatcctgttctgcactgggccaccttcagagctgctctgggcagacaaagctgtttctcaccctcccaaaatcccttcccatcccctctcaggagctgcaaagagaagggcacagtctataccttatcacccttcatcatccacttctcagcagtccctggtattacttgattgtgaacatattatcaggaaaaaagattatcattgaaaaaattggaaaagtcaaagtctggccgggtgcagcggctcacatctgtattcccagcattttgggaggccaaggcaggtggatcacttgaggtcagagttcaagaccagccttgccaacatggtgaaacccatctctactt

SEQ ID NO: 36022 - DNA, 89716 bp, Homo sapiens
cggcgctgctggaagatggcgagcggccgggacgagcggccgccttggcggctagggcggctcctgttgctcatgtgcctgctgctgctggggagctcggcccgggcggctcacatcaagaaggcggaggcgactaccacaactacgagcgcgggcgccgaggcggccgagggccagttcgaccgctactaccacgaagaggagttggagtcggcgctgagggaggcggcggccgcgggcctccccggcctggcccgcctctttagcatcggccgctcggtggaaggccggccgctgtgggtgcttcgcctcaccgccggcctggggtcgctaatccctgagggcgacgcggggcctgacgctgccgggcccgacgctgcggggccgctgctgcccggccggccccaggtgaagctggtgggcaacatgcatggcgacgagaccgtgtcgcgccaggtgttgatctacttggcccgcgagctggcggccggctaccgccgcggggacccgcgcctggtccgcctgctcaacaccaccgacgtgtacctgctgcccagcctcaaccccgatggcttcgagcgtgcccgcgagggcgactgtggcttcggcgacggcggcccgtccggggccagcggccgcgacaatagtcgcggccgcgacctcaaccgaagctttcccgaccagtttagcaccggcgaaccccccgccctggacgaggtgcccgaggtgcgcgccctcatcgagtggatccgcaggaacaagtgagtgttgcctgccccctccccgtccgtgtgagcctccaagggccgaggctggttccggcacccagtaggcgctcagacaatgctggcataaggggtggcggtggtgaaggtgaagggagacaccctgtaacggggacagggcccaggccgcgtagcctcccgtcctgctaatcatcaaagaattgcctcctagaggctgtcatttgttcaagggatggctggaggggacactcctttctgacatttctggtccctattcttacaggggcatagaatatgagcgagaagagatcttaaggataacctaggtcagctcacacattttatagataagctgtcaatgttgttatcttatatcaaaagtgcctaatgttataggcgctgtgctaattttttctgtgactgcagtatctcactttattttggccacaacctgatgtcatagacaccatcagttttgcatacggggaaattgagggtcagattggttaactgatttacataggagtgtggctgggacttagaattaggcaatctgattcccgatagtcctcttagccacggagggacactggagcccaaaaatggcagatgatattcccaggatcttccccttgcctatttgacagaagctgatttttctccaatttttacctctgactcagcttaagaagatatggacttagctggagaacttgcacagatctgtgagccgcttcattttagactctgaagggtttgtgatgtcatttgtgcaccttattagcctgggcagaatggctaatggtcacacttctaatacacactttaagtgttattaagcattgcatgaggtttaaaaaattacaaagtagaagaaggaggacctcaagaaattagtataaaacaagagaatgttataaatatttatgaggtatgttggtgtacccagttaaactttacaggaattgttcccactggcaagatgtgtgtgggctgcaataacacggaccatctctgtggaagaggtagagcttgagctatctccagagatgggcaggattttcagcaaaaaggagaggaataaaataagagggaactcactccagatggcatagtgtctgaagtgagcaggcatctcttccccttttctagcatcagcttttccccatttttgtatcttcataaggcttttgaagcaataactgatcattccatctggattaaaagaagatttctgagggactgctaagataaagaagtttccctgcgggacttggaatcatttcttctacaagatttcagtcatatatagaagatctagaaaattcttgagtgttaggacagttcctgagtcttttcgtcttctatcttttactttactcctcttgataagctctcttgtagatatataatttcacatagactttctgggaggatttttttttcttttaaatacgatcgtgtcatcacctctgaacatctgcgtaagaaatatgactttgacatacacttattgacagagctgtgatggccagggctttttggagatgatacaacaaatgcaccgtttgcattgcttaaatgtttaaaatgctctgtccttgcacctttaaaatgctgtgatccttgcagggatgtaaattctgtgcctggatttttcttttcagtattagttgtgctgtgaccaaatatgaaaataagctttttcttggtgcaagtcgccttgaggctatacagagtcattttggtctgtggctgtggactaccctaatcatatctgttcttcaaatatgtaactctcattaatcaaaagggaaagtaggtgatcatatatggtaaagagtacatccatcctaactcagtcttcaagaattcactcaaaatgcgtactctgtgctattaaccaataacaaaggacactgatatgtgaataaaattaaaaacacaagcacacacacaatttgatattgatgcctaaatatagtgtcaactttatggatgggatatttttaaatactcaaacattagtctgtatgggaaaactacctttttcagtgtattttgtgaggtaaaccatttgagtaatttcttgatatcctattcacccagctatattcgaattagatttttgttgttatttcgaatatgtaaaattttaaggcttaatttcctccagcttgggaaaatgaagtttattttctttgtttcactttatacttcatccaatggatgttgagacaaatacttaagaaaatatataaaaaaattaactttatcattcaaatgaagattttatagttgactcctatttttttatagttgaccgctatgcttctttaagtgaatatacctgcttaaattttcataggtaattagcatataaatgatatttgaatgtgtttgtgaaaagcattattacagtgttgagagtgggtgcagatgatttttttgggggcttatgtatacatatctatgattgtctgaatctttgaaatttagtttgtcagatatcaagttatcttaatttttttcaagttatctacagggttacctggatagcgtaatagagttaatttagagattaactgtttaatatttataaactcatttgtaatatctctaatatatttaccagctactttaaatcttatgcaaggaatgatatgtgatactgaagtcaagtatgagaaacatttcagagaattgatttgaatggaaaccataaagtacctgtcaaataagattggagttgatttgcaaagttgatttgacaaaaactcaaagcataatcttacagccattgtagtcactttctcttgaaatcttcattgtaagaatgacactggtactttcaaaactgtgtaattacagtaaggaaaatcgaagtgaattttattactcaagtagattgcaaatatttcattgttcaaaagtatttgattaggccattttgacaatatttctgagaagtgttggaagaaatgttgaacaaaatgagaaacagcattttgtagagaatcttggattttaaagttttacttaacatgtgtaattaaagtagcatgctttacttatttagaatatttaattatccattttattttactagaatatgaatgcccagagggtatttgtttgtttgtttcgctcacagatgtatctatccctggaatgtcctttgggatgtatctgtccctgaaacgtcatttggcaaatagttgacactcaagaaatgtttgttgccgaatggattacctgacctgccccagccttcttataactttcccagagtcagtgggggaaaaatacttaaaaattgttttagaattacaaaccagagagtaaattgttaataccttagctataggggagaggtggttagagtggagttagaaagttagaatatttacttagtttttgtttctgtatcattctattacccaaggactggcagtggaagtggggagtagaatgatagtttgtaaggcagtgtttccttaaacaggatgctagatacctccaaagaaatgaacatttgttgagcaggggctataaagtagtctttatgccagattatgtttcatgtgtgttatcttaattttcatgacaactctgggaaatgggtagcattaatccccattttacaaatgaaaggaaaactgaggttcagcgaatttaaaggcagtaacttctcctgattatgttatattactggtgagcaacagatctgggagacggaatgttcttacccaaatttgtctccaaagcctgtgccattgccactacaccaaatggcattcttctctggtgtctggaagggtgctaattataattatattagtttttagctagtttcttttcatggtctatgctagtgtttaatcagtgtccttattggcaaagatctgtcttctgatgaacagattttgtgttacaagtaattttcattgtttgatcttctctgggataatactactcatcatgcttaaaatagtctttcaaattagacatgataggtttacttttttttcaagcatatagaaaaatcttatatatcaaccccctttagaatttctgtaggtcagttaatttcaacaacagaaaggcagaagcaagaaaatcctatttagaatggaaaaagaaaagtatttaatctctactgatagtaatggtttaagctgttatataagggaaagatgcttaaataggactttagcattttttttgcctttaggttttagcttttaccataaaaggaattcttcagtatttctatatagataagtttgaccaaattgtaaattggttcacttaaaagtagaagcattaaaaaaaatgtttcttttacaggagcagccttgcctccatgtcaatttatttttttaatggcccaatcagaaacattgggccttgaaagagctgcttctacagtgatgtattggaggactagtctttgacatggtgtattgtttttctctgtaagcagctcactgaatcaggttgttttctttgtttgtttttttcctgaatcttctcaactatggcttctctcttgaaaatgtgaatttagtatattgtgaaactggagtgaaacacaaaatatccttttaaaaattagacttcctatcttaaaaattctctttggacggtaaatgtaaaaagcataaaagttattaacctaacatatatgcaatgaatatttatatataccagccatattttctgtggaatttacgtattatgaaatacaagtcgtagactgaactatatgaaattgtcatttttttaggtcaaaaaaatgggtgagggccaggcatagtggctcatgcctctaatcccagcattttgggaggcctggcaacatggcgagaccccatcactaccaaaaagaaaagggtgaatattggcaagctcaaagctcatatagttcaacctaatacatgaatttagaattccctaaataagacatttcctgaaatattaatttatactgtgttatccagctattttttcaatgaaggaaaactctttaaagttagtttaggttaacctgaattgttaaaggtgtttgaaatcttaaattgataatactttctttccattttctttttttgttgttgttagtctccttataacagataacagctgatagagttgttttctaggtctccaagagagatattggagtttatttctaaaagattttgtggaatttttttaatgcatggtgttttgtgtccttttttagtgatacgtgatttggttgtattttcaaaggtttgtgctttctggaaatctgcatggtggctcagtggtagcaagctatccttttgatgattctccagaacataaggccactggaatctatagcaaaacctcagatgatgaagtatttaaatacttggcaaaagcttatgcttcaaaccaccccataatgaaaactggtgagcctcattgtccaggagatgaagacgagactttcaaagatggaatcacaaacggcgcacattggtatgatgtggaaggtatgcaaagcattgagtttgctacattttcccccttgttcgttgaattttgttatgtgtattctgagcaaaaaagaagaaactctgtagaaatctaactttaaaagatatttatttttattttgaaaatttcaaatctacagcaaaattgaaggactacatgaagacctatctgtccttcatttaaattcaccactgttatcttatcccagatggcttgcctctccctctctctttttcactctctacatgcacgtgtatgtgcatgcacacacacacacacacacacacacacaatcacacaatttttttgccaaaccatccaaaagtaggttgcagatttcacaacactttacctataagttcctcagcatgtatttcccaagtacagggacattttcctgtttaactatatactattaccataactgagaaatcaatgataatttaatattatcataccacatgccatccgtaactcagatttcccccattatgtccaaagtagccttggtagcccctttttatccagatctagtatccaatcaaagttcaagcattgcagttggctcttgtaaagagaccgtgctaatagtcctatggaaaaattccataatctagattgtcactttcttcatggtaagattaggtcaggtttcccagcaagactattatatagatcatgttgcgcattatatcaggagacccataacgtcaagctgcaagtggccaagttggacagcttggttaacatgatgaccaccagcaaccaggtctctccatttaaatttaaaatgtatatattttttaagagatagggtctcactctgttacccaggctgcagtgcaatagtacaatcatagctcactgtaatcacaagctcctgggcgcaagcaatactcctgcctcaatctcctgagtagctggaactatagatgtgtgccaccatgctagctaatttttaaattttttgtagagatggggtatcgctgtgttgccgaggctgatctcaaactcctgacctcaagggatcctcttacctcaaactcccaaagtgctgggattatagatgtgagccacttcacccagcccagatctctccattttacataaaggcacattttccttttgtattttaatctgtgaggtgatcatggaatgctgttttttttatttttattgtggtaaaacatacatatatatatacataacatgaaatttgacagtttaactgtttaaacatttttaagtgtagagctcagtggtactaattttcacaatgttgtgcaaccatcaccactatttctaaaacttgttcatcatcccaaacagaaactcggtaggcattaaataataattcccacttccatctctatcccttacccccagccattggtaacctctaatctactttctatctctgtgaatttgcccattttagatattttatataactggagttatacaatattcttccttttgcatcaggcttatttttcttaacataatattcttaagggtgatccattttgttgcaggtatcagaactttattcatttttatagctgaataatattccttgaatgtatatgttagtaatacattttgtttatccatctattgatgagcactgggttgtttccaccttggctactaggaataatgcgtaatgaacgttggcgttcaggtatctgtatgagtccttattttcaattcgtctggatatatacccaggagtagaattgctgggtcaaatggtaattctatgtttagctttgacagactattttccacagtagatataccatttacattcccaccagcaatatataagaattccaatttcttatgaaatgttattttttaaagaattgtttgttgttgttgttgttgttttcagatggaatttcactcttgttgcccaggctggagtatagtggcatgatcttggctcactgtaacctccgcctcctggcttcaagtgattctccagcctcagcctcccaagtagctgggattacaggtgcctgccaccaggcccagctaattttttgtatttttagtagagatagggttccatcatgttggccaggctggtctcgaactcctgacctcgagtgatctacctgtctcagcctcccaaagtgctggaattatgtatgagccaccgtgcctggcaagaattgttaatacaagcttgaactgtttaccttttctctttaaatgctatgaaaacagctattactctttttaaactttaggtatgctttgaataataacgtttttgtttttatgcacagatgtagatgtagagggaacttagaaggaataagtcaaccaatggaaatgtcatcagtgtaaattttttcttttctaggagtctgcccatgatgaaatgccttaggtcttccttacctttttattggcagtcacattataaagtgtcttatgacatgtctcttaatgtatatttaaacctttgaattactcttttactttttatatcaagccatatgtacccaaaatgggtcataagtttgagaatttaatactttcgttactggatctttggggtattgcttttctggttggaaacctctgtgcctggtggtgcctttgcccaagttcttgtcctgcatccaggaagaatgaggtatgcagacaagtggagggtgagcaagacaaagaggagctttattgagctcagaggagaccggcagtgggcatctcctctctgtaggcaggtcacccagtcaagtgttcagccctcagcacaaaggaaccctggagtgggtggcccctctctacaggcaggtcatcctgatgagtgttcagcttcagctttcagcagagaggagctaccctctggttgtcccatcatctctccatcctctgccttgctctgactgagcccagggcttttatggacctcagaggggaggaagtgtatgccgattggttcatgggcgccacgggcagcctggaaaaggcacaagtccccactccagtctatgggactggcagcctggcccccagccttcaggacctccctggcctgaaggtggggcctcaccagggaccccctcccttatacccaggagctagtctgcctcttgctgctttccatggcaccccggctgctcgtgctaaggggcacctgcaagccagtgctgagtcgccctcagtccccaaccttggttccctcttccatgcttgtcagtgcccagtccggtgggggcccaggcaacagggcccaagcatgtgcgtacccctccgggcagtgacagtgcgccgcctcagctccaaccccaatcccggataggagcagacgcaagaatggggagaggccaggcagcaggagcaggcatctccaagcctgcaagggtaaggggggcctaggaggtcgggggacgcagctgctgccagctcccagctcccgccgactcagtggagcatgcagccccagccgtgccccctgggagcctgtggcgggtggctcctaatcctcgctgggcctgggccagtgtctgggccaggggcgacattgccacaagcttccctgttgccctggggctaaggagtggcccggagctgattgcgggcctggggccaggctgtcaggagtgtcaggctgggaggtcaccccacgtgtggcggacactggggacttggccccaagtggcccgcgcagagcctcctcccgagcccaggaacccgggacccttagtggggtgggcgcagtggctgcacttctggccagatccccaaagctggagcagctcctgctttccgccccgcccccgaagcacagccccagctccgcataggggttcctctctgcctgactacattactcccccgctgtgctgctctgggcctgaccccattacggcagcccccagggcagcgggctctggggggtggcagcgggctgtggggggtggctgcagaaggggtggctgtccgcctccttcccgcaccttccggcctgctgctgctatcactttctagaattttctgatcctcctatagtttctaccagtgtttcttgtatatcagaagcattcaaaaagaggtttgacatactatttagaagtgaaaccttctccccataacaattagaggtgatttgaaaatcattaaaaatttttttgtagataatggacttactttaatgtgtaatttttacatttcagtccttgggaaatatatttaataaaacctaactttgaactggtggttttgtaatctagtcaagttgcttcattaatttgagatgatgttacttaaaataatggggtaaatacttaactttgcctttttggaaaaagttgtaaaaggttagaaagtaatttctaactgacaattaattgaggaaggtaaatgtatctcatactacttaaaaaataaatatccggcctctacaaaacgtaggtgtactttggtattaaggccagagattatttggtgaagctagttatcatcagatttttctgattattcagacatctgaagaagctacattatgctgctgtcatttttattttcatgagcatcaacttttctcttgtttcagctgaatgtcggatatgtcctatgttatttctacaataactggcttatttctcttcgtacctcagcaaatattgagcagtttccccttgaagaggaggctgtgatggttttagtttcaacagggtgaattcattgtgtttagtgagtaagatgttgtgaaaccttgtgactaggcatatattcaaaaaacccggatgtcctggagtaattttttttttttttttgagacagagtcttgctgtgttgcccaggctggagtgcaggcgtgatctcagctcactgcaacctctgcctcctgggttcagatgattcccgtgcctcagcctcttgagcagctgggattgcaggtgtgtgccaccatgctggctaattttttgtattttaagtagagacagggttttaccatgttgaccaggctggtcttgaattcctggcctcaagtgatctgcccaccttggcctcccaaagtgctgggattataaacgggagccacatgctcagccgagtaattttactgatgttctatgtgatatatttaggaattctagcttaaagaagtatagacctttagagctgaaagtgaatatattgatttagtccaacccttttgttttagagaaaatcaaggcctgagagaggaactaacttgtgcaatataatgtattaatatagcaaatatttactgagttcctgccgtgccacatatactgtattaggtgatgtaccggtatacagtgagagcaaaacagaaacaactcctgctctgaggaatcagatagtatattagtagtgtggaatctggggtgatttgggccctagtgcctttgccttcattgccagggctggcccagcatatctagctgcctatgtgggtgagccttgcttcattcaacatgtctcacaaacctcaggatccatttaggaaatggctatcctaataaggctgatgaatagccacatccccttccaaagcctcgttattgtgagacctactctggacttgttcatggagtaagatgcctttttttttttttgagatggagtttcgctcttgttgcccagggtggagtgcaatggcacaatctcagctcactgcaacctctgcctcttgggttcaagcgattctagtgcctcagtctcctgagtagctgaggttacgggcatgtaccaccatgcccggctaatttttgtatttttagtagaaacagggttttaccatgttggtcaagctggtcttgaattccagacctcaagtgatccacctgcctcgccctcccaaagtgctgggattacaggcctgagctaccgtgcctggccgcctttttttttttttttttttttaatcacagtgcgctgatttgtatgccatttgcctaccgttctttcttcacagttttgaagacattgtaaaaatcatatgatgttttggtatgtttattccaaagcagatttaataaaaactgaactgtagttttaggtcaacttttaagccatggcgtgtgcttgtagtcgcagatacttgggaggccaaggcgggaggatcttgagttcaagcccagcctgggcaaaataatgagaccctgtctccaagaaaacaaacagacaaaaaagaattgccttctttcaaattatacaatttaaggaagggcaggcaacgtatagttgaaattatttgatcaaagatcatagttttatgtaacttttagaagttttcttgggcagaacattgttatattttattttcttgcagatagaagaacagtagaaggcagtgcaatgtagtggcaaagagagagctttggaatcccgttgccttaggttggaatcacaactctgccttgactagctgtgtgcgtgtgtgtgtgtggtgtgggtgagagacaaattaatgaatttctctaagcctcaattcccacttatataaaattaagataaatactatctactcacaagattaggaggctcaagtgagaatgtgtgtaaagcactttagcctagcatctggtgccatggctacttatatctactagagtttaaacttactcttgaagatagggactttgttttattccattttctatttctagcacacacaaccatgcctggtatatataaggtaaataatagtctttttggaataaatgaatttttgccatccgaaacataaatacatagttatttgatctttggataatcttttttttttttttttttggagacaaagtctcactctgtcacccaggccggagtgaagtggcgcaatctcggctcactgcagcctctgcctcccaggttccagcgattctcctgcctcagcctcccagttagctggtgttacaagcatgcaccactacgcctggctaatttttgtatttttagtagagacggggtttcaccatgttgaccaggctgctctctaactcctgacctcaggtgatctgctcgcctcggcctcccaaagtgctaggattacaggcatgagccactgcgcccggcctaaaatcttagatctttagttaatcttataacaatttataaaaatattcttcctagttttgctcctactctgagtaaataagcttgccttactggtagatcctagatcagtattatttgaacttttttttcttacttttaacctataatatgaaataccttttagttgtgtatgtacatttcatatatatgtgtgtacattaaaaaatttcatggaacaatacttttactatacattctggtattatttcttttagtttgttctatatcattctttaaaaaatatgtctgaacccactaatatatctcacaacccactaatgcatgatgaccttcagtttgaaaaaacactattcttgatcaccctgtggtagaattcatttattttcaaattctaagtaggaacaaaacaccttacaagttgtgtgtgataacttattatttgggtttttcctcccaacttgtttatatgtttcagttatttgcagtgaggactgggccacagatatttatctcagatgttctacttttagattgctttccctaaaatacgaatgagtgttgagttaggaaattggtcagaaatatagttgtcaggcctatgtattgctcatgtgagtctatggattctattattagttaggacagctgccataaagctttatatttgtcttcttaagccactataaacttgaggctgagccttttcaaactagtaattatgattgttttctcctctggaagaagaataaactgttctttggatttatcaaattttcttccctctccttttatacaatggacagagttatgaaatgtggccagaaagcatataatgtaaccaattcagttttttgtgtgaatatcaactccttttatcatgcagacaactattctttccccaaactggaggtcagactgagcagtagcagtgtgctttaaatattgaagtatgtttggctggaagtagattgttgatggaaaaggaagagcatggggaaaataattacccacctgttttcaacaatgctgttgaaagtttagatttggtccagaaatggaccagaaagcttatttttgaggagtattttctgtgtcattaaataggatattatgaattaacccagtaacaccagaaaattgtaatctaaaacaaaaaggaataagatgaacagtatgtaactataaaaatacaatatctgatattaagaaacagacaaatccataaatatagtaggaagtttaaaataggcctctttcagaactagtaggtcatagagatcataactgttagatcacaaaaatgtgagtaaggatacagtggatttgaataacataaataaaccaatctgacctaatgaacgcgtacagaatactgtccttatatctaattttcctgcagagtctgtttactaatttgaggtgtggatgactaagaaaccagctgtcacgcttagggaagatgcatctggttctgttagcgcttgtgttactttgtttttaagattatatattaaaaactaaacaacaaagatacacaggtaaaataggcccaggagcagtggagcacacttgtaatcccagcactttgggaggctgaagtaggaggattgcttgaggccaggagtttaagacctgggcaactggtgagacctcatctcttaaaaaatacaaaaattagtggggcatggtgatgcacccctgtagtcccagctacttgggaggctgaggggctgaggcagcaagatagtttgagctcaggaatgtgaggctgcagtgagctatgattgcaccactgcactccagcctttttttttttttttttttttttttttttgacaggggaagacccgtgtcaaaaaaaaaagaaaaaaaaaagcttataatacagggttcataggatcaagtctaatacttcttagcatgggagcgaagatcccacagtctgactcaagcctataagtttagcctcagctcctacctctcctctgccaccggactacttgtccttcccaaatgtgaaccttcacatgttaggctatcctctgtctgaagtgcttttcaccagtttagctgtaacctcttctgaaacctctcctataataactgtcactatcctaccttcgagagctttttgtttatacagtaccatcagtataatacttatccacttatgttgttaatagtttttttgtttcctgttagtgtgtgaattctttgatgataaggacagtgtagtgctattcgttttggagttatctttgtgcaaaatgtattggcaggaaagagtcctagaggagggaaaactagagaggtgtttacagtcatctgggatgaggtctctttggagataagggctttacctagagggcatgtaggggaatgaaaagggagtataagatacatatataagaagttatgcaagaagaactgcagaattgaccatcgtttaaatagcagaacagaatgtcaaagagaggatgtcaaagatatgactttgaggattttgagcttggattagaaagaatgggagtgggaaaaactaattggatggtggggattgggagacagcaagcgagtgagcatgtgtgtatgtgtgtgtgtgtgtgtgtgtgtgttcgttcaggtgaaagaggagtgaaaactggaaatattaatagtacttgatgtactagtcacaagtacccaatgggcagttagggaataggttctagagcttgggagagaggtcaagatgagaaagagatttagaagttttgagacatttggaaagcatatggcagtgtagatgattttgaaaattgaattaatagtgttttctggcataatttaattgcgtggagctagaagttcaaccagaacatatatataaatgaacagatgggtgctttttttttttttttttttttacctctaaagtgaatgcatttcgtactgggatgttttccttaaggaatgccaacaattcagatattaattctcagcctgatcatattttaaaggtacagttgataatcaaatgtgcattagtaaagtgcttttggtcttacctgatcttgcacattaaagacctggttgaggctttttcttccctttattttctcttttaaaatctgagtgctgcctaatttaaaaggaaagcaaaaaggtaaaacaatactccaaaacagaatatttgcttggagtcacgagttggctttagtaaattgaagcataacctagtataaagactgacctttaggagcagtgcagttgtgtactttgtaacgtgataataggcctaaatgaagagaacctaacactcctttaggatttggcccccagtctttagatctaatgtgtataaattggatgtacttttttcttttccttttttcctgtttaactcaggtggtagagaatgggagagtacatttaaaaaaaaaaaaaaggaaaatacagttcaaagagctatgtgggagacagtgttaaccaagttagacaaaaatgaaaacagatgtaggactgtgtaatttagtttaactctgtagaatcatatcattagcaaatatatattcagtgggagtggtgaaggaaatagattttcacaagataggttgctcagaatacaaagaccaggttcagttagttaagatttgatcaatgtgaacttgaatttaaaaattaggaatttggggaatttttttaagagcaacctctgatttttccattgatttggcccagattttccacctaaaatttttttacaaacgttatgctcattagcttttaaaaatatctcagaaagtacaaaattatcacttaataactcacttattgcctataaaaaattgttcaggaaattcaaagtcgtgagagaatttctcactatccttcaaagtagttttaataaagtaatatcattaagctccaagttgaaatatagggtagaaattgtctgtctatattcctagactttaaaatgcttttcctatttaaaaaaacacattgtagtttccttgtaaaagattaatagggttcttgtgtaatgcagtttgacactttatagttggcctgcagaggcaagtaaaaaaaaaaacaaaaaaaacttgctatgtttcttaacactgaagcattggctgtattttttcttttggctttctgtttgagacagaagagtgaatctttagtatctttgaatgaaggattgaatttattaatctcccctccccttaaaagctagatctttctgtggtgaaaagagtgataagagacttgtttcctaatcaagacggattgagtatcttaaaacacatgaagattagttgtgctacaaatcgattgaaagagtttaatgggtacgagtagatcacttgatcagaagatttagctatccgtaacaattagcattggtattgatcacaatttgcagtattactagacagattcctaatggttacactttgagtcttgttctttgatactggtaaatgaatggtaggtttctttctttcctttcctttcctttcatttcctcttcctttctttccttctttccttcctctctctctctctctcttaatttttagatctcagttttcatacgtattctttcctaaaattaatctgcctgagaaagatacttgctgtggaggttctatctcatattctcttctcccaattgactgaagacaggcatacttttctacccacctgaatcacattatggtgtattgccttggagttttacaaacttccagggcactaaaacaaaaggaacaatttggtgattactttaatggttaaacagtaccataagagcatcacccccaatttttctttgaaagatgtattttcagtaattatttcttatatttactattttattatttaccaaaatttgtaaaaaaaactatgcctttttgataaattgtgtgctagtgactattgtaataattcaatttagaggacacagaattaatacttagagcattacagtcattggaaattaagaaaaatttaaatacactaacatactatagattgaaaaattatagaatgattggtgaaagactttcaagcatgcaggtatatcacattcaaatagcattctgtggaggaagtagaatggaaaaaaagttcaaagagaaaaagagaagatgtggctgggtatggtggctcaggcctatgatcctggcactttgggaggccgatgcagaaggattagttgagctgaggacttcaagaccagcctgagcaacatagtgagatatgtctctacaaaaagtaaaaataaaaaaattagccaggcatggtggtgcacatctgcagtccagtctactcaggaggctaaggtgggaggatcacttgagcctggagggcaaggctgcagtgagctgtgactacgccactgcactgcagcttgggtgacagagcaagactcctgtctcaaaaaaaaaaaaaaaaaaaaaaaaagaagatataaaattccttaaagaggcatgttcaggcaacttttaaatagatatttctagaaatcaaatctctggcatttttatttggatatatttaaaataataatataaaagttttatttaaaaaaaactggtcatggtgcagtggttcacacagtgtaattccagcactttaagaggccaaggtgggaggattgcttgtgcccaggagttcgagaccagcctgggcaaaatagtgagacactgtctctacaaaaaaaaaaaaagagaaaaatttacattatgcaggatattcctttgtttacaactatttaaacttaagatgaaaacttgtgaataccaacttaaaaatttgtgaagcgtcgcatattttttcagttattttagtattaacaaacaaattgaagatcattggtttatataaccccctgagagactaatagtagaatagaacagaataatagaatagaatagaacagaatagaataatagaatagaataataatagaataatagaaactcgcttatttatgattgttaataagtaggataaattgcagatcatttatactattaaagtgctttattgctttgaggtgtgcctgtaactgaatgttttacttccaaaattaaaattttctttggctgaataaagatattctgaaacctgacatttctcctttaatctttgttgagccaaatgacatatcaacttaaaaagataagcaaatatattaactgaatctggcagtagctgcagctgttattaatgtcaggcctatctacagatcagtggctgctccctgtttgggtgaactctagctttgggtaagtaggttttgtgttgagaaaaaaaaaattaagacaacaaacctgaaccagctacttagttaggattacttattatacagtctttgacatttggtttcagaaaaataaatgttaagtttaacatagatggcaaataatgcctatctgtgacatctcacaaaaaattcttgaattattcataacttaatgtccccatttggttccatgttttaaaataattaaaaaaataaatttaaaaataattttaaaaataaaaaaaatttttttaaataattaaaaaaaaattcctaaaccaaaacttgaagttgatgaataaagacgttttgatattctaatgctaggatagtttatctttttgtcttatgaaataaaaattagtttgctactcttcagacatttatgagtttgaagaagataaaggtagacatcacaactcattaattgccttctgaaaacagttcattattatagactcagaggaaacgtgctttacttttatgagattgtatcaagacagagataaatattttataatatatttatgttattgatttcaatataataacatcgtggtcagagaacaccctttgtatgtaagtttgacctaggtcaaacttaaatcatacaaagtttgacctaggatatggtcagacttggtgcatgttccatttgtacttgaaaagcatgtgtattctgccattgttgggtggggtatagtataaatatcatttatagatctagttagttgatagtattattacatttttctctatcctttgctgattgtcttttctgctgattactgagagaagaatgttgaaatgtgcaaccaaaattgtggatttacccatttttccttttagttctataaatttttgttttatatatttcaaaattctgattgttgcatgcacatctagaattatgtcgttttggtgaatctacacttttatcgttatgtaatgtccctctttatctctggcatttttccttgctctgaagtctattttacctgatagtcatatagctactccatcttttgatttgtgtgtgtatggtgtatttttttcctttcttttaacttacctataccattatatttaaagtgagtttctgacctggtgcggtggctcatgcctgtaatcccagcacttttggaggctgaggcaggtggatcacttgaggtcaggagttcgagaccagcctggccaaaatggtgaaaccccatctctaataaaaatacaaaaattagctgggcatggtggcaggcacctgtaatcccagctactcgagaggctgaggcaagagaatgcttaggaaaccgggaggcagaggttacagtgagccgagattgtaccactgcactccaacctgggtaatacagcgagactctgtctcaaaaaataaataaataaataataagtaaataaattgtgtttcttgtagttgcatagagttgggccttgttttttaatgagttttacaattcctgtcttttagttggtgtgtttgcaccatttacactgaatataattattgttatgtttggatttaggtctactttctcatttttcagtttgcctctctcattttaatcccactgcttcctttttcctgccttctattggattgtgttttcaacgatatcttttagttgctctagtaaatacaagttactacttaacttttcacagttctacctaaaattaatattttacttcaagaggaatgtacgaacctacccaccataccctttatcctccccttttatgttgtacttaacttatatatatatgctgcactgaaaaccctactagacaatgttataatttttactttcaactgtcatacacagtctaagggacttaaggggagaaaaatagctgattgtatttaccatttctgttgcttttcattcattcctgaagttctaagtttctctgtggtataacttctcttctgcctgaagagccttctttagcatttcttttaaagcaagtatgcttataatggattatcttagttttccatctctgagaatgtgtattttgccatcattcttttttttttttttttttttttttgagatggagtcttactctgttgcccaggctggagtgcatggcgcgatctcagctcaccgcaagctttgcctcctgggttcactccattctcctgcctcagcctcctgagtagctgggactacaggcgcctaccaccacgcccggttaatttttttttttttttttttgtattttgtatttttagtggagatggggtttcaccatgttagccaagatagtcttgatctcctgacctcgtgatccgcccgtctcggcctcccagagtgctgggattacaggcgtgagccactgcacccggccttgccatccttcttgaaggacatttttattggatataaaactcggggttgtggattgtagtttgttgtttttgctgtttgttttttagagtgctttaataattttgtgccattgccttctggcctccatggcttctgctgagaaattcagtcatttgaatttttcttcccctttatacgcacatcatttttctatggccactttcaagactattttattgctgctgctgctgctgcttctgcttctgcttcttctgcttctgctgctgcttcttctccttctccttctcctcctccttcttccttctcctcctctttctcctcttactcctcttcctcttcctcctcttcttcctcttcctcttcttcctcctcttcctcttcttcctcctcttcctcttcttcctcctcttcctcttcttcctcctcctcttcttcctcttcctcctcttcctcttcttcttcctcatcttcttcttcttcttcctcttcttcttcttcttcctcttcctgttattattattgtgagacagagtttggctgtgtttcccaggctggagtgcagtggtgcggtcgtggctcactgcaacctctgcctcccaggctcaagctattttcttgcctcagcctcctaagcagccgggactacaggcacgtgtcacaacacctggcttatttttttgtattttttgtagagacaggttttcaacatgttgccccagctggtctcaaactcctgggctcaagggatccgcctgcctcggtctcccaaaatgttgagattacaggcatgagccattgtgcccagctgactttttttctgtctttggttttcagcagtttgattataaaatacccatgcatggatttttttgcacttatagtgtttgagatttgctgagcttcttgaaatgtaagtttttgtcttttgccaaatttatggtgtttctagccattatttcactttttttttttttttaaatagcatggcgccatttttttttctctcctgagactccagtgataacaatagtaggccttttgctattgttcttaaaattttttcttcttttttttcagatctttttttcttctttctctgttattcataaggcaatttctacttacccatcttcaagataactcactttttcctatcatttccattcttccattaaacccattcagtttatttttttaatttagttactgtatttttctgaaattctgaaatttctacttttttctattttgcatgtttggtatctttcttttactttaagactgtttaatcttacttccttggaaggctgggcgtggtggttcacacctgtaatctcagcaattcgggaggccaaggtgggtggattacttgaggtccagagtttgagaccagcctggccaacatggtgaaaccctgtctctactaaaaatacaaaaattagctggacatggtggcacatgcctgtaatcccagctactcagaaggctgagggacgagaattgcttgaacctgagaggcagaggttgcagtgaactgagatcgtgccactgcactcaagcctgggtgacagagcgagactctgtctcaaaaaaaccaaaccaaaacaaaacgaaaaccttaattccttgtaacatggttataataactgctttaaggttagtctggtaattccagcatctgtgtcacattggagttggtgtctgttgactttttttctttataatatattgagcttttactggttatttgaatgtcaaataattttggattatatcctggacattttgaatcttatgctatgagatctgggtcttgtttaaatcctattaaaacataatacttgttggctgggtgtggtggctcacacctataatcccagcactttgagaggccgaggcgggcagatcacctgaggtcaagaattcaagaccagcctaaccaacatggagaaaccctgtctctactaaaaatacaaaattagctgggcatggtggcacatgcttgtaatcacagctactcaggaggctgaggcaggagaatcgctttaacctgggaggtggaggttgcggtgagcagagatagtgccattgcactccagactgggcaacaagaatgaaactccatctcaaaaaaataaaataaaataaaaataataatacttgtctgtttgtgccatcagggaatgacccagttaggttcagctgcaagttttgactcgccttatgtaagctgtaattccaatgtcagttcagttttcaaagcctttatagtgctattcagatctgtactgtatgtgcaccactcaggggccagtctgggtgctgggcagtaacctgttttgtagttcagttctcagtgcttttggtgtgctgtttaaggtcagacctgtacatgtgcagtttagagatgatcccaggtggtcacaggcaattttatgagatccctttctcacattccctcatatctgccatctcactaaagtctctgtcttccagggtctccagtatagaagataaataaagacatgaaagatctcctttcatgggaaagaaaggatgtgcaatatcatttgttatcagtgaaatacaaattaaaaccacaattagataccactcgtcttccactagaatgcttaaaatttaagagactttccagtggcatgagcaacttgttaggtgatgatgcagaataactaaaacatggatacattgctggtggtaatatgaatatggtacaaccactttagaaaacaatttcttacaaagttaaacttactataagatccctccatgccacctctagatatttacccaaaagataggaaaacatatgcccacattaagatctatgcacagctttaatcaccaaaaaacaagaaacaactgaaataaccatcacatgatgaacagataagcaaattgaactacttttattcaatagaatacttagtaatgtaatggaccatttatatatgaagaatatagatgagtctcaaaagcattatgctaagtgaaagaagcctaatacaaaaggctatatactatatgattttatttatatgacattctagagaaggcagaaatatagggaaagaaattagattaatggtaacccagggtctgggaaccttctgggatatagaaatgttctgtatttttattgtggtggtagttatgtgactgtatacattgcactgtacatgtaaatgggatgaattttatagcatataagttattatacctccataaacttgacttttaaaaaggctttaaagcaccgtgttaactagattgtcaaaattcttttgaatcatttacttaatacttaagtgaaaggaaattatttaagaacctctgtatgcttcaaagaagaataaaattcaaagtatcatgcaaaaatatttgccttgtatatgccgttttataaccttttttgatgcatggtaaatatcgtgacaataaatatatgcctgcagtaatttaaatggctgcatagtagcccattttatatcataatttactaaactggtctttcatttttgaacatttagattgcttccagttttatgctctttcaatttgaatactatagccctcatccttatagctattatcttggaataaatttctagaaaaggaatttctggttgaggtcatacctattttaaagattttatattcatattactaaattttcacccagaaatgttctataatcctttgtcatctcttttttttctttctttttaatgaaagacacttcatctttcattttctttaaaatttctgatggcagctttttggccaacagatattttactagctttttggtagttgaatctgttaggtagttaaatcttttaggtagttaaatctattcatctattattcctctcatggttttatactactttgttgtcatacttagaagggctttcctcattctgagagagtaaaaacatttatgttggcttctggtttcattaatggcttcatttttatgttaaattccatatggattaaagagtttacttggtatgatactgtaaaccaaaaagtatctgtctctaagatgggtctcaatcaatttagaagtttattttgccaaggttaaggacatgcccggaagacataaatacagtcacagaaaccgtctgtggtctttccctttctccaaagatgacttttgagggcttcaatatttaaaggggaaaagtgagctggaggggaaagagtaaaggtcatccacatagtgcaagagaaaaggagcagttgggggaatagtcaattatgtattcatctcatgctcagtaaatgggcacttttcatgagataaggtgaacatgaaagagctacctgtggagatatttacccctttatctgtagctatctgcttaggaacaaaaggaaaggcagcttcttgcatgactcagctttcagcttaatttttttcttttggcatagtgaattgagtgaatttggcatacctttcacaatatgatgtaaaactccaccagtattttttgccacctagttaacctagtcaaccacttttaaccatgtaagagttactaattttttcccccattggttttaaataccttgatcatattccaaatgcttttgtttcagttactgtgatttctatgttgttccgttggtctctttatttttatacctgaagtgaactgctttagtaagtgtagttttattatatgtattttagtaatatggcaatgcaggtcccctcttaaaccactcttattttttaattttttgggagatattctcagccatttctcagaaattctcacaaagttactggtacagtttaacttctaaatcattatgtccagttgcaacaaaaaaatctatgttttcataatatttataaattaatttggggaaatttgatatttttataagcctcttatctagaggcataatacactttactaaaatctcctacatccctcagtagcattttataatattgatttatattatgcattttattatacttcatcctatacattttgtgatttcgttgctggaaactttttaaaaattatatttgctgattattgctgaaatacagtaaaaaatattgatttttatattgtttttaagtagtcatctttttatttccagtgtcattttacatgactttttatttaacttaaatatggtcttatcaaagaaaaatttggggactgtatgtcaggattcaactaatattttctatttccattagattttacactgtgaagctaatattaaaatcagtctataagacctaaaataaaagaggcttgtctccatgaatctgacttttagtaattgtttgtagagatatatattaaaaagtcaatatttatattatatgctctgtcaaactaaggatgctaaatgtattttcttctcttggaattaagtcttattttaaaatgatttctgtccttcctccctacttgctacctgggggatatatttgtatgtgtcattagatggaattcacaagttatggtccaattaaagttacctttaaaaacctgattaggtaacactctaaaatgttactgtaaacttgatcttcttgctgggtcttagctagtatttcttaaattgctgctaaaataggacaattaagggatagacaaaagaatgctaggactcaagcctggggattatagtgttactctacgtcattgccttctagcataatgaaagtgtgagttggccatgtttgcaaattaacacagctattaaattttacatatgcaaaaaaacccttagattagtttacatttatatggccctgaaattgttattattattttttcttttttattatactttaagttctagggtacatgtgcataatgtgcaggtttgttacataggtatacatgtgtcatgttggtttgctgcacccatcagcttatcatttacattaggtatttctcctaatgctatccctcccccagtaccccacccgcctacaggtcctggtgtatgatgttccctgccctgtgtccatgtgttctcattgttcaattcccacctatgagtgagaacatacggtgtttggttttctgtccttgtgatagtttgctgagaatgtggtagtttccagcttcatctatgtccctgcaaaggacatgaactcattcttttttatggctgcattgtattccatggtgtatatgtgcacattttcttaatccagtctgtcattgatggacacttgggttggttccaagtctttgctattgtgaatagtgccgcaataaacatacatgtgcatgtgtctttatagtagcatgatttataatcctttgggtatatacccagtaataggatcgctgggtcaaatgttatttctagttctagatccttgaggaatcgccacactgacttccacaatggttgaactaatttacactcccaccaacagtgtaaaagctttccagtttctctacatcgtctccagtatctattgtttcctgactttttaatgatcgccattctaactggcatgaaatggtatctcattgtggttttgatttgcgtttctctgatgaccagtgatgatgagcattttttcctgtgtctgttggctgcataaatgtcttcttttgagaagtgtctgttcctttcctttgcccactttttgatggggttgtttgtttttttcttgtaaatttgtttaagttctttatagattctggatattagccctttgtcagatgggcagattgcaaaaattttctcccattctgtaggttgcctgttcactctgatggtagtttcttttgctgtgcagaagctctttagtttagttagatcccatttgtctattttggcttttgttgccattgcttttggtgttttagtcatgaagtctttgtccatgcctatgtcctcaatggtattgcctagattttcttctagggtttttatgcttttaggtcgtacgtttaattctttaaaacatcttgagttaatttttgtatgaggtgtaaggaagggatccagtttcagcttcctacatatggctacccacttttcccagcaccatttattgaatagggaatcctttgcccatttcttgtttttgtcaggtttgtcaaatatcagatggttgtagatgtgtggtgttatttctaaggcctctgttctgttctgtatctgttttggtaccagtactatgctattttggtgactgtagccttgtagtatagtttgaagtcaggtagcatgatgcctccagctttgttctttttgcttaggattgtcttggctatgcaggctcttatttggttccatatgaagtttaaagtagttttttccaattctgtgaagaaagtaattggtagcttgatggggatggcattgaatctataaatgaccttgggcagtatggccattttcacgatattgattcttcctatccatgagcatggaatgttcttccatttgtttgtgtcttcttttatttcattgagcagtggtttgtagttctccttgaaaaggtctttcacatcccttgtaagttgtattcctaggtattttattctctttgtagcaattgtgaatgggagttcactcatgatttggctctctgtatgtctgttattggtgtataggaatgcttgtgatttttgcacattgattttgtatcctgagactttgctgaagttgcttatcagcttaaggagatttggggctgagaccatggagttttctaaatatacagtcatgccatctgcaaacagggacaatttgagttcctcttttcctagttgaataccctttatttctttctcttgcctgattgccctggccagaacttccaacactatgttgaacaggagtggtgagagagggcatccttgtgttgtgccagttttcaaagggaatgcttgcagtattcaaaaaaactggcacagtattcttgtgccagttttcaaagggaatgcttgcccattcagtatgatactgactgtgggtttgttataaatagctcttattattttgagatacattccatcaatacctagtttattgagagtttttagcatgaagggctgttgaattttgtctaaggccttttcagtatctattgagataatcatgtggtttttgtcatttggttgtgtttatgtgatggattacatttattgatttgcatatgttgaaacagccttgcatcccagggatgaagctgacttgatcgtggtggataagctttttgatgtgcttctggattcggttttccattattttattaaggattttcgcatcgacattcatcagggatattggtctaaaattctctttttttgttgtgtctctgccaggctttggttatcaggatgatgctggcctcataaaatgagttagggaggattccctccttttctactgattggaatagtttcagaaggaatggtaccagctcctctttgtacctctggtagaattcagcggtgaatccctctgctcctggactttatttggttggtaggctattattgcctcaatttcaaaacctgttattggtctattaagagattcaacttcctcctggtttagtcttgggagggtgtatgtgtccggaaatttatccatttcttctagattttctagtttatttgtgtagagcggtttatagtattctctgatggtagtttgtatttctgtgggatcggtggtgatatcccctttatcattttttattgcatctatttgattcttctctcttttcttctttattagtcttgctagcagtctatcaattctgttgatcttttcaaaaaaccagctcctggattcattgattttttttgaatggttttttatgtctctatctccttcagttctgctctgattttagttatttcttgccttctgctagcttttgaatgtgtttgctcttgcttctctagttcttttaattgtgatgttagggtgtcaattttagctctttcctgctttctcttgtgggcatttagtgctataaatttccctctacacactgctttaaatgtgtcctagagattctggtatgttgtgtatttgatctcattggtttcaaagaacatctttatttctgccttcatttcgttatttatccagtagtcattcaggagtaggttgttcagttgccatgtagttgtgtagttttgagtgagtttcttaatcctgagttctaatttgattgtactgtggcccgagagacagtttgttgtgatttctgttcttttatatttgttgaggagtgttttacttccaattatgaggtcaattttcgcataagtgtgatatgatgctgagaagaatgtatattctgttgatttggagtggagagttctgtagatgtctattaggtccacttggtgcagagctgagttcaattcctggatatccttgttaaccttctgtctcattgatctgtctaatgttgatagtggggtgttaaagtctcccattatcattgtgtgggagcctaagtctctttgtaggtctctaaggacttgctttatgaatctgggtgctcctgtattgcatgcatatgtatttaggatagttagctcttcttgttgaattgatccctttaccattatgtaatggccttctttgtctcttttgatctttgttggtttaaagtctgttttattagagactaggattgcaacccatgcatttttttgctctccatttgcttggtagatcttcctccatccctttattttgagcctatgtgtgtctctgcacatgagatgggtttcctgaatacagcacactgatgggtcttgactctttatccagtttgtcagtctgtgtcttttaattggagcatttagcccatttacatttaaggttaatgttgttatgtgtgaatttgatcctgtcattatgatgttagctggttattttgcccgttaattgatgtagtttcttcacagcatgaatggtctttgcaatttggcatgtttttgcggtggctggtactggttgctcttttcaatgtttagtgcttcctttaggagctcttgtaaggcaggtctggtggtgacaaaatctctcagcatttgcttgtctgtaaaggatttgatttgcccttcacttacgaagcttagtttggctggatatgaaattctggattgaaaattctttcttttaagaatgttgaatattggcccccactctcttctggcttgtagggtttctgacgagagatctgctgttagtccgatgggcttccctttgtgggtaacctgacctttctctctggctgcctttaacattttttccttcatttcaaccttggttaatctgacaattatgtgtcttggagttgctcttcttgaggaatatctttgtggtggtctccatatttcctgaatttgaatattggcctgccttgctaggttggagaagttctcctggataatatcctgaagagtgttttctaacttggttccattctccccgtcactttcaggtacaccaatcaaatgtagatttggtttttttacatagtcccatatttcttggaggcttttttcgtttctttttactcttttttctctaatcttgtcttctcgttttatttcattaatttgatcttcaaccacgatagcctttcttccacttaatcgaattggctattgaagcttgtgcatgcgtcatgaagttctcgtactgtggttttcagctccatcaggtcatttaaggtcttctctacactgtttattctagttagccattcgtctaaccttttttcaaggtttttagcttccttgcgatgggttagaacatgtttctttagctcggagaagtttgttattaccaaccttcggaagcctacttctgtcagcttgtgaaagtcattctccatccagttttgttccgttgctggcaaggagctgcgatccttttcaggagaagaggcgctctggtttttggaattttcagcttttcagccctggtttctccctatctttgtggttttatctacctttggtctttgatgttggtgacctacagatggggttttggtgtggatgtcctttttgctgatgttgatgctattccttcctgtttgttaattttccttctaacaggcccctcagctgcaggtctgttggagtttgctggaggtccactccggaccctgtttgcctaggtctcaccagtggaggctgcagaacagcaaatattgcagaacagcaaatattgctgcctgatccttcctctggaagcatcatcccagaggggcacctgcctgtatgaggtgtctgtcggcccctactgggaggtgtctcccagtcagtctacatgggatcagggacccacttgaagaggcagtctgttcattctcagagcttgaatgccatgctgggagaaccactgctctcttcagagctgtcagtcagggacgtttaagtttgcagaagttgtctgctgcctttttttcagctatgccctgcccacagaggtggaatctatagaggcagtaggccttgctgagctacggtgggctctgcctagttcgagcttcccagctgctttgttaacctactcaagcctcagcaatggcagacgcccctcccgccatgaggctgcagcctcgcaggttgatctcagactgctgcagtagcagtgaataaggcttcgtgggtgtgggacccaccgagccaggcacaggagggaatcttctggtctgctggttgctaagaccatgggaaaagcacagtatttgggcaaaagagtactgtttttccaggtacagtctgtcatggcttcccttggctaggaaagggaaatctccccaccccttgcacttcccagttgaggtgacgccctgccctgcttcgacttgccctccgtgggctgcacccactgtccaaccagtcccaatgagatgaaccaggtatctcagttggaaatgcagaaatctacccctcttctgtgtcaatcttgtcgatcttgctgggagctgcagaccggagctgttcctattcggccatcttggaagtgactgaaattgttatttttatgtgttctctgttttgcttcctcaccaagactctaaactctggatggaagtatatctgttgtttataattcccaatagtcttagtataatcccttacacacaacgaccattgtattgtgaccaatgtagtagtaaaaattggaaaagattttcaataaatattatgacaatgaatgcacgtgtgtttacgtgtatatgtacaagttaaagttaccaaagatgattataggtcagcaatgactaaaggtgactaatatcataatgactaaatatggcttggtagggataggaaaatcagcatcttacccatttcctgccagactcaaggtgaataagagaaagctaaaagattgccttgccctaggagacaaggttaagaccgagttactaggcttatggtggtcataaacctgcaaatattctgagaagtcaaagtctgtttgacatccccatatggatattcaatgggcatttcaaacttaatgctttaagaacaaacatcttaatttcccattgctccaacctccttttattcatttaacatatatttattgaagggctactatgtggcaggtactgttttagtcttggaatgtccatcaatgggcataacaaagatctctgcccttgtgttgtttataatctggcagggagaaacaggcagtagatagtaaacacagtaggtgaattgttaagtgttgtagaaaaagcaacaaggtagaaaaagggtaagaggaactgggagtgctggtgggatgggcttggggatagtgatggagagatgtaagtagcaacttcaattggggaggtcaggatgacctgactccattgtcaggttgaaattggagcagagagctggggttgagggagttagtcaagtagtaaggttatccgggggaagagcattccagcaaagggaacaagtagagcaaagtcaggaggtacttagagtatcccgtgaacagcaaggaggccatgtgtctgctgcagagccagtgatggagagagtataaaaggaggtttaggaaggaaagctgggtgatggggatcaaatcatacagggccttaggccactgaaaagactttggcttttagtctgagtgaaatacggggagtctctgaactgttttgaacagagaaataacatctgacttgcattttaacagaattactctggcatctctgttgagtaaagaatataaaacggcaagggcaggaacaggggaacctgttaagagcaattgcagaggctgggcgcagtggctcatgcctgtaatcccagcactttgggaggccaaggtgggtggatcacggggtcaggagatcgagaccatcctggccaacatggtgaaaccccgtctctactaaaaatacaaaaatacaaaaaattagctgggcacggtggcgggcgcctgtagtcccagctactcgggaagctgaggcaggagaatggcatgaatccgggaggcagagcttgcagtgagctgagatcacaccactgcactccagcctgggtaacagagcgagactgtctcggaaaaaaaaaaaaaagagtgattgcagaaatacatgcagagaaatggcagtggcttgtacagggccacagcaatggacatgaggatgaacatattttggattctgaacatattttgaagttagagtcggcatggttttctgacactttggatataaaatgtgaatccaaggctttttgcctgagcaactatttaatagaagaatgaaagtgccattaactgcagtgggaaagactgtgggtggagcaggtttggagaagataagtagttcagttttggatatgttaagtttgtgatatccaagtaaagattttgaataggcagttggatgtacaagtctggagtctgggaagaaatctaggctggggacagaaatttgagggttgtcaccctgtagatcatgtttaaaaccacgggactgtatgagtttcattataccaaggaaataagtagtaagagaagaggaccaaaggcagaaccttagggatgccacctctgttgcctttgttctctttcatcttttcagtaaatggcactactatctccctgatttctcaagcctaaaatctagaagtcgtccttgatttcttccttctacatccagacccgtcctctttgtctccactaccaccaacctagtccaagtcaccattatcttctaatacatctccatgcttccccatttgtccccctacagtcattttccatccagcagtcagaatgatcttgacagaatgaaggtaattctaattgtatcacacctctgtgcaaagcctgccagtgttctgcacagcaaacattgtgaatgaatgttctgactcacaaatcactgtgaaatattgtccaacgtgaaacagagtgaaaaggcagcctacagaaaggaaaaaaatatttttttcttagaataaaatattctaataaaatattaaccccctaaaaaggggttaatatccagaatatacaaagaactcctacaacataacaataaaaaacaaataatctaatttaaaaatgggcaaaggacttaaatggacatttctctaaagaagatatacacatggccaacaaacattgaaaagatgctctacatcatgaatcatcacatacccatgttcattgcagcattattcacaattaccaagaggtggaagcaattaaatgtcaattgacagatgagtggataaagaaaagtttgtatatacaaaaaatggaatcttattcagccttaaaaaagaagggaatcctatcatatgctataacatggctgaaccttagggatattatgctaagtgaaataagccaaaaagacaaaatactgcatgatttcacttatatgaagtatctgaagtagtcaaactcttagaaacagaaagtagaaaggtggttgccaagagccggggagagtggcaaaaggggagttgtttataatggatatggagcttcattttttgcgagatgaaaatgttctagggctgggtgcggtgggtcacgcctgtaatcccagcactttgggaggccaaggcgggcggatcacctgaggtcaggagttcgagaccagcctcaacatggggaaaccctgtctctactaaaaaaaatacaaaattagccgggcgtagtgctgcatgcctgtaatctcagctactcaggaggctgaggcaggagaattgcttgaacctgggaggcggaggttgcggtgagccgagattgagccattgcactccagcctgggcaacaagagcgaaagtccgtctcaaaaaaaagaaaatgttctagagctctattgcacagcaatgtggatatagttaacactattgtactgtacatgtaaaaatggttaatatggtgaaatttgtattatgtgttctttagcacaataaaacaaaaaccaaatccctcctgtggttcctactgcacttagaataaaatccccaacttcttgccctagctgccaaagctgtttatgatgttgttttgccagaatccctcgacctcaacttgtgccattcttcctttgtctgttattgtccagccacagtagctttctttctattccttacacttaccaaacttttccccctgcctttgaaatgttcttcccgctgacttttaccaggctagctgcatcttgtttttcagatcttgacttaatgttacctcctcatgaaggctttttataactacctagtctctagttgccaccaatcactagctgtatcacatcactctacttaaattttctaggccgggcgcggtggctcacgcctgtaatcccagcactttgggaggctgaggcgggtggatcacgaggtcaagagatggagaccagcctggccaacatggtgaaaccccgtctctactaaaaatacagaaaattagctgggtgtggtggcatgagcctgtagtcctaggtactcgggaggttgaggcaggagaattgcttgaacctgggaggtggaggttgcagtgagccgagatcgcgccactgcactccagcctggtgacagagtgagactcagtctccaaaaaaaaaaaaaaattctgcatagcacttctcactatctgatatttttcttatttatatttgtttactgtctgcttcccctatgtaagaattctataagttttttatattttagaatttaaagtttttaaattttaaaagaatgttacgagaaagcagggaccttgtctgttttgttcatcaccatatccccaagcacctagaatagtgcctggcatatactaggtgctcaataaatatttgccgaaagaaaactgaacttcctagtcttaaatgatcatttcttgaaaaggactactcttctccccaagctccagacctgtctttttgaattccttcttgggtatttctgtctaaatattctacaaatacctcaaattcaacatgcccctttctgctcaattactcttacagaccttattttttctgttaatggcatcatcattagcccaattgatcaggccagaggtcctctttgattcctttctttctctcaactcccactatctatcagatcctgtcagtatcttgtctcacatctttcccttctcttccacagagttgctaccacatcattttaggcctaattactttttacttgtatcattgtaagaaactgcctaaccgggctttttgcttccaatcccccacgcctttccagaccatactgtcttctattcatcatactacttttctgttcaaaactaacaaatgaaatgccatttttttttatgctttggaaagccacggaaaactttatcctcagcctcctttagaccctacttacctttccagcctcaccattcatgacatccctgcagctctgtgctgctgccctcattctgtggccttatcagcctcatagctggtggtcacatacaccagcagcctccacctttacaaagccattttccctgactgcagtgctcctgaacccccgctccttttggctgacttacagttttatctttaagatataactaaaaaactgcctccccaagaagcctttatagatcttccctcaactccaaaattgaaattagtggcatagacccataatatctctattattaatatcatttttttctttttttttccaagataggtcttactttgttacccagactggagtgcagtggcgcaatcttggctcactgcagccttgaactcctgagcttaagcaatcctcccacctcaacctcctgagtagctatgatgacaggcatgtgccaccatgcccagctaatttttttgtattttttgtagagatggggttttgctatgttgcctaggctggtctcaaactcctgagctcaagcagtctgcccaggcttccaaaatatttattgagcacctactatatgccaggcactattctaggtactgccctcagcctcccaaagtgttaggattacaggcatgagccacctctcccagcctatttcattttttaaattgtggtaaagtatacataatataaaatttaccattgtaactgtttttaagggtacaattcccttgcattaagtacatttacattgctgtacaacattcaccactgtcctctgctatcatatttaattatttatggatgtagttgtcccctcctctgattggaaacaaaacgcttggcgttatttgtaagtgctgaattaacatggatgaacatgaatataatcagatcatctcctgagatgagatgtcatgtcacaagtatccttgtgatcctgcttgggtaacttcaggattgtgttcagttttcttccttgtacttattcaaaatggcattggttagagttcacggagtcctggatttttaaaggttctttgcctaatttcttctttacaagtttttggtgcgtacacttaacctaacttttttgtcttaccaatatctatcctataaatatgccagtgaaatggagcatattgcgttaggtaaggtgtgcatatttcaagaactagatgtgtttcaaagcacataatgaaacttcagcaaaaatgagattaagagtttaggctccaataatattgctgcgattttatttctgtcaaagttttgttatttttgctgtattgtttgcttttcttcaatgttttgtaagccccggttctttgatgaactcctaataagctgtgcttaaaactatgacattgacctttctccagaaacaggtttcagaattgtctgtttttcatgttctctccctgccttttctcttgtaatcaaatcagcatgtttttgtttttgttttggagacagagtcgcactctgttgcccaggctggagtgcagtggcactatctctgctaactgcaacctctgcctcctgggttcaagcgattcttctgcctcagcctcccgagtagctgggactacaggcacgtgccaccacacccagctaattttttgtatttttagtagagacagggtttcaccatgttgcccagactagtctcaaactcctgagctcaggcaatctgcccgcctccacctcacaaagtgctaggattacaggcatgggccattgcacccagcctaaatcagcatgtatttttaaacatcatagaatgcgagggtttgaagtgtcttttgtgatcatctaacattcactttgcatataaataaataaataaagacccatgttaatgccaaagggagtgagtggcagaagaatctatgacggaagcatatcttttggtgctgtcaatgaaagggaaacaaatgcttggcattatttgtaagtgctgaattaacatggatgaacatgaaaataatcagatcatcagttattctccctcctgatctgaaggatcctgtgtgacatcatctgagatgcactgggggttgaggaaagatgacccttaaaatccacatttgtactttccaagagcaaggtgagatcatagagaagttacacccgctcctttctccactttttagtctttatccactaaaaacaagatgtgagaaaatcaagtgacaagaatgatagggtaataggctgtcaacaaaatgagtgtgtgggcttatataggtataaacatggtgaaggtgatagaccatggatgcttagtcccttttaagttccatcttccgtttaacacattttgaaagaatttattgtgtcttattttcccctgatttgtgtagctgtgccaccctagataacagtttttctttttgctcttgccaccttcttgataaaggcaagtacagttagaatcgtaggtacttaataatgcttcggcatgaatatgcttcacaactttgagatgtgtaccctttattttctttctgttataaatcttaatttctttgtgccctacttttcatatctgtaaaatggatgaaatagtagtatctgcctcatataattgctgtaaagattaaatgctaatacacataaagctcttagaacaggtctggtgtatagtaaacacacaaagctgctattattattgttactggtattaactgatatattcatactttttataactgctcatcctattaattaaatgtattttttcactatatattctttttcaatgtatattccttttaatcttccttcttagcctccactatagttcagatgccttctccaatttcaaacaatttaatgaaaagaaaagaaaatttatacatccagagatggctgatttaatttcttcagtcttttggagggtagaattattttccttctgagagtaaacttattttttctatgttacaggtggtatgcaagattacaattatgtgtgggccaactgttttgagatcacattagaactgtcttgttgcaagtacccacctgcttcacagcttcgacaggaatgggagaacaatcgtgagtctttgatcacattgattgaaaaggtaaaagtagatgactggaatgttggggtatagaaacaggattaaataagggagaaatttggatgcatgtgaatgataatctatacagtattagatgtcatttatctctttttattacttaagattataaattatctttaaagattattagattataatctattaaaacatattctagctctgcttcccctgccccttacccccagctctctgctccatagggcttccttttcctatcttggaacacttacttatacaaactgaaataattagccaaatttgtactctcaggttcttacaatgtcatgtgatcatatttgctagtgagcctttaccactatatgaaccatagacatcagtttaatttaaacatcacccagactaatacagcaattgaatacaccagcagttacaccttgttgagaaaattagaaatctggctttgaggagagggaattttaaaagcaccttactagtgtcgagttcagacatatgacttaagtttaaggatttaatacttctgtctgtattttatttaaacttcaagggattgaaaatgttttgggggagagagaagagtcactttattttttagaaattctagtatcggtgcagagagaaattatgcgctcttgccttccaaattcaccgtctctgagcttggattcttgtcttcttaggttcacattggagtgaaaggatttgttaaagattccataacaggatctgggttagagaatgcaaccatctcagtggctggtattaatcataatatcacaacaggcagatttggtgatttctaccgattacttgttcctggaacttacaaccttacagtagttttaactgggtaagaatttaaactatgtagactcttagttaaaatgtcaagtctctgttttatatctgagacagaaatatagtctagtacatgttgtttattttttgtggcttttatttttccttattttctgatttttctcgttttataataagaaaatactattgtggagttttttgtcacatagtctaatagtacaatgggatgtgaagcatagttgtagcattagaggaaggacaatttttaaaacttgaaaagatattcagctgtgtaaagcattgccttaaagctaaccgaataccagagtagaagaaacccattgctctgtaaatgacattttgaagaactgtcttatcagctttctaatatattaaatgaatggtttcccacctcccctggaaagctttctggaagctcactttgataaggatttaattgataacctttaatcttgagctttcctacttgaaaaagaagttggaatgtcagtttgataagacactgcaaagaattgtgtaatttatcccttctttgagtactgtagcagtggttacaatggagtaacaaccacatctttcaacatgttctttcctttgagtgtaatttttttggtatacattctagtgtgtggtacttgagaagatttggtgagagaaatagttgttcaatctggggttctttgtgagataatgtcctaaaactcttaaatttacacatctctctttatttagtttgagttttgatagatcgctaagtgtaagaggatgaaaaggctactgtgcttttataatattaaagcattgtatgtcttaactataaaccatttactttttcaaatttttttttcaggtatatgccattgactgttactaatgtagtggtgaaagaaggaccagccacagaggtggatttttctcttaggccaactgtaacttcagtaatccctgacacgacagaggctgtatcaactgctagcacagttgctatacctaatattctttctggaacatcatcctcctaccagccaattcagccaaaggactttcaccaccaccatttccctgatatggaaatcttcttgagaaggtttgccaatgaatatcctaacattacccggctttattccttgggaaaatcagtagagtcaagagaactttatgtgatggagatatctgataatccgggtgtccatgaaccaggtaattggtatggtcttacacataatttcagtagtgcccctcaaagccatgttcaatattgctatgtttcattcagaaaggtcgcctacagtttgtataactggcattaagaaaacctaactaaaattaaaagaaagcaaaaaagaaaatgtaaccaatcttttcccagaagagaaggaaatccttttgctaacccatattaggcatggtatttaataagtgcatagattagatttattctgctaatagtgttttatttatttatattatatagcatatatatgctttgagcctgctcagacatatgtattagtaaggaagctgctttataagatgtttctgaaggttttttctgcctcctttgccaaaatacatgtttaaaaaattttttagtataggatttatatatgttgcggaaaaaaactgagtccatgatgattaagaaggaaaaaaagccttccatgtaattattttgttttcaggtgaaccagaatttaagtacattggaaatatgcatggaaatgaagtggttggaagagaactgctgttgaacctcatagaatacctttgtaagaactttggaacagaccctgaagtcacagatttggttcataacactagaattcaccttatgccatccatgaatcctgatgggtatgaaaagtcccaggaaggtaaagaatagcatttaattcttaatcatttgatcatcatatagaatgattattttgatggagaagagaatttgaactggttcttttggaatttcttccaattttttttccttttaatttatgattgattttagctcttgtattcttatatgatgatctggtctgttcaacaattaggtgatcaaatttatatatttagtggtgtcttccacttggtaatggttctaatttactagaaatagagtataagacttttataaattgttttattttagcaatagttctgttgacaaagagtcaaactctgtaaaatatttgaagagatttattctgagccaaatatgagtgaccatggcccatgacacagccctcagacccagaggacatgtgttcagggtagtcagggtgcagcttggttttaaacattttaagaagacatgagacatcagtcagacacatttaagatatacattggcttggtccagaaatcgggcgagggttgaaagatttattatcaatcgaaaggaatgtctgggttaggataagaggttgtagttaccaaagtttgatcatgcagatgaagcctccaggtagcaggcttcacagagaatagattgtaaatgtttcttatcagacttaaggtctgtgttggtattaatgctgattgacttttcctgatttccaaaagagaggaggcataatgaggcatgtctgacccccatttcccatcatggcctgaaccagtctttcaggttaactttggagtgccgtggtcaagaggagggaatctgttgagataggccctgcctattgagcggggccttagaattttgttttgggtttacagttcttattaaatcattattttgggaaccttatttcataagtgaaaaaccaaaccagatatctgtctgagtcagtgactctgttttgactctcagttctactccctctgcatattccagacttgctaatttattgacttctcatttctttgccttccctgggcaagcccatctctcctggggcgttatagtgtgggatgggacagcagacccttatgcacaacactaggggagtaagaattcatcttttcccagcccatgatttcttccaggcaatgatatctatcaggcaccatagtataatatggagcctcatgacttattactagcactgacctgaccattgggaggatcagttggtcattagttggtcattagtacccagaagttggtcattagtaccccagaagctcacttgaacaaataggcacaagatcttacttatatatgtatatatttcagatttttccccctaaggttctcattctttgtcagtgccacaagtcccttctacatactccccagacctttctgaaaggtggaactaattacactagtgagccctccagttttctttagtctcttgcaatttttctcattataatgacaatagtaaggctcccactccctattaaaatggaatatgcacagttaagcttaaattgaactttctcctccatcaggttaaacttccagctgtgctcttggctaactttacctttttgtgatcactttaatgtgagcatatcacaattttcttttcatttgctctatttcttacaatgtcttagtgagctttatacaagtacagagaggagtatagagttcctggccaggcgtggtggctcatgcttataatcccagcactttgggaggtcgaggtagatggatcatttgagaccaggagttcaagagcagcctggccaacatggtgaaaccctgtttctactaaaaatacaaaaaattagctggacgtggtggtgcacacctgtaattccagctactcgggagactgaggcacaagaattgctttaacctgggaggtggaggtagcagtgagccgagatggcgccactgcactacagtctaggccacagagtgagactctgtctcaaaaaaaaaaaaaaaaacaaatagagttcccctctgatcagtaatttccactcaacattgtgataatgtcattatatgtggattattgacacttaaacagtgctttaatataatttgtctaattggaatatttttcctcccagattatgagcagagggcaaaaataaaaagataatggttttacctctctgttcaaaatatctggaagagatacagtttttaaacacgcaatgtgaaaaagatgtgttttaactgtaatgcctggccaggtgctgtggctcacgcctgtcatcccagcactttgggaggccaaggtgggtggatcacgaggtcaggagttcgagaccagcctggccaacatggtgaaacctcatctctactaaagatacaaaaaattagctgggcgtggtggcgcacacctgtaatcccagctactcgggaggctgaggcaggagaatggcgtgaacccaggaggcagaggttgcagtaagccaagattgtgccattgcactccagcctgggcgacaaggcgaggctccgtctcaaaaaaaaaaaaaaaaaaaagaggtaatgcctgacaggttcttcctgcctgctgcacaggcaaaacagttcattgagaccatggtatcgcagtaaagagtttaattaatgcaaggccagccacgcaggagaattggagttatcactcaaatcagtctccctgaaggctcagaggttagggtttttcaaagatagtttgatggacaagggactagagaatgggttgattggttggggatgaaatcatagggatgtggaaaacagtccttatgtgctgagtcagcttctagttgggaaccacaggaccagctgagttacaactcactcactggtccaggtgacgtcagctggttgtcagaaatgcaaaagtcagaataacatctcagaaggccaatcttaggttctacagtagtgatgttatctacaggagtagttgaggaagttacaaatcttaacaacttccaaaacaatgactggttatcctttaattacacatacatgttagccaaattcaggcccctcttataatcccaaccttgtgacctttcattagttttacaaaggtggtttagttttgggaaaggttgttatcatccttgctttaagattaaactgtaagctaaatttctcccaaagttagcttggccgatgcccaggaatgaccaaggacagcttggaggttagaagtaaggtggagtctggctgggcgtggtggctcactcctgtaatcctagcactttgggaggctgaggggggtgggtcacctgatgtcaggagttcaagaccagcctggccaacatggtgaaaccccatctctactaataaatacaaaaattagctgggcatgatggcaggtgcctgtaattccagctacttgggaggctgagatgggagaatcgcttgaacccgggagatggtggttgcagtgagctgagattgcgccactgcactccagcctgggtgactgagtgagactccatctcaaaaaaaaaaaaaaaggcggagtcaaccatgtcagatttcttttactgttataattttgcaaagacagtttcataatcataggtgattgataatagcgaagcctgatgtgttcacatttgccttgagttaaggtatctaaagtagtacgtgttggaataaaatataagtgaacatggcttatattcaaatcctttatcatatcatacaggagattcaataagtgtaattggcagaaacaacagcaacaactttgacctgaaccgaaatttcccagaccagtttgttcagatcacagatcctacgcaaccagaaactattgctgtaatgagctggatgaagtcctatccatttgtactttcagcaaacctgcatggaggtatggcaactttatattctactaatcagttcttgttgagagcatttggaaatcctggtggaattttatctgtttgtagtgttatgctttcttaaaatgagtatcctgttactgctcttatggcagacaacagtaaaggtcttttctcattactttttcagccagtgtcctggctgtttctttcctccttctttctctctttttttcctcctcttctcttctccttttacccccatctcttctctccacccctttctcctctcttttctcacctactacttctctttcccttctcttacctcctctcccctttcttctctgtcttgtcttttttctcctctcctctccttctcccccgcctgtccccctactctgttcttcctcctcctctcctcttcctctcatagttcttcaggtattttgtatttatctctcacattgggaacttggtaacatattctttgtcattcataaaaattgatccaaatgtttagttctgttttctccctgaagtttaataaactcttttatgtaaatttagattttgatattctcttttttacttggtatatccttaactgcagcagagtgaccacattctcatgtagtacctgagctcatatacctccatataatttagcaggatggatcggttgaataggatgagtgtcaagattaaaaatcgccacaatgtccaactaaggttgcgaataagagtgaagatatcagtacccaagagaaccaaactgtgtccacacataaactcacttgaacaaaatgttcactcatttaatgtacagtgctcatgtatatgaatgttcaatgtacatgaacgttcattcaggattattcacaataacaaaaaagttgaaacaacccaaacaaccatcatctgataaatagataaataaaatgtggtctgtccttacaatgaatattatttggctcgaaaaggaatcaagtgctgatacatgctacaacatagatccttgaaaccttacactaagtgacaaaagccagtcataatagaccacatagtgcatgattattatttttttctttatcaagttgattatatttttatgaaatttttagaataggcatatccatagagacaggaagtagattaaagattgtattgggctggagtgaatagtggtaagaggtgataggggagtgactgctaatggattttggggtttctttttggagttatgaaaatgttctataactggatagtggtagtggttgtacaaccctgtgaatataaacaactttaaatgggtgaattgcatggtatttgaattacatcagtaaaactactaaaaaaaaaaaagtgacaagtattagcaccaggggcaatggggaagaaatttagtttcaacatttactggaatatccagaagtaccatagtggagacttcatgtcatatagagtagcctgccattttagaatgacagtacatactgatggatatttagatttaggaggttaattgagattctccaaaaattgctttgaaagattgccaatagtagaaaaaagtacttctacagttggtaatcatatattgttctcaaagagtcaaataagaactatgaagttataccctggttggcaaaataaattttttgttttcttttattatattttatgtgtttaatgctatgtttgataaaattcacttatttagagctttaaaaatagtctcataataaatcacacatcatgttggctaaatctggaaagttaataatagttacattccagtgaaaataagtcacagatttacagatgtggtgtccagaccttggcatggtgagaggtaggaatcttcagtcatgcagacatttttctttccatgacatattttgttttctcatcttaaaatccttatttaaatggagtttgaaatcttggcaaagcagtttgaaggagaatttctttgttgctgtacaggagtaaaaaatcctcatagagtccgcagctggagcttgtgaattaagctgataaaagacagattaaaagaaaaaagcatacaaattttatttgatgtttgtatgtggcacaggcaacaggcagtgggggagttcataggaaagacgtgaaaccctcaaaaaagcagtgttaaggacttagtgctcttataacaaagggtaataccttgtggaaaagtgactacacaaaggaaggggtttagacttctaggggtaaaaaattgtgggaaagtgactaggaaatatgcgggggaaactaatgaaagatgagggttattttactaaggtttgtttgtgtcaactcatcttggtgttgactatcccatctctgatggtaccaggaaggtgcctttctcacgggaaatttatgccctaattttaggcagaaagagggagggtagatagcctttcctgcatctgctgtttctcagttgccttcagctctaaataattaacatgctaaagagttatattctggggcagaatgttctgattcctttccctgccatctttataatttagaaggatcttgaaagaagataggggaaagcaatattctttttcataaaatttcaaaaattttgatactaatttttttattgaggtgaagtttacataattccagtggcgtttagtgcattcatagtgttttgcaaccaccccctctatcttgttccaaaacatttttatctccgcaaaaggataccccacacccatttaacagtgactcccctttcccttctcccctcaacctctggtaaccaccaatctttgttctgtctctagggatttacctattctggatatttcatagaaatggaatcctataacatgtgacctttcgtgtctggcttctttcatttagcatagtgttttcaaggttcactcatgttgtggcatatatcagtacttcattcctttctatggttgaataatagtacattgtatatacatatgtatatatcaatatcacatttgctttatccatttacgtactgatggacatttgggttgttttgactttttgactacaatgaaaaatgcttctatgcccattggcattcaaatatctatttgagttcctgttttcttttccccgtgccccccttgttttgaaacagagtctcactctgttacccaggctggagtgtaagtggtgtgatcatggctcactgcagcctcaaactcctgagctcaggcagtcctcccacctcagcctcccaagtagctggaactgcaggcatgcaccaccacacctggcttatttttaattttttgtagagacagggtctcccagtgttgcccaggctgatcttgaactcttgggctcaagcaatccacctgcctgccttggcctcccaaagtgctgagattataggtgtgaactactgtacgcagcccctgtattcagttcttttgggtgtacacttaggagtgaaattgtcatatgataattccatgttaagctttttgaggaattgccaaactgttttccacagaggctggactattttacattcccgccagcaatgtatgaggttccagtttcttcatatcctcaccaccacttattattttctatttttattattatagctgtcctagtgggtgagaagtaggacctcattttggttttggtgtgcatttccacaataactaatgatgccgaggatcttttcatgagcttgttggccatttatctatcttctttggagaaatatctgttcaagtcctttgtccaatttttaattgagtttttgtctttgttgttaagttgtaagagtttttaaatactggacactggacccttatcaggcttgcaaaacattttcccccattctataggttgtcttttctctttcttatgttcttgatgcataaaagtttttgattttgatggaatcccgtatatctgtttttttcttttgttgctagtcctttccgtattgatgctaattatttttttgaggtagactgtttggtagaagtactataaatctttttttgtggctttagaaaattagccatttgaaagatatcttctcacttattcactttgaattgaagaaattagtgtaattttcatttctgttgaggaaattctgcttggcaaattttattgttttctcttctctggcagtattctgaaaagctttatgttaataatccatcttgaaacagacaacatgatacattttcctcttttcccttataggttctttggtggttaactacccttttgatgatgatgaacaaggacttgccacatatagtaaatcaccagatgatgctgtgttccaacaaatagcactttcttattccaaggtaggcttgtctttgaatataaaatgttacaaaattaattcttttatttaaaaatatgctttaaagtcctgcaagactcaggtcaagtgcttccatagttaataaagcatgactttttcagctgtttccgaaaaatagctttttctcctgtttcccacctcacttttgaatacactacatgtctttctccattggccttttatctatggttttagcacagtacctggaacatatacatgtcaatttatttcatttgacaaataagttataagcccagtaaagtaggccaagataagggcttaatgaattatagctctggagccaaatcttgcccaccacctgtttttgtaaataaaattgtattgacacacagccacagctatatttttatatattgtgtgtggctgctttctccttcaacatttcaaagtaagtcagtataatttactatattaacaaactaaagaaggaaaatccagtgatcaaagggcaaagttgggtagtttcaacaaagacttttgcatctaaaaagtctgaaatatttgctttctggttttttacaggaaaaaattgccaaactttagtctaaggtatttaagatcctgtagttacatatagcaaggaaaagcaggcagaaatttctgtattttccaaacttcctatgataaacatggattactcttacaatcgggaatgttaaaatgtgtgtgtgtgtgaaaatttaatttaaaaatcgttcttaggaccaggcttggtggctcatgcctgaaatcgtagcactttggtagggcaaggcaggagaattgcttgagctctcaggagtttgagaccagactgggcaacatagcaagagcttgcctctactaaaaataaaaaataaaaaaaaaattagccggttgtggtgacatgcatttgttgttccagctacttaggaggctgaggtgggaggattgctctatcccaggagattgaggttgaagtgagcttgatcacaatactatactctagcctgggtgacaaagctgagaccctgtctcaaaaaaataaaaattgtcttagaaaacatgttaaaagttgaggcttgtaaactaagcttgttagtttcaatgtttggtgttactactgacttagtattgttattggttatattggtactattattggttataggtaatgaatattattactgtaactctgcactctccagtcacagtcctccatccttccacttttcccattccctcatcctctgcaaatgaatcttgtgagattgttcagagtttctactagaggagtacagctgttcatttcaccttagagaattattgctttctgtttggacatatatgtttttttgaagtacatacgtggagtaataagagaatgtatagtgtcccaaccatcaaaataaaaattaaatggctggattttgcatattttctcatcacattctatgctcattctcatgatttctgcttttcgccttcattttggcttctagttccttatcttctctttgttttcttagaccattaacccttttgatttgatttacctttctctgtagggtagacccatggacataccttttcaatgattctcctaagggtcttgtacacccctttgacataactgctttgccctccagtcctcagtaattaccattatctcttttctccataccaatattacaagtacagcctagagtggtcacactgtcacggcaatttgctatagtccatatgtgtgctctccaacttcagctgaaccctcagtcctacatggcaacatttcctgtttagctacttgactccctggctcagttcccactatggtgattcagagcctttatcctctatctgagcctcctgttccagctctatccctcttattcatagtagatcactttgcattgaactcaagtagaactttgagtaatctgatgtgagttcactaagattctgtcttctcaattgtttctcatgtgtgtcttaacaatattctcctccatttcttgatcccactgcattctgcctcctcgaatcttgtgtcttcatatcttattttataaatgaggaaggtgataattaaactccccagtcttcactcacagccttttttctcttggtcaataagcagctcctctaaaaatattgtcttctgctaaccttagtaagcccccatgaagctaccattcaaagtttctttatttttactcttcaaaacttctcaaaagtagatagtcttgggagacatctgagcagccaaagacaatgatggctatgtgataacctatctcccagggtttttctttaaacaatataaaacgacttaaaaactaccaaattttacacaaaaccacactgttggcatcacaaaagatcctgaaactgcaaaataactgtaaattttttaaaaatcaagaagtctcagcatgatctatcatgcacctaccccaccttcgccccaccacaaggctttgtggtgaggtaaaacagaccaagaaaacttacggagaagacagaagtgggtgccagtgaagggcagctgtgaaggtaatttggaatgaccaccatacatcacatatgcactaaatccaaaaatactaaaagagtaactgggcagattagagctctggaatacagggaagagatttcaaaatgcacacaacttaaaggatctggtgtgatttaatgggataagtacaatttaaaaggagaggatggttacagggagatcttccaaactcatagcttctggagaaggaaaaaaagaggcaaagatagaaatgaagaagtgctccttggcaattagatggtgaatgggaaaaggaaaaagtggggagaaatgtaaggttttacaagacagaaaagaactttaaaatcagaagattctcagctccacccttaccaccaagacaaataaataaccacactgaggtacctggattttgctagaccgacagaaaagtgtaccattaagctaggaataatattaaatgcccaatatcataaaaataaagaggaaaataaagtccatggaaaatgattgcagaaaattaggaaatgaaacttcacatatagacactaaggagaccctaccattagcaaaaaataatcgagaagcagaagaaaactgttcagttggcattctaaacagattaagtatacccaaatatacgttgagaatatgagaaactacctcaactcagatagtcaaaaaataaaaacagaggccaggaaacaaaaaacagggataaataaaataaagtttataggactcaggaaaaaaatggaagaaaaagacaaaattatctctgaaatgaagaataaatgacaaaagttagggaactcatacatccaatttcaaacttactacaaagctacagtaattaagacagtgtggtactggcataaagacagacatatagatcaatgaaatagaactgagaacccaggaataaattcttatgttgatggtcagttgatttttttttttagaaaaggatgccaagacaattcaataggcaaagaatagattttttaaataaatggtgctgggacaattggatatttatatgcaaaagaataaactagataccttcctcacaccacaccccaaaattagcttaaaataggtcataaacctaaatataggaactaaaactataaaactaagaaaaaataggaatacatttttgtgatttggtcctcctctagatatgacatcggaagcacaagtgacaaaaaaagattgatacattggacataatccagatttaaaacttctttactgcaaaaaaaaactgtatttgtttcctagttctgctgtaacaaaattccacaaactgggtggtctaagacaacaggaatttattgtctcatagttttggaggccagaagtccaaaatcacagtgttggcagggccattctccctctgaaactgtggaagaatccttccttgtttctccctagtttctggtgctttgctggcaaccattggcattccttcacttctaggtgcatcactccaacccttcatcatcacacggcattctccctctgtcttcgtatcccagtttcccctttgtacaaggacaccgtcatattggattagggcccatgctaatcaccttattttaacttgattacctctgtaaggaacttatttttaaataagatcacattttgaggtactgagggttaggacttcaatatatttttggaggacacaactcaatccataacatataacatccaggaagtaaaaagacaacccacagaagctgggcttggtgacacgtgcctgtagtcccagctacttgggaggctgaggccgaaggattgcttgagcccaagaagtagaggctatcgtgagctatgatcatgccactgcactccagctttggtgacagaaggagaccccagcccccaaaaaataaataaatagatgacccacagaataagagaaaatttttgtaaatcatatattttgataaaggtgttatatctaaaatatataaagaactcttatggctaaataataaaaagacaaatcatccaagtgaaaaataggcaaaggatctgaatggacatttctctgaagaagagaaaatggccaataagcacatgaaaagatgctcaatattattagccattagagaaatgcaagtcaataccacaatgagatacctcttgttacccactagaatggctgtaattttaaaaaatggaaaatatgcataggcaaaggtggaaaaattgaaaccttacatacattgctggtggggtgtaaaatggtataactgctttgaaaaacagtctggcagtgctttaaaacattaaatatagaattgtaatatgacccagcattccactgctaggtatatacccaagagaaatggaaacatgtattcacacaaaaacttgtacatgaatatttgtagcagcattattcataatagccccaaatggaagcaaccaaaatgtccatcaactgatgaatgggttaacaaactgataagtagacatacaaaatcatacagtggaatattattcagccataaaaagtaatgaagtaatgatacacagtacaacttgaatgaaccttaaaaacctactaagtgaaagaagtcacaagagactacatattgtatgattcagtttatatgtaatgttcagagtaggcaaacccatagagacagaaagtagattggtggttgcctagggtttggagtgggggtggggagtaggggttggggaaaaatggagaatgctaataggtatagagtttctttttggggtgatgaaaatgtcctaaaatttattatggtgggtggttatacaactctatgaatactaaaaaccattgaattgtacactttaaatggagtcaatgtgtggaatgtgaattatatctcaataaagtggattttgaaaacctaaagaagactgaggggtggaggatccattctgtattcgtatataagttaaaaaaatgagatctaaaagttatataccaagcccggtgtgatggctcacacctgtaatctcaacactttgggaggccgaggtgggcagattcgttgagcccaggagttcgagaccagcctgggcaacatagtcaaaccccatccctacaaaaaatacaaaaattagccaggtgtgtgggtgcatgcctatagtcccagctcctcaggagggtgaggtggaaggatcacttgagcgtggggagattgaggctgcagtgagcctgtgtttccactactgcactctgagctgggtgacaaacaagacccagtttcaaaaccaaaacaaaaccaaaacaaaaccaaagcaaaagagcatgcatataattattacagtaatctaaaattatggtttttatttgataagagagtgatgggatgataagcctataattggcatattaagtttctagatggggatcgtttattttattttgtttttgttaggacagagtcttgctttgtcacccaggctgtagtgcagtggtgcaatcatggtttactgcagcctcaacctcctggggtcaagctattttcccatctcagcctcccaaggagctggttctacagacatgtagcaccatgtgtggcttttttttttttttttttttttttgtagagatgaggtctcactgtattgcccaggctggtcttgaacttctgagctcaagcagttctccaaccttggcctcccaaagtgttgggattacaggtgtgatcttacctgtccctgtttatatattttaaatggttaattctctgtggtagaaaaatgggaaattattctttttctcttcacactttcagtactttttttctgtttcaaaaagagataaatgaagttttgaccatctttcaaagctcaatttcttctaggaaactccccctgccactctcatcagatgtaatctttctctcctcttgctttcaatggcatgcatttgtgtctccatggcagtttttcttacccttcattgagttatcagttggacacctactgtatgctagatgctgaggacacagagacacaaactgtttcaaggaatagtgtattgtctttagggaagagaaaggtgcaactagttgtaatagggtaagataattgtacagagggcagtcagagcacagaggggccatcttattcctgctagcagtcagggaaagctgcttgcttttattgtgtgtgtattatcttttttggacttcaagctccttgaaagcatgaaacgaaagtataaatatgagcagaaattttttttagagaggggttcagctaggttttatattacttgtaattgcgagtaataaatgaagtcaatattttcttacggagcacattgtattttgatttttaaaaatagataagttcagatagtgaaaaatcaaaatggcataaaaagctatacactgaaaagtctcactgctcatagccccaccccactcccacctccacccctcacataccctgttggaagccacttttattattttcctgtatctttccagtatttttttttgatggagatacaaacaaatagaagtaaagattctttttgtttttccaggaaaattcccagatgtttcaaggtagaccttgcaagaatatgtatcctaatgaatattttcctcatggaataacaaatggagctagttggtataatgtgccaggtaaagattcttttatatcaaggccttacaacttgatggcctttctgctttcctagatggtgcttcttgttattatcttttagttttgaggaataataattatttttaaaacatggtttaaatagtttaaaatatttaaataatcttttcaactacttttatgtttgatgtacgttgagggttgagtaagaataatgcactaaaacttgattaaatggttacattttacttctggctattagaaagaatcttacatgtgctaatagaagagtgtaagctatatttgaattcttttttttctttacaacgttactttctttttttttttttcttttctttttttattatactttaggttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccctttcctgtgtccatgtgatctcattgttcaattcccacctatgagtgagaatatgcggtgtttggttttttgttcttgcgatagtttactgagaatgatgatttccaatttcatccatgtccctgcaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacaatgtaaaagtgttcctatttctccacatcctctcctgcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtataaggaagggatccagtttcagctttctacatatggctagccagttttcccagcaccatttattaaatagggaatcctttccccatttcttgtttttctcaggtttgtcaaagatcagacagttgtaggtatgtggtgttatttctgagggctctgttctgttccattgatctatatctctgttttggtaccagtaccatgctgttttggttactgtagccttgtagtaaagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagagttgttgaattttgtcaaaggctttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcagtttgccagtattttattgaggatttttgcatcaatgttcatcaaggatattggtctaaaattctctttttttgttgtgtctctgcccggctttggtatcagaatgatgctggcctcataaaatgagttagggaggattccctctttttctattgattggaatagtttcagaaggaatggtaccagttcctccttgtacctctggtagaattcggctgtaaatccatctggtcctggactctttttggttggtaagctattgattattgccacaatttcagctcctgttattggtctattaagagattcaacttcttccacatgaaggtataggtgttttgcttgtatcgcaagcatcaaagtgccctcacatgaacacgttagcttatcaatgctgataagagataaatttggctttttactaggaatgttgcttaccttttgggatctgagctgtttagaacttcttcagagtgactaattttaatttttatcttttaggaggaatgcaggactggaactatttacaaacaaattgctttgaagtgactattgaactaggttgtgtgaaatatccacttgagaaagagctgccaaacttttgggaacagaatcgaagatcactaatccagtttatgaaacaggtgactattcaggagtgaagtatgaaatttctcccgagggtgaaaagatttttgtgcgtacacgtggtttttgtgcagtgattttggaatacactctttaaaatttcaattcattttagtatatttaaccagtttgtatattccaaggtgtttaatatatttatctagaaaattcgtgaatggaaatgagtttatttgtatatgtgaggaaaagttgaagaaaatgattgaacaaggtagtgatattttgctcttaagggttagtggtcactttttacccgtgtttaaaaaagaccagcataaattggatacacacctaatcattggccaagtgatagaaagatgggctgtggagtgaatgtttttattctttttcttgttgccagtgatttactgtgaaatgattaatttccttttgtttggatatgtgtggtggccagtaggtaaagattataagaaatatactaatgttaattaggataatcagactaatactttctgccagtacatttctgcatttttctttttcctgagtggtgtgacataaagtctgtgagttttttttactatatttaaagacattttattctgaaaaattttaaatatacagaaaagttatgactagccaataattattcctatacctagatttaacatttttaacattttgttatatttgctttattttaatgtaaattttatttacacactcacatacacatacatatttttgactgaactattgtaatataaattgcaggtatggtattttacccctaaatatttcagcatctatctcctaaaaataaggagctactacatactatctctaagtgctactgtcctacccaagaaaattaacagtaattccctaatattacctaatacttagtttatatttaaatgtccatatttgtccccaaaatgtaattttacagctgtattttatgaccaggatctagtcaagtttcatgcattgcattggattattatatctctttactattctttgaactataagagtccttctgtttttaaaaaatgccatttccttttgaaaaggccaggtctgttttcttgtagaatgtcatatattctgaaatcatcagaatgtgctaaagtttaaacagtgttatttatattcttcatgataaagagaaacaaagcctatgaaaaattagccttcagaaatattttaatgaacatttacattgaactttactctgaactcctaaattcctgtttgttccatttatttgtgttgacaatctgttattttgaatatgacctcccaagataattagatgatgatgtttattattgaaatctggtgtccttgtacttaatccaggttcatcagggcgtcagaggatttgttctagatgccacagatggcaggggtatattaaatgccaccattagtgttgctgagattaatcacccagtgactacttacaaaactggagattactggcgtctcttggttccaggaacttataaaatcacagcatctgctcgagggtgagtgactgaatgctttgaaatagagtgctcggaggacaaacatggctccattctggaggattattactagaacgttctagagagcctgttaagcaactttgaatggattgctgcgaagtttagggctggttatacctttgactctcctttagtggcagatagagtacacgaaaaaaaaaaaaaggaaagattcctggggtaaatattctagttattgcttagttgactcattgtgacatgcttccaacctggacattaaacaagacattttagaatacacatcaaatcctgatcctcatggccttaggttttttatttaaaaggagagttaggctgaagtaattctacagtcagttccaattcatagtagaatttattggaaatgtgttcaagatagtttttcctttaaaggagtaacagaagtgttagttgatgaagcacaaagaacatagaaaatgcatagaaagaacatttctcgttcttttaatttgctaaatacaggtaagcccaaagcaatgcagtctatttaacatgctagtaacttttttttttttttttttttttttttgagacagagcttctctctatcgcccaggctggagtgcatggcactatctcagctgcctgcaacttctgcctcctgggttcaagggatgcttgtgcctcagcctcccaagtagttgatattactggtgtgtgccaccacacccgactaatttttgtatttttagtagagacagggtttctcttgtagttttcttttttatcttttgataagtatagatgttaccacaggatattttcccttcctcctgctagctaacttatttctgaagagttagtttgaatacccattgaagtaagggtaaaatatgaaagcattttagtcgttgcctttgttttttaatggttttcagatatctagtggtccgtaaatgaatgggttagaacctcacactaatgagtaatgaggtcttttctgtgattcttccatttttggcagagtgttaactaaagcagcaggggatccgagaaacagggtgagaaggatgtgtttggcagagaatgtcataacctagcacctctgcaactttcccacccgtataccctgatagaagacaagtgaatttaagttccaggagacatgggagtatccactacaagcactaaatttcttttgaagccatatatttaatcttaaaaacctaggccaggtgcggtggctcaggtctgtaatcccagcactttgggaggcagaggcaggtggatcacttgaggtcagaagtttgagaccagcctggccaacatggtgaaatcctgtctctactaaaaatacaaaaattatccaggcatggtggtgggcacctgcaatcccagctactcaggaggctgaggcaggagaatcacttgaacccaggaggcggaggttgcagtgaactgagatggtgccactgcactccagcctgggtgacagagcaagactccatcttaaaaaaaatcatgaaaaaaaatccattcatattttgtaatatacccatgtctattctttattaatgtattaaaaataataaattactcaacgttaaaattttgtctctttaggaaactgcaccacatttatcccaaggattcttacgttctctgcacacctgccttcccagggtttgggtactccagctgcaggagtgtggttctgatctgtctcctttatcataggtataatccagttaccaagaatgtgactgtcaagagtgaaggcgctattcaggtcaacttcacacttgttcgatcctcaacagattcaaacaatgaatcaaagaaaggaaaaggggctagcagcagcaccaatgatgccagtgatccaactactaaagagtttgaaactttaattaaagacctttcagcggagaatggtttggaaagcctcatgttacgctcctcctcaaatctggctctggctctttatcgataccattcctacaaagacttatcagagtttctgagaggacttgtaatgaactatccacatattacaaatcttaccaagtaagtgtcactttctattgtctttttttttttttcaagacagtaaaatcagcattagccatgttgaatagttgtaatttatatagaaatatttgggaacagaatgtacagagagttggagtttacttattttgcaacatgtatttgcttggagatcttttttttttaattatgctttaagttttagggtacatgtgcacaacgtgcaggtttgttacatatgtatacatgtgccatgttggtgtgctgcacccattaactcgtcatttacattaggtatatctcctaatgctatccctcccccctacccctaccccacaacagaccccagggtgtgatgttccccttcctgtgtccaagtgttctcattgttcagttcccacctatgagtgagaacatgcagtgtttggttttttgtccttgcgatagtttgctgagaatgatggtttccagcttcatccatgtccctacaaaggacatgaactcataattttttatggttgcatagtattccatggtgtatatgtgccacattttcttaatccagtctatcattgatggacatttgggttggttccaagtctttgctattgtgaatagtgccacaataaacatacgtgtgcatgtgtctttatagcaccatgatttatagtcctttgggtatatacccagtaatgggatggctgggtcaaatggtatttccagttctagatccctgaggaattgcaacactgacttccacaatggttgaactagtttacagtcccaccaacaatgtaaaagtgttcctatttctccacatcctctccagcacctgttgtttcctgactttttaatgattgctattctaactgatgtgagatggtatctcactgtggttttgatttgcattctctgatggccagtgatgatgagcatttttttgtgtgtcttttggctgcataaatgtcttcttttgagaagtgtctgttcatatccttcacccactttttgatggggttgtttgtatttttcttgtaaatttgtttaagttctttgtagattctggatattagccctttgtcagatgagtagattgcaaaaattttcttccattctgtaggttgcctgttcactctgatggtagtttcttttgctgtgcagaagctctttagtttaatgagatcccatttgtcaattttggcttttgttgccattgctattggtgttttagacataaagttcttgcccatgcctatgtcctgaatggtattgcctaggttttcttctagggtttttatggttttaggtctaacatgtaagtctttaatccatcgtgaattaatttttgtataaggtgtaaggaaggggtgcttggagatctttttaatagtgaatcttgggaactttaaggagaattacttgttagattagaagtagatagcctgtgattccaggaaatgtaaaattgctcttcctgataattattttgactgattgtaaaaccctttccatcactcagctacagatctattaatatgttctgactaaatattgtttagtttgttttattttgcttggggcaagggaggaatttagaactgtaagctcacctgttagggattatgtgtaactttttttttttaattagaaaatgaagcctagttgctgtcctaattctagtctctattcacagtctcttacttgaagctttagggacatgtgtgatcgtgggtcccagggaaaacatacagtcctggcttatgtaaaactgatagctgagatagcctttaccttcactttgtggtggttgctctgcctcacttgcactgcttcattttagattttgttacagttactccaaaattatttctatgatttgttgattcctatggtttgcctgttgtagttaaggtctttacattttgccttgagcatatagttctctgctgcaaacctcatgaacattatttagccttttacctttttactttgtctttcttcatgggtccttttaatttcatcagaaaacttagttcctcaaattctgatttataatattcatagatgcagagtgatacttaactttctttggcaataccaattacttttcttccttaactgattcttggatatttctggctatttcaggttttaatatcatacaatcttagtgccatagagttcatatacttttttattttaaaataaaaccaggctgggcacagtggctcacacctgtaatcccagcactttgggaggcccaggtgggaggatcgcttgaggccaggagctccagtttacgttgaactatgatcacaccactgtactccagcctaggtgacagtaagatcctgtctctaaaacaaacaaaaattgggcattattttgctgtctgtttacttagttgatttaatttttttaacctcctaattcaagacacactttttagttaaatattttctcaaaatatgccacacatgccagtggtggggcacaagagagttttaggtggtacaccaacaggcactaagtaccattgaatagcgtcatgagaaagcaataaggtttctgttaatttttctcaatttaatatgattatttttttctgtccaattcttgtaaatctccctttatgctaaagaaagcagaccttaagctcaaagctcttgggcaagcagagtatttgaccattgtttaattttcattgaattagtatttttttccccactcaaattacttttactgtgaaactggtgttgcatttatagtaaaatataacgtgacttatttacaaatattaattttgattaaaaagggagggccagggtggtggcgcatgctgtaatcccagcactttgggaggctgaggtgggaggattgcttgaggccagaagcgcttgaaaccagcctcagcaatatagcaagaccctgtctctacaaaattttttttaaaaaattagctaggcatggtggtgcaaacctgtagtactactcccttaggagactgaggccagaggatcacttgagtcctggaattcaaggctgcagtgagctatgatcaagccattgcattccagcttgggtgacatagtgagaccctgtctcttaaaaatataatgacaataatataaataaataaataaataaataagggaggttatctatgttcatacatacttaaatatttctgtaataaaaatttaatttgtgagttagtacaaaatatattaactaaatagtagtgtagattaaagaagatagggcaaatattgtgatgattgtatgagaattactgaatttggaaggatggtaaactaaatcataatctttcctaaatctttcctaaatctgataatatcatctatttgataaatgttctttggtcaaggaaaactaattttcttaaggttttctgatgcagtgattcactctttaaagactttttaaaactttttgtgttttgttttcatttctatttttaaagtccataagtcaacattaacatagtgcttgattacttgctgatttttttgtttctggtttttgaaagtttgggacagagcactgaatatcgtcacatttggtcccttgaaatctccaataagcccaatgtatctgagcctgaagaaccaaagattcgttttgttgctggtatccatggaaatgcgccagttggaactgaactgcttttggctctggcagaatttctctgcctgaactacaaaaagaacccagctgttacccaagtaagagaatagccgaggttgacatgctttaaaaggaaaaagctcaacattaatatcagggcaccatttttaaaatttttaatttcttgctagattttacagagtcacttgtagtacattatgaactttactctttaaaaatgaaccatctttgtagtatataccctttgttaatagtgtctttctattatatttccttgtatgtcttaagaggcatgcaggaaagaatactaaaaatttacattcaatttcctactccgtcatttaatagccacactacccttccagtctttattcatagttctttactttttttttttttttttgagacagagtcctgctctatcacccaggcttgagtgcaatggcatgatctcggctcactgcaacctccacctcctggattcaagcaattatcccgcctcagcttcctgagtagctgggactacagatgcccaccaccatgcccggctaatttttttatatttttggtagagacggggttttgccatgttggccacgctggtctcgaactcctgacctcaggtaatccacctcctttggcctcccaaaaatgctgtgattacaggcgtgagccatggcgcctggccagttttttacattctgacttgagggacttccattctgaattacttataactaggacactatattgaaaaatctagtgaaagcctagtttttcagtatagttttctttttcatgtaatacataaaaaattattggacatcttggctgctaagagattttagaaaaagcaatatggtgttatctactttagcaatctgtgactacagaaaagaactttgactggggtgtgatggctcatgcctgtaatcacaacacttcagggggctgaagagagaggaccacttgaggccaggcgtttgagaccagccagagcagcagagtgataccttgtctctacaaaaatttaaaaaattagctgggccttgtggtgcacacctgtaatcctagctacttgggacgctaaagtgggaggatcacttgagcctagtaggtcaagactgcagtgagctgtgattgcaccactgcattccagcctgggtaacaggctggaatctcaaaaacaaacaaaacaaaacaaaactttgacccagaggcttgggcacgtatgattaagcatcctagttgtacgttgcctcagagaagggaaggaaagagtgaaacactcactaattggcactgtccatagtggacttaggaaagggaaaaagaactgatatttattgaatacatattttgtgctgggtaatataccaggtattttatatacgtcattatatcctcaaccctgtgataatgattatctccattttataaatgtagaaactgaggcagtcccacagctagaaactggtaaaactagaatttaaacccacgtatgtctactttgaagcccagtgcagttctgcctccccaaaacaaattgggaaagaattgatgtcatgattaggatcagaagggacctgtgtaattaggtgacatgaacttaaatcagactgaccaaaaattatgttatcttcctttgtgggacaggtgctctgtgttgcgaacttactcaactctgccattagagcacaaaacagtcatatgtaaatgaatagtcatgcttatgtgtcagtaaaactttatatacaatagcaggcaccaactggatttggcctgctgttagtggtttctcacccctgttctaagtcactggaaggtctctgggaacattagctgtacagtagttttttgcttatttttaatatatttgaagcaaaaggaaatttaattttttattttttcattcatcttagttctgtcttttaaattaactatgtgtagaataaacagactttctgtttgaggcatgagagggtacccattgattctacatgcagctagtaactcgttaatttctgtttgtgcttcagttggttgacaggactaggattgtgattgtcccttctctaaatccagatgggcgagagagagctcaagagaaagactgtacttcaaaaataggacaaacaaatgctcgtggcaaagatttggatacagacttcacaagtaagactaatttttaggctactaaagtacttaggagataattttctttctgctagaagattgattgatcctattttgtcagtgaataatggagtactttcttgtctgggttatgaatgtgaggtataaatgaattcagacatctggaaaagtttttgaatttttctccattattatttgcaaaaataatttaagtttttcatagaaattcaatccattatattgggatgtttgtttcttcactagttgtgtagagatgtgtattctctctcccctcctatgtatgtgtgtatgtgtatacacgcacaacacacacgtatgtatattgatttggagagccctatttcttatttacttaaatgggacctttttcattgaatatgtatcattgacatggttcaatttcagtacttatagatctctaacattctttttcttttttttttttttgagacagagtctcactctgttgcccaggctggagtgcaatggtacaatcttggctcgcctccgcctcttgggttaagcaattatcctgcctcagcctcctgaatagctgggattacagggacccgccaccatgcctggccaatttttgtatttttagtagagatggggttttatcatgttgaccaggctggtcttgaactcccgacctcgggtgatccgcctgcccagcctcccaaagtgctgggattataggcattagccactgtgccaggcccaacattattttctaatggcatctagtatgccatgaatctatgacagtactcttaatttattcaaccattttctactgatagatatttactttatttctgattttttgcttttgtaaacagtgctgcagagaacacccggctttctgaaactctaattttcttccaaagataatgtatttgtccattttcacactgctgataaaggcatacccaagactggaaagaaaaggagttttaatttgacttacagctctacatggctggggaggtttcacaatcatgctgcaggatgaaagccacttcttacatggtggcagcaagagagtgtgagaaggaagcaaaagcagatctgataaacccatcagatctcataagacttattcactatcacaagaataatacgggaaagacccgcccccatgattcagttacctcccaccggctccctcccacaacaagtgggaattctgggagataaaattcgagttgagatttgagtggggacacagccaaaccatatcattctgccactggcccctcccaaatctcatgtcctcacatttcaaaaccaatcatgccttcccaacagtcccccaaagtcttatttcagcattaactcaaaagtccacagtccaacatctcatctaagacaggtcccttctgcctctgaggctgtaaaatcaaaagcaagttagttacttcctagataaaataggggtacaggcattgagtaaatacagccattccaaatgggagaaattggccaaaatggaggggctacaggccccatgcaagttcagaatccagcagggcagtcaaatcttaaaagttcaaaaattttctcctttgactccatgtcttgcatctaggtcatgctgatgcaagaagtgggttcccatggtcttgggcagctccacccctgtggctttacagggtacaggctgtctcccagctgctttcaccagctggcattgagtgtctgtggcttttccaggggcatggtgcaagctgtcgtggatctaccattctggagtctggaggatggtggccctcttctcacagctccactaggcagtacctcagtagggactctgtgtgggggctctgatcccacatttcccttctgcactgccctagcagaggttctccatgaggggcctgcccctgcagcaaacttttgcctggacatccaagcttttccatacatcttctgaaatctaggtggaggttcccaaacatcaattcttgacttttttgcacccgcgggctcaatgccacatggaagctgccaggtctcggggcttccacccattgaagcaacagcccgagctgtaccttggccccttttagtcacagccggcacagctgggacacagggcaccaagtccctagattgcccccagcacggggaccctgggcccagcccacaaaaccagtttttcctcctgggcctccaggcctttgatgggaggggctgccgagaaggtctctgacatggcctggagacattttccccatggtcttggggattaacattaggctcctggctacttatgcaaatttctgcagctgggttgaatttctccccagaaaatgggtttttcttttctattgcatagtcaggctgcaaattttccaaacttttatgctttgcttcccttataaaactgaatgcctttaacagcacccatgtcacctcttgaatgctttgctgcttagaaatttcttccgccagataccctaaatcatctctctcagattcaaagttccaaaaatctctagggcaggggcaaaatgctgccagtctctttgctaaaacataacaagaatcatctttgctccagttcccaacaagttcattatctccgtctgagaccacctcagcctggaccttattggtcatatcactatcagcatttttgtcaaagccattcaacaagtctctaggaagttctatgctttcccacattttcccatcttcttctgagccctacaaactattccaacctctgcctgttacccagctccaaagctgcttccacatttttgggtatcttttcagcaacacctggctctattggtaccaatttactgtattagtctgttttcaaactgctaataaagacatactcgagactgggaagaaaaggagatttaattggacttacagtcccacatggctggggaggtttcacaatcatagcggaggatgaaaggcacttcttacatggcagtggcaagagagaatgagaaggaagtgaaagtggaatcccctggtaaacccatcagatcttgtgagacttattcactatcacaagaatagcatggcaaagacccgcccccatgattcagtcacctcccactgggtacctcccacaacacgtgggaattctgggagatacaattcaagttgagatttgggtgggggtacagccaaaccatatcagataggttatttatatattccctaaattattttgtaaagctggatatgcttattctttttgtttttttaataagatttttctttaacttgcttagagtcattagtatatacacatcctgaagtacataataaaactcagactaacctaccttctgtaatgtatctttcttgcttgagatagtggcttatggagaaataaaatatttatctacaaatttttaagttagcattttgattgtattcaagtagagaatattttcttagatactcatactaagatttaaaatttgatattttatatttgacttttctcttttttagataatgcctcccaacctgagaccaaagccatcattgaaaatttgattcaaaaacaggactttagtctttctgttgccttagatggtggttccatgctggtcacatatccttatgacaagccagtacagacaggtatgtagaatgtcattttatatatatactgtttaagcttaggtagcaaatcccaattaagtaatgtcccttccacatttttataaatagtgagcatttgagcacactctatgagcaaattaccaaccaaagaagattgtacatacatcagcagttcagttacttggagagctcagatctaatggtagcccagctttattgagtctagctatcttgttccatctgttccatttagtccacaagcatttactgagcaattattatgtctgtaaatattgagaatataaaagtgagtatgacacggtttctgcctcatgaaactcctatgtaaccaaatactaacagtacagatttgtccttccctgttttaaactttgactaagtggttgcaccttatggtgagttaaatagttggttgtttaatctctgtggggtcgcagtatatggagatagtttgggtggttttcagtgcatcttacaaagaatattgttattaggctacagttgtcccaaaatgcagtaagacataccaaaacaagtttgtattttagtgtgatagtctgttgtgaaaactcaccattagaaccttttcatgtaaagaggatgtttgtcttctattatcttgggctaaataaaaccttttagggttaattatagtaacagtatacttaagtggagtgcaaaatttattaggagaaaaagatgacttgtatccatgaaggttaacttgggggaaaaaaatcatttggatttctccactgacttctaaatttttctttctatagtggaaaataaagagactctgaagcatttggcatctctttatgcaaataatcatccatccatgcacatgggtcagcccagttgcccaaataaatcaggtagatgttttccataccttttgttattgctgttgttgttgttgcttttgtggggaaaggagtttcaccttaaggtcttcctgattccacatctcttaatgcttttatagatgagaatattccaggaggagtaatgcgtggagcagaatggcatagtcacctgggcagcatgaaggtatgctttctagaacatggttagaatggagttatggccaggcacaatgccgtatgtgtaaacccagtgctttgggaggccaaggcaggtggattttctgagtttgggagttcaagaccagcctggccaacatggtgaaaccccatttctactaaaaatataaaaattagctgggtgtggtggcagacgcccgtaatcccagctacttgggaggctgagtcaggagaatcgcttgaacctgggaggcggaggttgcagtgagtcgagccgagatcgcactactgcactccagcctgggcaacagagcaagattccatctcaaaaaaaaaaaaaaaaaaaaaaagaatggagtttatgaatatcagccattgagtacaagaataggtgacttttctggtattgtaaagtgaatggcatctgcctcatggctttcttgacatgtttagcccttacattaacccgacagtacttttttggccattttaaccatttttaattgtacagtttagtgacattaattaaatgttgtgccccaaaaaccatatctatttccaaaacttcatttgccccagacagaaactctgtacccactaagcaataactccctattcccctctcccacggctcctggaacccctgtctactttctgcctctatgaatttgcctattctaggtatttcatgtaagtagaatcatacaatatttaccctttcacttagcaaaatgtttttaggattcatccattttagagcatgtatcattacttcattcatttttatggctgaataatattctatttatgtttataccacattttatttgttaattcatgtgtcaatgggcacttggatttctactttttggctgttgcaaatgatgttgccatgaagattggtattgcaggtatctgtttgaaccctgtgctgccatgaacattggtattacaagtatctgtcacttctttggggtagatacctaggagtggaattgcctggttatattgtaagtctatgtttcaccttttgaggaaccaccaaactgttttccacagcagctgcaccattttacattccttaccagcaatgtttgaggtttccaattttcccatatcctctcctcaccaacacttatttgctggtttttttttttttaaacagagtctcactttgttgctcaggctggagtgcagtggctatggctccttcgcagcttattgcagcctgaacctcccaggcccaagcaatccccccacctcagcctcctgagtagccaagaccacccgcatgcaccaccatgctgaaccaattatttttaattctttgtagagacagggtctccctttgttgcctaggctggagttctttatatattaatataaaaggctgagcgtggtggtggctcatgcctataatcccagcactttgggaggccgaggcgggaggatcacctgaggtcaggagtttgagaccagcctggccaacatggtgaaacccatctctactaaaaatacaaaaaaattagctgggcgtggtggcaggtgcctgtaatcccagctacttgggaggctgaggcaggagaatcgcttgaacttgggaagcagaggtttcagtgagccgagattacaccattgcactccagcctgggcaacaaacacgaaactctgtctcaaaaaaacgaataaacaaacaaaacccattctggatgctgtgtattctagataggaaattcttatcagatacatgatttgcaagtattttctcctattctttaggttaccttttaaatttcttgattatgtcctttgatacatgagtttttaattgtaacgaaatccagtgtacctgtttttgttgttgttgcttttgcagttgttatcctatctaaggatctgttgctaaatccaaggtcatgaagatgccccgccccaccccatgttttcttttcttttttttggagggcaaatgtgggatgagtgggaggggcggggtacatggcccccctgcccacctccctgctccctgccgcctatccttgtgttttctttgaagagttttatgggcttggcacggtggctcaggcctgtaatctgagcactttgggaggccaaggtgggtggatcatttgatgtcaggagttcaagaccagcctggccaacatgttgaaaccccatatactaaaaatacaaacattagccaggctgtagtgctgcgcacctgtaatcccagctacccgggaggctgtggcaggagaattgcttgagcctgggatgggaagattgcgaagagccgagatcttgccacttcacttgagtctgggcaacagagtgagaccctgtctcaaaaaaaaaaaaaagaaaaaaaagagttttatggatcaagctgccatatttcagtcattgatgcagtttattttttatggtatgaagtaggagttcaacttcgtttgtttgtatgtagaaattcagttgtgtcagcactatttgttgaaagactattctttccccactgaatggttttggtatccttcccaaaaatgagtttaccatagatgtgtggatttatttctggactctcaattctattccattggtctatatgtttgcctttatgccagtatcacttttttttttttttttttggttgttgttttccttttttttaatttattttttatttatttttatttattatttattatttattatttatttttttattatactttaagttttagggtacatgtgcacaacgtgcaggttagttacatatgtatacatgtgccatgttggtgtgctgcactcatcaactcatcatttaacattaggtatatctcctaatgctatccctcccccgaccccacaacaggccctggtgtgtgatgttccccttcctgtgtccatgtgttctcattgttcagtccccacctatgagtgagaacatgcggtgtttggttttttgtccttgcgatagtttgctgagaatgatggtttccagcttcatcagtatcactgttttgattaatgtaggtttgttgtagtaagttgtaaaattggaacgtgtgagtctttcagctttattgttcttaaagattgttttggctattcagggccccttgtcattccatttgaatttgagcattggcttttctttttctgagaaaaggggtgttggaattttgttagatgttgtgttaaaaccgtatatcactttgtgtagtattgacatctctacaatattgtcctcctatccattatttaggtcttctttaatttctgacagcattttaattcattgtccatccacttcaaattaggcaggagttgttagcagatgggtggttggctgatcattttattcacatgtgcaaccagaaaattgactttattcccatttctgcctgtcttccctcctttatttactaagaacttactactgggaggcattttgctatattagtgataaataaaatatactgcctggcctattgtacgaattaactgtgttacataattaattgatttgatctggaagagagcaactctcagcaggccgtgagaaattaaagacacaaaaaattatatctagtcagagatacagccttttctctttagaggagatggcatttgggctgcagagatagtgaagcagaacattccagaaagaggaagcagtacatagcagaagtctaatttagttagaatatggggtgtaatgcagagccacagaagtttaagaatggaaagagtgcttgttgctttgaatgctttgttttaataagaatgggaaactgaggttttgagcaggggtaacaatattgacatgatctgagctatgctatgggaaaactaatctctaaataatcagttaagatagtttggaggaaggagagactggtacagggagaccggtttggaattatctagacaaaaagtaatgagggcctaggttatgctagtggcaacgagagtagagtcaaaggatgacattttagatattctatagaggtagaattgacaagattcagcaaattatggatgatagtgagatagagaagtcaaagacaagaggtttcattgctatgtaagaaaatgagttaataccattaactgagttaggaaaaagaagagattttgggaaaaggtggtaagttgggtttttgaacctgtctgcacaggcagttcctgtaccttgataatatcaatgccgtattgcagggagtggatattgtcaccagcaggggtccaggttgagggtatgagagagctgatgatcattatctccatagcttcaagtacaactgtgacatttctgggttttgagggaagctgaccctcttctgcatgtactcattcattcatttcttcagcaaacccgaataaaccccatctacctggcactaccaggcactgtgggaagcactgaagataggaaaatgaattcgacatagcccctgtcctcaagggctctcatagagtttgtgattgattataatacagagaggtttatttatatttgtcataaaatgctttacagcttctttgtttacgtcagctacgttttcttttcatttactccatttgttgtattacaaagccttattctttcttttacttattaattttcccacatttgattttgaactttatattctaggattatagtgtcacctatggccattgtccggaaatcacagtatacacaagctgctgttactttcctagtgctgcacgactcccttccttgtgggcagacaataagagatctcttcttagtatgttagtggaggtgagtcttttccttttaactagaggcaaactcccaggaatatgttcagtgaaaacctttatcaaaacattgtcttttaccaaaaatgtatattatttattttaaatttatatagaaagaagagttttggtcattttatgtttcctaaatagatgccatttattcacatctctggaatctgctataatttaggtaatttgaccttgcaagatgctgcaagttctttaatttgaatatcacagagttactggagtcagtataccatggtgggaaggaaatcactcaaggcattggaagattgggttctaatgcttcaggctatgacaatatcagagttctcttttatttccagctctgtgagcctgaatattgaatgaatagcaaacaaggtcagagtcagtggggagggaagagaagaagcaggccatacagagtttgatacttgtttgtgtgtggtttttgttttgtttgtttgtttggttggttttggtcatgcctcaagctagtgcctctaccatgtctggcattatgacaacataaatttatattttaaacattttttcaggttcacaagggagttcatggatttgttaaagataagactggaaagccaatctctaaagcagtcattgtacttaatgaaggaataaaggtacaaacaaaagagggaggttatttccatgtactcttagcgccaggtgtccataacattattgccatcgctgatgggtaccagcaacaacattcacaggtaagaaactcaaattgagtagcatcatgtaaatttttattcttaataatacttctgttttattttgaaactcttgttagaaatcttgaagggaataaagaaattaaaagtgtgactgcctcttgattatgatatcttgttatccttgtaccccttgctaacaaaagggaaaattttctagcattttgtatactttagatggcaatgcatcatctccttagtttgctatatggggcctaataatatagcagggatacagtacaccttaagcagaatttgtcatgattcttacactttctccttctaggtctttgtgcatcatgatgcagctagttctgtggtgatagtctttgacacagataaccggatatttggtttgccaagggagcttgtggtaactgtatcaggtaaagacattttgatttttagtagtaaaagttaaaaacaatcttgacatttcaatatgagagtgggtcacctctctcatattgatcctgaaactaatcacttgtcttctaatgtctccttatctaaatgtgattttcctggacctctgttctcgcatatgttctcctggcttgcctttctctgccgagaccagctccatcaaggagaccctaacccagcggtgctagagaaattaaagacacacacagaaatatagaggtgtcaagtgggaaatcaggggtctcatagccttcagcgctgagaacctccaacagagatttacccaggtgtttattaacagcaagccagtcattagcattgtttctatagatattatattagctgaaagtatcctttatgggaaacgaagggatgggccaaaataaagggatgggttgggctagttatctgcagcaggagcatgtccttaaggcacagatcactcatgctattgtttgtggtttaagaacgcctttaagcagttttccgccctgggcgggccaggtgttccttgccttcattccggtaaacccacaaccttctagtgtggatgtcatggccatcatgaacatgtcacagtgctgcagagattttgtttatggccagttttggggccagtttatggccatattttggggggcctgttcccaacacttctctttcttcaggtctatactcaaacgtcacctccacggagaggctttccctgatcaccctagctacccctgtcactatctctatcctgctttttttcattatagcactttcataacattatatatttgttcatgtatttgtctatattcaatctctcccactaaaacataagttctgagagagggaggaatctacctgtatcctccaagcctagaacgatggttagcacgcagtgggtcttaatgaagagttgttgaatgaatgaatgatttgctttatattaaagtcataagttcctaggactttgacttatattagttccgctttttcaagatccaggaaagaggaaatgtttgtttacgctggaactaattcatgtcattgcttggattactgaaaggttaggaaggaaaaaaatgtggtaaaatgaatactctgctatactttatctatttgatacaaacagccttagtttatttctaagtgcagcttggatgaggcagaataaccaagttttatcacagggttcctgtgggagagacccttagttgagagaaagtagtatattggaaacatggcccaatcatagatcctgtgtggtgtgtttaaagggttcttagcttgtctcagataaagtgtaaataacttagtggttaaaaacacaggaggtagaattcagccatggtttaaatctggctctgtcacccattagctattgtgaacttagtttttattacttttagtttctaacacttttattttgataaccttgtacaaatttaaaataaacaaggagatttggatgaaatgaaagtttactggaaaggaaaagtataatagaagtcataaaaagcaggttgcagaacagtagacacagtataatttcattatggtaaaagaaaaaaaatacatgtacgtgcatatgcataaagaaagatctggagccaggcatggtggctcacgcctgtaataccagcactttgggaggccgaggcaggtggatcacttgaagtcaggagttctagactagcctgggcaacatggcaaaaccctatctctagcaaaaataaaaaaaaattagccaggtgtggtggcatgcacctgtggtactacttgggaggctgaggtgggaggattacacacacacacaaaagatcttataactaaaaatgatctctgggtaatggaaatgtaaatataggaggttttttggttttggcttttgttagtttgcttatctgtatttttaaactttgtatattgtacatatactgcttctataataataaaggttgttcttaagtgcatgaaatagaaataaaataaatgaggggtatattattaaaagttccattgtaagcggctgcttattaatatccttaaagtataatatcacccacatgatggtttttgtttgtcaggtgctactatgtcggcattgatcctaacagcttgcattatttggtgcatctgctcaatcaagtctaatagacacaaggatggctttcatcggctcaggcagcatcatgatgagtatgaagatgaaattcgcatgatgtctaccggctccaagaagtccctcctaagccatgagttccaggatgaaacagacactgaagaggaaacattatattctagcaaacattgaaaaacacattttgcatatctcccagcataagtaccaagcaaaattacagttcctcttgggagaacactgcattaagaagagagactctcttgcttcttcaaagagctttgggaaattaaattgctaaatttgtattctctgtgaatttcactggcagttttgaacttcccttccttaaagtactctaaacctttaaaaaaaaatctgatttatgcagcagagatgggacagccactttttctttttaatttaagatgagctatttggagcttatgtaataatggcataaagccaactagaggatgttgtattttgcacatcagatgtttactagtggctttagtatttttctttgttttaaatggccaaaagaatccagaaacattaaggcagggacagcagtcagaatcgacataaagctttaaaaactcaaggttttttcaacctactgaggagtacttttctctagttgttaaatagctggagtttttcttattcaggtttaatggaggttgaattgatttttaaacacatataacagtaggaaatgaataaatgggcttctgcatttggctttctacctgttccaaggctagatcggaactggtagactacgctgtaagcaggatttcactacctctcttaaggtttagcaaacttctaaatagcccattttaagggagaacttactaactttattgtgaaaggtctaaatgcccacttgaatgaagctgagagagagatctagcaaaagctaaaactcatgttgtctatctttgaacttggtaaaaacccacaggtgctgctgcttatatctgtgaagcactagcttattctaggaatgcctgattctttaatattgcctaaatcggaacctttttctatgttgcacacatggttttcagatgacccagccatctacaagatctgaattctactgaaaatatctagaaatgtggaagagacctacttgcacattcttaacctgtatttgaacacaaaatatctatacttcatgctccagcccaagcctataccctgtaatagcatactattattgaaatcgcttgaccggtcttgttcacataggcctctgggagtgatttggttctttgccctaatgtttcatttgacggtctctttttgatcaaccaatttttctaaaagttcagtcgaaagcttttaagtatagcttcctcccttgaaaaaaaatgtaaactatgactgctgagtgataaaacactgtggtgtgaaagtgtcatcttcactgccaatcaggcaaagaccggaaagatttgcattttattatgtctgtcttatcatgcaatggaaatgatgctttttgtaagtatgcatcttaccaatgatgtaacggtttaatacctttgaatgttttaataaccaagttgctgctgaacttatactaaatcaggggaccaaaaaacttgctcttatcttctcaaattgtattctatatccattaatgtatcagttatcccaaagccttcaggtggaggggtttaccaccttcctaggtcgttcaaccaggttttgtgaggaatgcattcaaagtggctttataaaagaagattttctttagcaagaataatgaggtcatgtcatttgttaataagtatctgtgataaatccgtggttcaaggttaagccattctggtattctggtattagcaactgtaaattctgccacctcatacatggaacagagcttgtgggatgctaatagttagtgaagtatacatgatttaatttctaataatctttatgttttctttaaggatggtggtgtattgctctttttcagctttatttttaagagtacagtcaggaaaccaacaaggggcctaagagtggctgcccctgcttgggacattacagcaagtgaaacaaagttaatgtgacaagctttgctttgttatcattggtcttcactagaggataccttttacatgtacttctctcttggatcaaatatgtctttaactgtacatctcagtggctggaggccatgccttttaagcatgtgtaaaatttttaaagaaatgaacatacacatagttattttagtaatatttcctgaaagaaaaaccaaattctgctataagtcttgatcttcaatgaacttttaaataatgcatttagctggaaaacaagactttcccagcttgtattacctagaagcgtgaatgtataggatacctgactactaagactatattctcagccctgccctgtcttttatttgcgggtctaatctaatattagaatatattaaccgcttaaggcattgaagccatatgggatggggaatgcatttcttcagtgtttctccgagagactttccatttccttggagttatggcggcaagtaagtatcatagtattaagaaatttgcctaaatctgagttgtgcctttctttactcacaaggcatgggctttgtcctggtgatcagtttgtaagccttcttccttcccagctccttaataaaagcaaagtgattgagtaggtaatgttcaaagtgtctgcctgtgtacatgtacttgtattgattatgtagttcagtaagatgtgcccaagtcatttcagaaagaaagacccttcagttttgatgcattttgctgaacacttgggtagtgagtgggatcctatccagttgaggaatgcttgcaatgctcattgaagggatttgctttgggactttgtcatcttccagaaaggaaacatattgtatatttggcccagtgtgattgattgctttatctttggtaacttttacttgaatgggatttgctgaattaatgactattgaatttaaaactaattatgagttgacaaataaataaaaggtagtgtttatgtctgagcttattgtgtttgagctaacaccaggttactcagtaaccatgacctgctcctccatttccatttattctcaacattaaatagttttatcttgttgttgccagaaatgcacttgtgccaggtattgtccctgctgtatgaaaagcttcttggcaatgaattctgtaatagtgccctacattatggttttctggtggaattgttttaacagtgacaacccaggatttccaatatatttttgttttattgttattaccaaaaattccactatgattgatgttcagtgattttctatagcaacttttttggtaactctttgggtttctgatttgttttagctaaaattttggggatatgatttgggtctttgattaatgtcagctgaacttggatttctagttcatgaagaaatctctcccaatacccatttatcctatttttagcaataattcgttaatgattccacttgattttcagaatattgtcctggttgattttgatttgacagcatacattatgaaatttgaaagtaggttaccattttgaggcagttggatataaattatgtaaatatgtatgattatgatttttataaatggcataacatgagtgtactaactaccttctatgctggccatgctacagattttctggaggtatgacaatagtatttttttatgctcagattaaaaatcagcttttcacctctccagtttttccaagtgatactcccagttctagagcaatctacagctgtttatgtgaggtgcccaacacccattcatctcaagtgcttcagtctttggtttatttcatgcactgtgccttcaaaatgaaatttttaaaagggactttaaatgaagttgaatagtagtttttaaaagtcaatttgtaatttatgtgaaatctaactgtaatgaggtcctttctgttttttatatgtaaacagatctactaatcctgtataaaagttattttacgatg

SEQ ID NO: 36023 - DNA, 89716 bp, Homo sapiens; identical to SEQ ID NO: 36022

SEQ ID NO: 36024 - DNA, 89716 bp, Homo sapiens; identical to SEQ ID NO: 36022

SEQ ID NO: 36025 - DNA, 36145 bp, Homo sapiens
gcagtcatctgactcggtgactcacccgcggccgcgcttcctctgatccgggccgggcgggaagtcgggtcccgaggctccggctcggcagaccgggcggaaagcagccgagcggccatggagctgtgcgggctggggctgccccggccgcccatgctgctggcgctgctgttggcgacactgctggcggcgatgttggcgctgctgactcaggtggcgctggtggtgcaggtggcggaggcggctcgggccccgagcgtctcggccaagccggggccggcgctgtggcccctgccgctcttggtgaagatgaccccgaacctgctgcatctcgccccggagaacttctacatcagccacagccccaattccacggcgggcccctcctgcaccctgctggaggaagcgtttcgacggtgagcgctcccggcccggccgggagttgtcctgggggaggggagaggcggaccaccccggagcgctgtgcagaccctcaccaccccactgcgcagacgagaaaccgcctgggagctggcaggcgatctgcccagcgccacatggactgaacccacgctcttgcccccaccctcctactgcttcttaagggacaccttgggtgctcaggaaccctggtttgagagccggatagtaagtggaagagggagtttgctctgaggccttgttgggcaaatggcatggacggaggggacaccggagctggggaggaaagtgacagctccttatttgaaggacgtgcaaagggataagttacccgaagggcttagacaagctctcttgagggaccaggaatcccccaaagctgactgtcatttataggccagtttcgccccctcacctctcctcacatctcctggtaacagctcaaatggcagaagtcctcagtttcgagcactgcctaaaactgccctctctcctaaaatctcttccatataaaatgtgacatgtttgcatctgactacgtttctgcggtcagtggttaggcagtatccaactttgtttctcaacaccgatcatgttgcctgctctccctgcttcctcttttacagacccctagatagcgcctctgtctctctcaccctttggctgcagacagggtgagttttgtcatgggagtcagccaatcacaccatagacaaggcaggttcccctggggagatgtttgaagacgccacacactgtcccctcagtgtgagacctgtgtaggtgggactgtcctgaaggcgtatcgtgccctgcagaattgtaatttggtgctaactgtactgcctcctggcattccccaagcctgtcgctgtacccagtggatactatagagcttaagtgtgcttgcaggaccctgaacaggtggggagggaatgtcaaactaactgaataatgtgttctgaccccagataggacaggtgcctaggctcaagctgcagaggcccaagatgctgatggcagaaatggttcattctctacaatcagaaggctcatggtttccttctgttttgtacaactaaatgggtattatcagtctctattttagacacacacactaatgagcctttggtatccaatctgctaaggccagagtggggttaagatgtagaaccaaagtgtttggttgcattgggatattcagaaagattgcatggaaagtacatgaaggttgtctcagaagatcatgactagggttggaaatctttttaaaaacaaacacgcttattatgtttgccttggagttcagcttgtagaattggattttccttctgtgtcatactgctaagtaaaacaaggacttggtaatatgctgaactgactgtgacaagaaagcatgggtgatgtaagttaacaataggtagataaccaggacttaaatcagctgagatggttcgaaggcaaggcttggtatttcaaggcatgtgcgggtgattacctgaagagtttgcctaactcatggcctctgagtgaagcagccattaattatgcctggtattattaggaagcaggtcataaaatgtgttggcccttatggctaagacttgaaggcatgcatgtgagcattctaggaactcagaaggagcagcaggtatctcagagtaaaagcacagtggagttggaaagatttggaaatatgggagtgttcacaaagtgcgacgtggtcaggaacacacagtctaggccccagattgttcagcatcacatagcccctgtctctgaagagcccaggttgtatcacaaaccttgctttgaaacagtatgctttttgcaggcagagagtttggctgttagatgcatagctgcttctttagcttctagaacagcgttcatcacatgctagtcactcatttttaaaaataaacaaatagcttcactccttcatttcctggaaggctaaactaacccacatacctttgacatactgcctcacagccctttgagttttctgttagaattttactacctagggtcaaggttctaagccagcttccaactctgatctcaaagctgccagcagctttaatttcttttttaaaaaaattttaattaaggaaaaaatacacataacataaaatttaccatcttaaccttttgtaagtatgtatttcggtggtcttaatttcctttttaatctgtcagggttttcctatgagaagggccctcaacacctacatccattccattctctcattggttaacttccatacacttccaaacatgtcagaattttccgacctcttctgcaaaaaagcataagacgttcttacacataagtagcatatataaccttctggcttaccaaaatctgtaaaatattatttaaacagttgccctgaagcctatctgatcttttttatttagtgcctttacatttttatttaatattctgatttttggataccaaaaacaattgctctgaagcctgtctgatcttttttatttaatgcctttacataatttttatttaatgcctttacagaatttttatgtatttaacatttaatgcctttacaatatttaatgcctttacagaatttttatttaatattctctgatttttggataccaacaaaaggtactttttttgtatttaatattaatattaatatttaatgcctttacaatatttaatgcctttacagaatttttatttaatattctctgatttttggataccaacaaaaggtactttttttttttttgagatggagtctcgttctgtcacccaggctggagtgcagtggtgcgatcttggctcactgctgcaacctccacctcccgggtccaagcagttctcctgcctcagcctcctgagtagctgggattacaggcgcctgccaccatacccagctgattgtttgtatttttagtagagactgtgtatttttagtttcactatgtgggccgggctggtcttgaactcctgacctcgtgatcctcccgccttggcctcccaaagtgctgggattacaggcatgagccactgcagctggccaacaaaaagtaaattttaaaggctctggtgagaattctggaccttcttttggggctttatatgtaagctaggatacttttgcaggaaggtaacaggaactctgactcaatctggctcaaacaataggaaaacttatttcacacattaggatgtccaaaagtagggatgaatttagggcaagttgaccaagtggctcaacagtgttaccagggatccatattctttccatctctgctctgtccactttagtgtagtggcaactagtccagctctcacatacagagaaacgaagttttcttgtgatttgctcagaactccccctaacccccacatcctatcactggtcagaattggtttttcattcccaagagtgatggattaccatgatggtttcattattggttcttaacggggcttcatatgtcacttcagagtgtggggaagcatttaaaattcccatgcctgaatcccattctaatagattctgattctgaaggcatggacgttgggattttcaaaaaacttcccaagtgattctaatgtacagcttggggtgagaatctctagttggacttacaatgggcagcatggatttgaggagttaactacaatgttactagcacatctgttttaaaaatttggctaaaatccttctaaaatgtgtttacatttatttctcaaacagatatcatggctatatttttggtttctacaagtggcatcatgaacctgctgaattccaggctaaaacccaggttcagcaacttcttgtctcaatcacccttcagtcagagtgtgatgctttccccaacatatcttcagatgagtcttgtaagtacctatgcaatgtgagtgtattatatcccaggtgctcgctgacggacttaagtgccaaaaactgactccatgctaggaaccactgagttctcaaccagtgagtttatgattcctattttaaaaataacctttaaagtctgattataaaagtagtacatagtctttgtggaaaatttattaagtacagtaagtgcagaagaagaaataaatcactcataatcccagcagatagaattaatcactgtcattttaggtgtatttttttgcagagtaaaacatgtaaacattttacatagacataaatacaaacatgataagcattgacatgaaaatggcagtaattctgtacatgtgcttcttgtatttttgttgtatttttatatcatgcttttttgcaaaatacattataaattaaacatgaatttcactagttttctgtgatatcattttcaatggctgaataatgttctgtcactatatggatgagctgacttgggtaatctcttttggacatctaggtaatttcttaactttttgtctttgaaaacatctgtatccatgatctctatttataatctaattttacagaaagataatgcagagctaggggagagggtgggtacagcagtttcatttgtaatctgctgtacaatataatcaacatttagctgtatgattttgtcctcgttgttgcctaaaacgttattctctagggcttttcccaaattgttttagaacaaataagtgggcgtgccatttctatagggtatactgcctgagaataatgtggaattgcaccaaggaatcaaagaagggcagtataaggacatgtgtaatataagattcgtgcaagaaagagcagacaggggaactaagtgtaaagatagaggctggacgctgtggctcatacctgtaatcccagcactttgggaggctgaggtgggtggatcacttaaggccaggagttcaagaccagcctggccaatatgctgaaactgcatccctactaaaaaatacaaaaagttagccaagcgtgttggtgcgtacctgtaatcccagctactcgggaggctgaggcaggagaatcacttgaacccaggaggcagaggttgcagtgagctgcaatcatgccgctgcactccagcctgggggacagagtgagacagtctcaaaaaaaaaaaaaaaaaaaaaaaaaaaaaaaaaaaaaaaaaaaaaaaaaagataggatgccacaaatttagagaaaagagcaactccattacccccagactgcctcacagttaagtacatgtcttcatcctgctggtttagatgagatttctcaataatacatctctttgaaaaaaagctttctttctcttcaattccatagctgttcttagaagagaaataggaaaattcaccaacatcaggtatcatttcaattgatactcagcactcagacaccatgtgaagtaggttttgcaacctgaattgagatggaaatggtcattacgttgccaaggaatctttgctgtccattggcaatacagataacagattgtaaattccacaaaatgaaatgtatcgagactagagagtcatagcttatctttcagtcagttctacaaaccctctttattctgaaagggaagtttcttgagacaaggttattgtgaaattttcagctgaagaataaactagtttttagtctttaaactagttgatgatgatgataaaagtaacacatatgaatggaaataacaagatatcaaatgtccagagtgggaggacatgttggaggaggtgacacatgttaaagcaccactatttattaaaaataaaaatatgcatgccctgagaagtggactagtttttactgcagataaatggacacataaatcaaggatgtttgatgcagtttgcctgtaatgtgaagaactgtcaataaaactcaatgtccatcaatagaggaatggctaaatacatcttgtcaatctatactaaacagtataatcacaacagttaagaataaagaagcagtattactgagaacacacatggagaactgacaagataaactgctgagttgaacaaaggaagctgtataattatgtgtagaggtggaccctgtttatatatcaacacacgtgcaggaacacacgcataaagcaatactatattttctccttccgtgtacatctatgtcaagcctaagaaaatgcccgataagtatttcctctgaggaaggtagagggagttaggtgagtatctcaaaggagattttagccttatctatattatattgcttttaaacagaatatatagatatgtcatttgtatattcaccctccaaaacaaatgtatttatggtgcaaaaagatacagaatgggctaactgaaaagtcaatgatataattcctttcacacttcagggaagtgatcattgttaacactaataacttggttgtgaagtaaaaatggaaattctatagctatgtgtccatatatttagaaaaccaaatttctaattgttatatgtattttccactgagttgaattacagtcctgtttaatatcagccagttgtcaactattagaaaataattggtatcaaatatatgcaatatattaatgttttttaggtgactgtgctatttctggaagatctcaaaactagaatgtggcaaaaaaatgtttttaaacagtgaccaatggagcagtgagctctaggtagctgattaagaatttgatacaggctgggtacagtagctgacacctgtaatcccaacactttgggaggctgaggccggtagatggcttgagcccaggagttcaagaccagcctgggcaacatggcaaaaccctgtctctacaaaaaaaaaaaaaaaaaagaaagagaaaaattagccaggcgtggtggcacatgcctacagtcccagctacttgggaggtcgaggctgcaatgaaccgtgattgtgccactccactccagcctgggcagcacagtgagactctgtctcaacaacaacacaagaatttgctatagatgtagaggaaacataattagactatgctcataaatagcaatatagttcttagcctggcattggctaactcatctaatggagtgtggttatctaatggaaaaggctatcttgtcagaagactatcacctgagatgctcacactactgatagagcacttttgcctacctgcagctaactattctgtgagcatctgaatggtggtggtggtagaaggtgataaaccaccccagaggacacagtattaaatcattaatctccagcccatcagtgtctttgccgtggcaaagtccaaagctgttacaccctttagctttcaatctctttaccatctgtgggtttactatgtggttgattccactccagacctctctaaaagactaaatgactattgggccaaccttagagtgtgcttcaaagattgaaagattagcctctcaccagaagcagctaactggagtcccattctggatgatgtgaacttttaattgagtgggacaaagctgaattatttttattgagtgagacaaagctgaactaagctaaagggatttggagagtaagtcttaaggcagatttggatgatactgagggaaggtgggtacagggcaagtagaaaattctgaatgcaaaagagtggagatactctctggccttaaagggagtagatttgagcgacacctagggcgttaccaaggattagtaggaactgaggaatgtttgcactttcaactaaactcttagcttaactaggaccctactctgttgaggagaagttggagagactaactcttttaggaaaatgaggaaacatggagttgacacccaaattcccgttctgagtgactcaagtgactggatggtggtgctgtgactcactgaaatgaggaacacagaagaccagcaggttgaagtgtgcggaggagggagggaagagttctgttggggcatgtggagtcgaaggaacctgcaggacatccaaatggagatgtacaggaggcagttagagaaataggtcatgtgcttgggagaaaataatagtccagaaatatcaatgacatgtttaggaaacttattgtgtgtcattgagggattaacaaaagtgtgtgtgtgattttaaatcctcaatacagatactttacttgtgaaagaaccagtggctgtccttaaggccaacagagtttggggagcattacgaggtaagttccatgcagtttcattgttactttccagtaaaggaaaattttcagttggtgctttgtgaaattaagcacagcaaaactttgccgccttagatcctttacagaatgctttgttatgtagttccaaaatgatttccattgaacatgtactacataaagcatgggagaggtcagcacagtggctcacgcctgtaatcccagcacttcgagaggctgaggtaggtgatgattgcctgagctcagaagtctgagaccagcctgggcaacatggtgcaactccatctctacaaaaagtacacaaattagccaggcatagtggtgtggacctatagtcccagctactctggaggctgaggtgggaggattgcttgagtccaggacgttgaggctgcagcgagcctagatcacaccactgcattccaggctgggcaacagagcaagacccctgtctcaaaaaaatacaaataaataaatacagcatgggagaaaactcatttgacctctcaaaaaatgtttgaaggttattacattcctgcagtgctgtaattcattgatgctcttgggactgtaatgtttatagcactacacatggccccaacctgtcctgattagggaattttgtttcagctatcacttctgttgacttcagaagcaagcatctctcttccctaattttaaattcctgtagatttagaaacataactaagtttgtataaggaacagtgtcaaaaggcaaatatgctatagagttggttagaggcagtgggcagggagtaacttgaaaagcttctcatgagaatttcagagtctgaacttcaaagtttgacctcaggacatttgctgttcaaaagtttcttttacctttctttctaggcagataagatactgtactgacttccgaatagcagagtttttagaaagggaatttaaaaaaacatgaactaaccaaacttagtcattaaaataaaggcttgggattgatcatagtcactcacacctgtaatcccaccactttgggaggttgaggcaggcagatcacttgaggtcaggagttcgagaccagactggccaacatggtgaaatcccatctctactaaaaatacaaaaaaaaaatgagccaggcatggtggcgcatgcctgtaatcccaactacttgggagggtgaggcaggagaattgcttgaacctgggagagggaggttgcagtgagctgagctggcaccactgcattccagccttggtgacagagcaaaactccatctcaaaaaacaaaataaataaagatttggaatctgactcagagtgttacctaaaataatcattgttatgctatatattttataccataagattataattttattcaaaatagaatatgaaaatatctagatatttactacaaatgtaattttatttatgtataatattagtgattttaagcttttattagtccaatctgcctgtctcatctgcgtctgctaaggagaagagacgcttttttttttttttttttttgagacagaatcttgctctgttgcccaggctggagtgcagtggtgaaatctcagctcactgcaagctccgcctcatgggttcatgccattctcctgcctcagcctcccgagtagctggtactacaggcgcctgccaccacgcctggctaattttttgtatttttagtagagacagggtttcactgtgttagccaggatggtctcgatctcctgacctcgtgatccacctgccttggcctcccaaagtgctgggattacaggcgtgagccactgcgcccagccaagagacgcttattgatgtttgttctgatccataccaaaataaagaactctagcaaggctgggcacggtggctcacgcctgtaatcccagcactttgggaggccgaggtgggtggatcacttgaggtcaggagttggagaccagcctggtcaacacagtgaaatcccatctctactaaaaatacaaaaattagccgggcatggtggtgcacgcttgtagtcccagctacttgggaggctgaggcaggagaagtacttgaacccgggaggtggaggttacaatgagccgagatcgcgccactgcactccgtcctgggtgacagagcaagactccgtctaaaaaaaaaaaaaaaaagataaaaccactcttgcgagtatgcagtgactagatttctagtccaagaagtccatattttctgtttaccatcagactttcagagtaatgtactctaaactgatcattattgaacgtaatgtcacttaacagaaactttcagagttattcttcccagcatgaacctgtacttgacgaggttggagagacaggaaggcgtagcaaagatgactgaactgttcttaggttaaaaattccctggctatatagctgtcagctagaatgaggaatctgaataaagtcaaggccagttagaagaattagcctgtcaactagtatattaagggaataatccacttgagtaaaaaatgttcagaaggtagtctttgcagctataagtaaaatgctgtatattgtaaattggcctttatttatagtttcatggtttttccagccatttttccctgttgcatttagataccttctaaaagtgactatatttgattataaaaattctttctcatgatgccataaatttattaaggaaccagtattttattaaattactattcttcttttgtctatattgaaacaacccccagggtatgggtacaatgaagtaaagcacttttattagatgagtagagaagtgcaatggatttttttttaatttggctttgattttagaaattatggtagagggtgtaggtataacaatatattttagaggatagaggtataacactatattcaattatatttgccttacctggttatgagtctgtttgaataatataacttttatcatctcaatttgttgatttataaattaatgcaataaattttactttcctcaggtttagagacctttagccagttagtttatcaagattcttatggaactgtaagtatgattattatatgttactaaaaattgttagacaaattgctaatagaaaaaaatgtaacctgtttagctattgcttcctgaagatttcatttccccagatatttgtcttagccggtaaatgtaaatttcatacatttttgttgttctaaattaatattttatgaaatgcttgtataaatagatttagtcttcattgagttcaagacaacagaaaattctaaaactaaatcaaaattttattttgtcatagttcaccatcaatgaatccaccattattgattctccaaggttttctcacagaggaattttgattgatacatccagacattatctgccagttaagattattcttaaaactctggtaagtaattacttcattctaatctgttgtctattctgaagatgtctcctttatgttgtaactttatgttggttactattgtgtagtttggaacaggggaatttgtataagcactgggcattctttcctcagttcctagggaagtgtatttcctcagctgtgacgtggaggtccccttgagaatcaccctcctgttttcagtgcgagagccacgtataacatgtatttagccaagactgttaagagaaggacagtttaaacactgcccattggccctttacatatactcccatttgtcaaatcatgtgtctagacttttgattaggaatacatggccacccaggtgcggtggcttacacttgtaatcccaacactttgggaggctgaggcaggtggatcacctgaggtcaggagttcgagaccagcctggccaacatggccaaaccccatctctactaaaaatacaaaaattagccaggcgtggtagcgtgcgcctgtaatcccagctactagggaggctgagacaggagaattgcttgaaccctccccgggtggaggttgcagtgagccgagatcgcaccaccgcactccagcctgggcgacagagcaagactctgtctcaaaaaaaaaaaaaaaaaaaggaatacgtggccaccacaccatacttctagttagtgccatttaaattttgtgaccacctcttactttttttgtaagtggcattagaaaggagtccgggagctcctttatacctagggaactattccaaaggaatatggaacctcaggggtggtatgggttaggaagaaggttgacaataactgttttctcctatgggcttttttttattggttaatccccaccatcacctgccaatttgtaggggtggggaggtttcctcccatgtttttttgcaccttcacttgatcattatgatgaaactatgctatttaaaaattattattattattatttatttatttattttgaaacggagtttcgctcttgttgcccaggctggagtgcaatggcgcgatctcggctcactgcaacctctgcctgacaggttcaagcaattctcctgcctcagcctcctgagtagctgggactacaggcatgcaccaccacgcccagctaattttgcatttttagtagagacggggtttctccatgttgaggctggtctcgaactcctgacctcaggtgatccacctgccttggcctcccaaagtgctgggattgcaggtgtgagccaccgtgcccagccaaaaattattattattattattatttttttttctttttagttgaagtcttgctctgtcgccaggctggagggcagtggtgcaatcttggctcactgcaacctccgcctcccggattcaagcaattctcctgcctcggcctcccgagtagctgggattacaggtgcacaccaccacacccagctaatttttgtatttttagtagagacagggtttcaccatgttagccaggatgttctcaatctcctgaccttgtgatccgcctgcctcagcctcccaaagtgctgggattacaggtgtgagccaccacgcctggcctaaaaattatttttacatttacattaatactctgaattttttctccaaaagacagtcttgtcacttttaagaaacagatgcttagtgtaaaaagtttaaacaatataaatgtgcataaaataggcagtcatcccataatttcatttgccaaagattgacatacatttttatgtgctacttgtctcattttagacttaaaaaatgaatatactaggtggggtacagtggctcacgcctgtaatcccagcactttgggaggtggaggcaggtggatcattcaaggtcaggagttcgagaccagcctgaccaccatggtgaaacccatctctactaaaaatacaaaaaattagccaggcgtggtggtgcacgcctgtaattccagctacttgggaggctgagacacaaaatcgcttgaacctgggagagggaggttggagtgagccaagattacgccactgcactccagcctgggcaacagagcaagactccatctcaaaacaaacaaacaaaatgaatatattaacatatacaatgtgactttttaaaaaacttaaatgagactgtacttttgctaccccccacccccttttttttctttttgtgagacagagtctcgctgtgttacccaggctggagtgcagttggcacaatctcggctcactgctacctccgcctcctgagttcaagcaattctcttgcctctgtctctcgagtagctgggattacaggtgcccaccaccacacctggctaatttttgtatttttagtagagatggggtttcaccatgttggtcaggctgatcttgaactcctgacctcaagtgatttgcctgccttggcctcccaaaatgatgggattacagatgtgagccaccacacctggcctttgctactcttttaacagttgaatatttcattttatttagtctcatgctgatggacatctaagttaattaactattatcataaatactactgcagtgttttatacatatatatttgtacacttgataagattatttctggaggataaattcttagaagtgaatttctgggcttaagatgtatatattttattttttggtacattttaacttttggtatatactgtcaggctgccttctagacaggtcggtcatagccacatatgcttggccaacagtgtggtacatctttgccatgtttgttgctgatctaatgataaaatatatctccttgttttaatgtgcacttccttgctttttagtgaatataagccttttttttacatattaattatttgtatattttatattataaactgtaagtttcctttttttttttttttttttttttttgagacagtcttgttctgttgcccagactggagtgcagtggcacaatcttggctcactgtaatctctgcctcctgggttcaagcgattcttggacctcagcctcctgagtagctgggattacaggcatgcaccaccacacccggctaattttttgtatttttagtagagacagggttttgccatgttgcccaggctggtctcaaactcctgagctcaggcaatctgcccacctcggcctctcagagtgctaggattacaggcatgagccactgtgcccagctgtaagtttattttctatgtttattttgtcgtctagaatgtgaataccttctttattggtttaatgttttaatgttatagttgtctatagattgtgccactgatacttttatatttgcttatatgtatcttatttttaaaatttaattaatttaaattttttatatttaaaaaaaatttgtgtagagatagggtctcaccataatgcctcaaactcctggtgtcaaatgatccttccaccttggcctcccaaagtgttgggattataggcatgaggcaccatactccaccttatatttatattatatacttacccatcatatgttgttgtgaattttttctaaatttctaaatttgttttaataactgtgtttataatgcctgtagacatttacattttatttatttatttatttattgagacggagttttgctcttgttgcacaggttggagtgcaatggtgcggtctcagctcactgcaacctccgcctctcagattcaagtgattcttctgcctcagcctcctaagtagctgggattacaggtgcccgccatcatgcctggctaatttttatatttttagtagaggcagggttttaccatgttggccaggctgatcttgaactcctgacctcaggtgatctaccttcctcagcttcccgaagtgctgggattacaggcgtgagcccccatgcctggcaaaatttttttatttttattttttagcaaagaaccctgctaacattttttttttttttaagagatggggttttgccacatttcccaggttggtcttaaactcctgagctcaggcgatccacctgccttggcctctcaaagtgctgggattacaggcataagccacccatgcccagccacaagttctttaaaggagtagtatatttcaatgttatcctttctatcatttttggctttgggaagtatgcttagaatcctcctctacaacaaggatataaatataaaaatagcctcttaaattttattttagtatcattatactttttcttattaaattcttgattctattagaatttactttagtgtatcaaacctattaggtattttaattttactttccaaatggttagccagtaatcccctcatttctgagcaatctacaattccctattgctttcaatgacaattactaaatactaaattcagttataattattaaatactaaattccaataaatatggaagttactttctgaagtcataatctttactactttatcttcttgggccagtacatgtggttttaatttctatagctttagcagtttttatttttgtttttgtttgtattttgaagtcttaaacttagggaaaagttgtaaatagtgtgcaaagaactcctatatactctttacccagatactccactttaaaatttttattgtatttattaaatattaaatttatttaagctatatatttgctttattctccctctctaaaaatacgttttctaaaccacatgggcacatatgatgcatcaatacccccttaatatttcaggatgaatttcttaaaaaaaggacatttaataacttcagtacaaccatcaaaatcaggaaattgacacaatactgcatctaatacgcagaccccattcaaatttcgattgttccaacaatgtcttttataggttccacatcccatccaaaatcaggtgttccgtttacttgtatgtctctttggccaccattaatctgcaactgactatctttccttgtctttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcctggctaattttttgtatttttagtagagacggggtttcaccgttttagccgggatggtctcgatctcctgacctcgtgatccgcccgcctcggcctcccaaagtgctgggattacaggcgtgagccaccgcgcccggcctccttgtcttttaagaccatgacatttttgaagagtataggccagttgctttgtagagtatgccttagcttgtccattttccagaagataatattcagttatgcatttttggcaggaataaagcagaaatgatgctgtgttcttctcagtgcttatcaggtgacacaatgtcttatttatttcatttctggtattgttcacttataacttgcctaagatgtcatctgccaggtttctccactgtgatgttaattaaaaagcattttgtacttaacaagtaattaagtatcttgtgggaagaaatcttgagaccgtgtaaaatcccattcttcatccagcgttcactcactagttttagcatccacagatgattcttgcctaaatcagttattactaaggtggctaccgagtggtgatgcttctaattccatcactccttctatcatttattacttggcatttcagtgtaaggtagagcaatcccttctcttttatttaagtattcgttatttttatcagtgtggactcatgggttactatgttattcaggattgtaatctgttactttccctgtttttttgtttgtttgtttgagatggagtttcgctcttgtcgcccaggctggagtgcaatggtgcagtctcagctcactgcaacctctgcctcccaggttcaagcgattctcctgcctcagcctcctgagtagctggagttacaggcatccgccaccacgcccagctaatttttctatttttagtagagatggggtttcgccatgttggccaggctggtcccgagctcctagcctcaggtggtccacccagcttggcctcccaaagtgctgggattacaggcgtgagccactgtgcccagccactttccttgtttaatagtcaaattatcccagctttggtcactggaagtccttcaagttgcctcttacatcccttgcaggttccctttaattttggagcactgtcttactttttggcacatgatgtttcaggcctgtcttccctgtcccggtcttttctgtgtcctcagacttttcttcaaggaacccttttagtggtgaacaacattttgaaaccaatatctaggctctaggtgtgctcattgctactaggatgtcattgcttgtagaccctctgagcagagagagctagaaaacgtgtgtacctgtgtatgtatacatttgtatgaatacacacacatctttccctatttctatatctgctaatatcaggagttggcaaaccataccccaaaggccaaatccagttcaccatctattttcacaaacatggggttttggtctcactgtcacccccaggctggagtgcagaggtatgagctcagcttactgcagtctcaacctcccaggctcaagcaatcctcccacctcagcctccagaatggatgggactaccggcactaccggcatgtgtcacgatgcccagctaatttcttaaaaattttttagtagagatagggtctcactatgtcatgcaggctggtctcaaactcctgggcccaagtgatcttcctgcctcagccttccaaagtactggggttacagatgtgagccaccgtgtctggcctcacaaataaagtttacaggaatataggcacgtacgtttgtttacatactgtctcactctacaattgcagagtggagtaggtgtaacaaactctatggcttgcaaagccaaaatatttactgtctagccctttatgtaaaatgtttaccaacccctggtctatgttaaaaaccatgagtttgtattaataagctcaattccagttaacacctatatttctggctcccttctctgagagtgaaaaccctccttttatcctcaatatatttatctgcacaatccccttgtatgtaaaagatgtcctaactccatcagccaaatcccttcagccttgatgaagagggagtctttaagttttgatgatcttgttggacaaatcttctcccttattgtttttcatcttttaaaaatagtgtttatattttatataaatattatattggttattcctctagagtatatataaaattaataactcaatttgcccaaaaatttctctgggggaattgtattgagtttgcaatgaaattcttggttgggactcaaatttcagaactgtgggaattataagtcctggtacttaaatgaatgctccgtttttcctttgctctattcccaaacacagtggcagccaagaaccattttgcattcttggcagactgctacatattgggaatcttgctctcctcccatacagcaaagttacaactcaccgtctagaataaatacaacatctccagaggctttttgtatactgatgtgtcatgtgaagtatatatgatgaagaatttctatttcttctcattctttctttgctgaaagataaattttagccaggtgtggtggctcatgcctgtaatcccagcaatttgggaggccaaggcgggtggttggcttgagcccaggagttccagaccagcctgggcaacatggcaaaaccctgtttcgacaaaaaatacaaaaattacctgggcatggtagtgggcgcctgtagtcccagctactcaggaggctgaagtgggaggatcacttgagactgggaggtcaaggctgcagtgagccaagatcatgccactgtattccagcctgggcaatggagtgagaccctgtctcaaaaaaaaaaaaaaaaaaaaagttttaaaggaagcagacatattggaagcaattccaaatgtagataggtaatatggattgtatatgatatctgcagtaaataatttttaaatatgtttgcttgcaggatgccatggcttttaataagtttaatgttcttcactggcacatagttgatgaccagtctttcccatatcagagcatcacttttcctgagttaagcaataaagtgagtaaattgtattgtactctgtctacaaaaacattgggtatagtttcattacaagtttgtagcttaaatgtttgttcttatggatagaatcaaagtgtaaaaatcagatgtttatggtttttaatttttttggctgtgacttagcattttacatccataaaactttttttgttattgttataacggttactgtaattgttactgtgaatataaacaatcttggggaagtgtaaatcgaaatttaacaaggtagaagccctgaataattctcaaattacatatggttaagataatatatttatcaagttgtccaacagtgtatttgttttaaacataattgtttggaaatccataaatgactatttttctctctgagaaactacatgaagtagggaattttagaggtgagagtgttttcttagaaaataatggtagtctcagttaacagtgttcaaattgactgtatcatggaccaatggatctgggagggaccctcagtgtcccctagtttaatacccctgtaatacaaagaaggtacctgacatccagagaaatgatgtgccttgtgtaaagttgtggttaggaagggacagagccaggactctaaattctgtcctccggccataattccaaaactttctccaatgttaggtatgtaggctaaaatgtgctaacagcacttgtgtttttgtttccttttgttttactttttattatggcaaatttcaaacatatacagatacagaatagtttaatgaactcccatgttctcatcatgccagttcaaacatgaatacatggtcaaccttgtatcacttaaactcctgcggacaagccctgccccatcctgttgttttgaataaaatccatcattgtatctcactgtaaaaaggcctgttctttaagaaaaaataaccataatacatgattgcagctaaaaaattaagagtaatctagacagctaatcaatattcacatttcggggggaggagccaagatggccgaataggaacagctcccgtctacagctcccagcatgagcgacacagaagacgggtgatttctgcatttccatctgaggtaccaggttcatctcactagggagtgccagacagtgggcgcaggacagtgggtgcagcgcatcatgcgcgagccgaagcagggtgaggcgttgcctcactcgggaagcgcaaggggtcagggagttccctttcctagtcaaagaaaggggtgacacacggcaccgggaaaatcgggtcactcccacccgaatactgtgcttttccgacgggcttaggaaacggcacaccaggatattatatcctgcacctggctcggagggtcctacgtgcacggagtctcgctgattgctagcacagaagtctgagatcaaactgcaaggcggcagcgaggctgggggaggggtgcccgccattgcccaggcttgcttaggtaaacagagcagccgggaagctccacctgggtggagcccaccacagctcaaggaggcctgcctgcctctgtaggctccacctctgggggcagggcacagacaaacaaaaagacagcagtaacctctgcagacttaaatgtccccgtctgacagctttgaagagagcagtggttctcccagcacacagctggagatctgagaacgggcagactgcctcctcaagtgggtccctgatccctgagcagcctaactgggaggcaccccccagtaggggcagactgacacctcacacagccgggtattcctctgagacaaaacttccagaggaacgatcagacagcagcattcacggttcacgaaaaaccactgttctgcagacaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcacctctcttcttccaaaggatcgcagttcctcaccagcaatggaacaaagctggacggagaatgactttgatgagttgagagaagaaggcttcagaagatcaaactacgagctacaggaggaaattcaaaccaaaggcaaagaagttaaaaactttgaaaaaaatttagacgaatgtacaactagaataaccaatacagagaagggcttaaaggagctgatggagctgaaagccaaggctcgagaactacgtgaagaatgcagaagcctcaggagctgatgtgatcaactggaagaaagggtatcagtgatggaagatgaaatgaatgaaatgaagtgagaagggaagtttagagaaaaaagaataaaaagaaatgaacaaagcctccaagaaatatgggactatgtgaaaagaccaaatctacatctgattggtgtacctgaaagtgaaagtgacggggagaatggaaccaagtcctactctgcaggatattatccaggagaatttccccaatctagcaaggcaggccaacattcagatgcaggaaatacagagaatgccacaaacatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagacagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctgaaagagctcctgaaggaagcactaaacatggaaaggaacaaccagtaccagccgctgcaaaatcatgccaaagtgtaaagaccatcgagactaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagacccatcagtgtgttggattcaggaaacccatctcacgggcagagacacacataggctcgatataaaaggatggaggaagatctaccaaggaaatggaaaacaaaaaaagtcaggggttgcaatcctagtctctgataaaacagacttttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccctactgtcaacattagacagatcaacgagacagaaagtcaacaaggatacccaggaattgaactcagctctgcaccaagtgaacctaatagacatctacagaactctccaccccaaatcaacagaagatacatttttttcagcaccacaccacacctattccaaaattgaccacatagttggaagtaaagctctcctcagcaaatgtaaaagaacagaaattataacaaactatctctcagaccacagtgcaatcaagctagaactcaggattaaggaactcactcaaaactgctcaactacatggaaactgaacaacctgctcctgaatgattactgggtacataacgaaatgaaggcagaaataaagatattctttgaaaccaacaagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcaaagcagaactgaaggaaatagacacacaaaaaacccttcaaaaaattaatgaatccagaagctggttttttgaaaggatcaacaaaattgatagaacgctagcaagactaataaaaaaagagagaagaatcaaatagacgcaataaaaaatgataaaggggatatcaccaccaatcccacagaaatacaaactaccatcagagaatactacaaacacctctatgcaaataaactagaaaatctagaagaaatggataaattcctccacacatatactctcccaagactaaaccaggaagaagttgaatctctgaatagaccaataacaggagctgaaattgtggcaataatcaatagcttatcaaccaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccgggcagagacacaaccaaaaaagagaattttagaccaatatccatgatgaacattgatgcaaaaatcctcaataaaatactggcaaaccaaatccagcagcacatcaaaaagcttatccaccatgatcaagtgggcttcatccctgggacgcaagcctggttcaatatacgtaaatcaataaatgtaatccagcatataaacagaaccaaagacaaaaaccacatgattatctcaatggatgcagaaaaggcctttgacaaaattcaacaacccttcatgctaaaaactctcaataaattaggtattgatgggacatatctcaaaataataagagctatctatgacaaacccccagccaatatcatactgaatgggcaaaaactagaagcattccctttgaaacctggcacaagacagggatgccccctctcaccactcctgttcaacatagtgttggaagttctggccagggcaattaggcaggagaaggaaataaaaggtattcaattaggaaaagaggaagtcaaattgtccctgtttgcagatgacatgattgtatatctagaaaaccccattgtctcagcccaaaatctccttaagctgataagcaaattcagcaaagtctcaggatacaaaatcaatgtgcaaaaatcacaagcattcttatacaccaataacagacaaacagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaaaattccatgctcatgggtaggaagaatcaatatcatgaaaatggccatactgcccaaggtaatttatagattcaatgccatccccatcaagctaccaatgactttcttcacagaattggaaaaaactacttgaaagttcatatggaaccaaaaaagagcccacattaccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataacgctgcatatctacaactatctgatgtttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacaggaaaagaaactaccatcagagtgaacaggcaacccacaatatgggagaaaattttcgcaacctactcatctgacaaaggaaatatccagaatctacaatgaacacaaacaaatttacaagaaaaaaacaaacaaccccatcaaaaagtgggtgaaggacatgaacagacacttctcaaaagaagacatttatgcagacaaaaaacacatgaaaaaatgctcatcatcactggccgtcagagaaatgcaaatcaaaaccacaatgagataccatctcacaccatttagaatggcaatcattaaaaagtcaggaaacaacaggtgctggagaggatgtggagaaataggaacacttttacactgttgggactgtaaactagttcaaccattgtggaagtcagtgtggcgattcctcagggatctagaactagaaataccatttgacccagccatcccattactgggtatatacccaaaggactataaatcatgctgctgtaaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaagaacaaaaagccaaacaccgcatattctcactcataggtgggaattgaacaatgagaacacatggacacaggaaggggaacatcacacactggggactgttgtggggtgggggaggggggagggatagcattgggagatatacctaatgctagatgacgagttagtgggtgcagcgcaccagcatggcacatgtatacatacgtaactaacctgcacattgtgcacatgtaccctaaaacttaaagtatgataataataaaaaaaagaaatgctttaaattttaaaaaaaaattcacatttctccaactgtctttttctcttatttaaaaaattattttaaaacatttgcagtgggatacaaataagctccataattgtggtgagttaatatgtctagtaattcttttttgatctacaggtctgctcttcccacctttttctcctgtaattgttgttgaagaaactgagtcatgtgtcctacagtttcccacagtctgggttttgctgattgcaccccacagtgtcaattaatatgtccctgtatttactataaactggtagttgaatctagtcttgatagaaatttgatttgcagtgctgggagacaagactgcttttccgcaactgagcacttataggccatagtttgagaaatgtgctaaggaacagctcacaactttagttacaaacaatattgagttctaatttttcaagtgacctataaagggactgaggtaatcattaaaaaaaaacaagtcacttattctggagtctatatgggaatttttcaagcttatagtaattcaagctgatagtcctttgaaggacaacagctatgctttgtaataaggtgtgcattttgactctaaaattgacaagagcagtgttttcggaagtttcactttggagacatttgttttgttgtattcttacatggaagttgaaacagcatgatagtagaaactcttgaaacaggaggcactgatggagacagatatttctaccagtaaatctgcggttagcccaaagtatactgagaatttattgctaaaatatggtaaacaaatgatttgacaaaagccccaaaatggctatcatcctttgagtatgtacgacttagtagaaattttctttctgaaattttctactcctgaaactatggcactatattatttttaaatgagtcatctaatatcacatgaaactaatacattgtcatagtgaaaaaattagctgtcaaatatcaaatgcaagcacaattgttaacaatttccaggatcaaatctacgttgtacattttaacttgaataaatatggcttttacagggaagctattctttgtctcatgtttatacaccaaatgatgtccgtatggtgattgaatatgccagattacgaggaattcgagtcctgccagaatttgatacccctgggcatacactatcttggggaaaaggtaaggagttgtattttatttcattttatcttattttttattttttgagatggagtcttgttctgtcacccaggctggagtgcagtagtacaatctcggctcactgcaacctccacctcccaggatcaagcgattctcctgcctcagcttcctgagtagctgagactacaggcatgcgccaccatgcccagctaatttttgtttttgttttgttttgttttttgagacggagtctcactccgttgcccaggctggagtgcagtggcatgattttggctcactacaacctctgcctcccaggttcaagcgattctcctgcctcagcctactgagtagctgggactacaggcgcccgccaccacgctaattttttgtatttttagtagagacggggtttcaccgtgttacccaggatggtcttgatctcccctcctcatgatcggcccgcctcggcctcccaaagtgttgggattataggcgtgagccactgcgcctggccaggagttgtattttataagttgcaaaagtgaatatttgaggtattgcatttcttattttatgacctagtgtttgctcattttgttcttaattgtgattggcctatcagtaatactattgacagatacaattcaatagctactctgtgtctattgtgagcaagtcattgtgattaggtactgcctaaagtataaaaaagggaatgaaagaaaacaaaaagtgattacaaaaagtagaacatgataagtgaattcaagaaatggtttcatagatgaggtaacacttaaaatgcttttgagtgatcacagaatatattcatgtttctggtagaggaaatggcataaggaaatgtgtgcaaaaagtgtaagatatgcttgacaagtatgtagctggagtagagtgtagcagagtaggaggcattatagggtggtgattaagaactttggctttggagccagacagcttgggtttgaatcttgcttctgccattataaactaggtgaccttgggcaagttacaatatctcatcttcagtttctccatctctaaaatgagaattagtagtagctatcatgtaatttttttgagaattaaataatgtaaagcacatagcacagtaccaagcatttataattgctcaatattattagagtagacatggggaatagtgagaggtaaatctggaaaagcacattagcgggcctttggtgaggaatgtgaacttcatcaggacacactggaaaccagtgaaaatttctgagcagaggagtaacatgatgggaaccacactttgggaaaacctttgggaaagtgacagattggagttctggaccaggagggtgatagtgggaatgtaaaataatggacagaactgagagacattctggaaatatccatagaatttggcaactgatggactccaggagagaggaggtatatactctaggatgacgatggtacccttattagaatacgaaaatcaggagaagctagagaagggagcttaaggactgcagatgttgttttttgttagcttgtatttgaagtacagctaggatattcagttgtatccagcagggaatttgaaatatgaattgaagctcaagaaaaagcgttgaggcaaactgaagatttgggagttactaacatttgacatagataaaatctcagatataatgggaaacaaagaggcaaagagacaggattcaggaaacccttcttatctggaagaaattactagctcttagtaaacatgttcatcttttgtgtataaaatcttgtagcttcaataaaatgacgtagtaaaatcatgtggaaaaccagatctttataatgagtacacttcttttaaaaagaatcttaatattttcttctaggtcagaaagacctcctgactccatgttacagtagacaaaacaagttggactcttttggacctataaaccctactctgaatacaacatacagcttccttactacatttttcaaagaaattagtgaggtgtttccagatcaattcattcatttgggaggagatgaagtggaatttaaatgttggtaagatgattccttaaaacccctttaaaaaaaaaaaaaagagaggctgggtgcggtggctcacgcctataatcccagcactttgggaggcagaggcaggcagatcacctgaggtcaggagttcaagaccagcctggccaacatggtgaaaccccatctctactaaaaatacaaaaattagctgggcgtggtggtgggtacctgtaatcccagctccttgggaggctgaggcaggagaatctcttgaacctgggaggaagagattgcagtgagctgagatcatgccactgtactccagactgagtgacagagtgagactccatctcaaaaaaaaaaaaaaaaaaaaaaaaatggaataaaaaacctgttgcattgaagtagctgtagagggctccacaccataaggaagacttaagagtaacatgcctgcttgtaagggtttaaactgggcaacatgactcctgagatggtagatttgtggagaatgtacattttggtatggcaaagtaaagcttgaggaaaaacaagatgcagaagaaaatggagattcaaaaaaagactactgtgaaatgagaacacctttagtgaaagagggcaatcaatgattaaataggaaagatttttcaaataaaaattctctctgcaaatagctttagatggaggagaaaggtggtaaggtaaagaaagccatttttaaaggaaatcagcttcttgaaaaaattgtttgcaatggataattaagataacttgtaattaagtttttaggcttctttttactacctacaaactttaatagttttaagtctgcacaactgatgttaggcatgtatactgctctaaataataaactgagcatatcaaacttctaatgaaattttaatcactttttgcttcagggaatcaaatccaaaaattcaagatttcatgaggcaaaaaggctttggcacagattttaagaaactagaatctttctacattcaaaagtaagttgtttgaaagcctatttctgtattaatgctttttgtaaaagtttatttagtaatgtgctttattttttacattttctctacatcctttgcctaagtgtagatgtgaaaaatcactaaaggaggcaatacccactgcttgctttaaatcagtaacatggtgactccaagtattttccaatagctgttgaaatataggaaggcagtcatctgttctaaaaactcagattgggctgggcatggtggctcacacctgtaatcccggcactttgggaggccgaggcaggtggatcaccggaggccaggagttcgagaccagcctggccaacatggtgaaatcccatctctactaaaaatgaaaaaattagccaggcatggtggcaggtgcctgtagtcccagctactcgggcggctgagggagaatctcctgggagatggaggttacagtgagctaagatcgcaccactgcactccagcctgggcaacagagtgagactgtctcaatcaatcaatcaatcaatccatcaataaatataaaactcagcttgaagccctggctaccctgtgaagtcttcactaccatccagcccctggaattcattccattttgtcaattccaggaacatatattttactatatacctgtgctacccaatacagtagccatagccacaggtgtctgtccatatgtaaattaattaaaattaatgaaagttaaaaattcagctactcagttgcattagccacatgtcaagtgttcagtagccagctgaggctagtgactgccatactgaaaaatgcatatatatatatatatatacacatttccatcccaggaagttctactagaccgtgctgctctagagggattggcaaactttttctgtaaagggtcagagagtaaagattttaggcttcatgggccacatacaattgcccatggaccacatacaatttttttttaacttaaaaaaaacctcaaattttaaaacttaaaaaaaaatgctttacaaatataaaaaccattcttagcccatgagacatacaaaaacagcctgcaagctgtagttgccaacccttatgctgtaccatttatttggcaagcccagattccagcctttgcctgttcagctttttgtgtgatgcatttaagtgttatttatctgcagagcacctggcattatgtaaatatctgtaaatatttgtggattgtcagtaactgttacatgtaatttatgtgatatgacaggctagatcgtggtccctaccattttaagacagccataaaattgtaagagattgctgtttgtacaatttcctgagttgcctaccaactcaatttgaggccacttcttcctatcttaggggcatgtttaactcattcattcagcaaatgattattaaacccccatactatgttaggttctgtatcaagtgctaaaaaggaggaactacttgtgacacttcccaacttgagctgcttctgctataaagctgaactatactaaaaggcacctctcaaaatgcaagaaatccttggtagaaaatgtacatgttttaaatatattgttaagcttatgatctaaaataactataatttttttgtaatactagggttttggatattattgcaaccataaacaagggatccattgtctggcaggaggtttttgatgataaagcaaaggtgagcattgtgaagactgcatctgatcaatataagagacttaattatttttcttggggcaactgggaatttgcaagtctaactactagtattacctttctagtgtagttagtgaccactttggacctcatagttccaagctaggtttggtagaaataagactaaaatgcaagtctcagctttagttaactgaacctatgtggtatccatatataagcaaaagttaaatattcaaacctaaggttgatgaaacttttaagtccctaaaatgagtatcacatggcactaactctgaagaaaagaggaaaaagaaaatgcagattttttttaaggatcttagaaaattatgttcctagtaataatgccttaaactttcaatttcatctactgttctaggcctaataatatgtattgcaatttgtaacgttaatagcttgcgccgggcacaatagttgaagtatggaaagacagcgcatatcctgaggaactcagtagagtcacagcatctggcttccctgtaatcctttctgctccttggtacttagatttgattagctatggacaagattggaggaaatactataaagtggaacctcttgattttggcggtaagtgaagcagttggtccaagtgttgtgggttactgtgaagctgatggtaagtgaagcaaccattgttacctttgttttatgagttttcttccctaacctcccaccccagaagtctttacctagatattacctaccaactatcttttatgtttgatccttgattttatgtgtttttttaagttcagtatcattttaaactctcaagaaaccatacagttgcctaaattcaagaacttcaaaagtattatagatccccttagattttatctccattttcagtgatggctcctcactctctacattctaaaggtatttgattgcattaaccttacatgccctcttctgaactgcttctccaatgtaagacacctaagcaaagctatagttttagttcagtggatttcaggctgtgttgtcttaggattctgaggagtagaatccttggtggatgggacaggagggaacatctgaagggtggagcttcaggctctcagatccccttcataaaaaacattctagtttgtccaattttgtacattagcctttagtgaaaaatcactgaaaaaggattttgctgtttaaaaaagtttcaaaaccataggtctattaagaattgataattttatatacaatgcattttatgaggaccaaaaagcgataattactgatttttaaaaagcattaagtggctgggcacggtggctgacgcctgtaatcccagcactttgggaggccgaggcaggtggatcatgaggtcaggagttcaagaccagcctgcctaagatggtgaaattctgtctctactaaaaatacaaaaattagccggacgtggtgatgggtacctgtaatcccagctattcgggaggctgaggcagagaattgcttgaacccaggaggtggaggttgcagtgagccaagatcgcgccactgcactccagcctgggtgaccaagcaagactccatctcaaaaaaaaaaaaaaacacacacattaagtattcaatttctgttttaaatgccaagaggtagaaattaaaggtaggcatggtggtcacagtccactaaaaaactagtattccaacttctattccctggcacactactaaataggcaaccagggatttaaaaaatggtttctggtgtccaggtaagtttgcataaaaccaaaataaaactgtttaatactggcccactacattaatctatggtgctaacacgtgctgtgaaccgtgggtcagggctggggataaagtttgcaaccatttttttggggggtgggggaagaggaggggccatcttttttgtgccacaaccattagcatctcccaaggtcctgctaaccacgggcaagaaatgttgccctaggataaagatggaggaaacaaatcttgatgaaatattgcctctgtgtataagctttgaacttctgaacttaattcaatgattttaatttaggtactcagaaacagaaacaacttttcattggtggagaagcttgtctatggggagaatatgtggatgcaactaacctcactccaagattatggtatgggatttacctgataacatttaagaattaaggtgccttagctttccttctctgtctaaacacaaaagtgctaaacataaatttaaactgcttgcggggggatgtgtgatttaaattttaggcctcgggcaagtgctgttggtgagagactctggagttccaaagatgtcagagatatggatgacgcctatgacagactgacaaggcaccgctgcaggatggtcgagtaagaaatctattaagtccagtgtgatttttaaccttcttattcagtgttagtttcttttgctataaatagaaatgtatgttacctaacaaatagtaattagaagaaaccaggaattatttttttgtaagtaataatacctgtaaagatatattcagacttgtgactgttttatagatacaaaaaatgttggtgtaacttagaactccatcttgagttgctttaattttcttcccttattttcagtaatgctgtgatttagtgattctaatttaagtttctaagatgacatgaatatcaatctaaaatatctttatgaatgatatcaatctaaatcaatctaaaatatctttattcatgttatctacagacgtggaatagctgcacaacctctttatgctggatattgtaaccatgagaacatgtaaaaaatggaggggaaaaaggccacagcaatctgtactacaatcaactttattttgaaatcatgtaaaataagatattagactgttttttgaataaaatatttttattgattgaa

SEQ ID NO: 36026 - DNA, 16106 bp, Homo sapiens
ctggtcccgagcacgagctgtgaggggattcacttgtgtgcggaactcctcggaaccatggtgagcctgactcccctgcctcttgccctacccctgctccgccgtgctcttgccaccccactgcttcctctgtcctgctagggtcgtaggctccgtttctgtctccccggccctccgcacatggtgcgagccatgcgcggggcgtgcggcctgcgccaggccagccggtggagctcaccacgagggggaggggtggaccgcaaagccagcgtctccttgtgcctaggtctttgcatagtcccggcagcccaggtccgcgcctcacccggagcgaagaaatttctagtgtgggacccgctccgccctccttctaggggcggagcctggagcgacggggtctgagccatcagagggtggaggggccgcagccttccgagggtggaagatggaggccgcgttccctcgcccgcccggcaggcgtcaccttgatggcctgcaacccctccctgcctcattcttagttcaagatcgtctttagtctcgctgtacgtaactgtcaatctcgctggtgtataatttatactcccgggggccttgtaaatccgaaaagccatgtcgctctcctacaagtccctctctcccacttaaatgctttctccgatgatggaagcttcatttgattgaaaacattgttgtaaatgagttttctcttagatgtccacttgtaagactagtggaaggcacctcagtgtatgtgttagagtattggtacttaaacggaatgcctcttggttttccttttcaggcgtccctttcccttgcacctgttaacatctttaaggcaggagctgatgaagagagagcagagacagctcgtctggtaagccttgttctaagcattgttttaaagataaaactggaggccaggcgcggtggcttactcctgtaatcccagtactttgggaggccgaggtaggcggatgaactgaggtcaggagttcgagaccagcctggccaacatggtaaaaccccgtttctactagaaatacaaaaattagccgggcgtggtgatgggcacctgtaatcccagctactcgggaggctgaggcaggaggatcgcttgaacccaggaggcggaggttgcagtgagctgagatcgcgccattgcactccagcctgggcgacagagcgacactctgcctcaaaaaaaaaaaaaagtaaataaagataaaactgtacttgaagactgtaaagttgattctgataatctccttggtttttactccagacttcttttattggtgccatcgccattggagacttggtaaagagcaccttgggacccaaaggcatggtaagaaaaatagaaaagttttatattttaatattgttttagagcgcttggtggaaatataataacaagcgtattaaaatgctttttaatctttaaaacgtttaattataaaagacaagtatgttctccttagtaaaaatcagagtccccagaatcaccatccccaatcccatgcccctccccaatgacaagtactgttatcatttgcacgtacatcttctaatattctgtttatgtagaagtatgtgtacttcattatgtattttatactcatgtaacatactgttttataaaacagatactatttatcaatacttttttgtagcttgctcttttaaattcctttcagtgtaagtagataacactgcccctttaactgtcaaatattatcctgtaccttaattattttataatttaattatggctgtattgatagtttctttccattgtttttgcagttacggtgttgaaacaaaaactagtgtctacctgtgcttctagtgtttctaggggtagatacatggtttggttacgtggtgtatgtattgaaaacatttgatgaatggataccacaaaatagctatccagagtgtttatacactagcactgtgtgagaatactgattgatccatgcattcttcaagatgtgcttatgtcttaacttgaaccaattatgttccctttaggacaaaattcttctaagcagtggacgagatgcctctcttatggtaaccaatgatggtgccactattctaaaaaacattggtgttgacaatccagcagctaaagttttagttggtaagtctgaatatactttttcaccaacctaataatactgtttgttaacatttttgaaataactttataaataggctgtgttgaccaatcgtactgtcaattgatgtccactagttgttaattatcgttgttaaaatacaagcttcaggagtgcccgtatgttggtggtaaaactgttgcatttcagacctcagagttccaaataatttgttgaatgaggaaccctggtaagtttagattggtagtgaatatttttggagaatttagtaagcaaagaagcaattttgagttaataactaatttctttttctagatatgtcaagggttcaagatgatgaagttggtgatggcactacctctgttaccgttttagcagcagaattattaagggtaagagcaactaagcaactcttttttcctactgtgtttttgagtatcagaggtaatctagtccttacttcctctgtctttactattgaggagtgcttaataattttctatttataacttttgttttataactttattaataggaagcagaatctttaattgcaaaaaagattcatccacagaccatcatagcgggttggagagaagccacgaaggctgcaagagaggcgctgttgagttctgcagttgatcatgggtttgtatagcaaagtactactgttctaaacatttagtgttctttcataacatgcttaatgcaagaaatctataggacactgaaaagcatacacaaagatcatcttgctgcctcaccccactccaacagtcaaacctacatcagcctccagagatagccactaaagttaagtttgggtttttagtctttttgtatatatcatcaaaatatacaaataaagcaaatagtataatactgtatagagaatttgttagcctctttttaacctagttaaatattaagcacatttttggatgtcaattttctgtgcagtattttaatagagttacacatttgaatatttggctagaatgactgtattaacctatctgtagggggagatttgtgtatttgatgatttttagcattataaaataactttgtgacgttgcgacatagcccaaaggtttctagaagtgtaattgttgggtccaaaggtaagtgtgtgtgttttaaggcacccccaaacctgggctgcacagcaggtgagcagcaggtggaaaaattgtcttcccatgaaaccagtccctggtgccaaaaaggtccgggaccactgttttaaggcacttctatttatttgcccattcacaactgtataataatacttgtttttcacgtccttttatttatttatttattttgagacggagtctcgctcttagagttgcccagaatggagtgcagtggcacgacttcggctgactgcaacctctgcctcccgggttcaagcgattctcttgcctcagcctcccaagtagcagggactacaggcatgtgccatcatagccagctaattttgtatttttagtgtagatggggtttcaccatgttgctcaggctggtcttgaactgacctcaagtgatccatcctcctcagtctcccaaagtgctaggattacaggcgtgagccactgtgcccggccatttctcacattcttgccaacattagacttttgcatgcttgtgtggcccccacccctcttttttttttggcattttgccagtttggtggggaaaataacatctttaatttgtgtttcttgattactgctgaggtttaattcttttcatatagcttacagacttgatcagttagggtaaaattatctattgacatgaatatctagataaattttgaaaagtaaagtagggttaatatgtatatttggttggttttatttagttccgatgaagttaaattccgtcaagatttaatgaatattgcgggcacaacattatcctcaaaacttcttactcatcacaaagaccactttacaaagttagctgtagaagcagttctcagactgaaaggctctggcaacctggaggcaattcatattatcaagaagctaggaggaagtttggcagattcctatttagatgaaggtatgtatgaatgtcagatacaagaagctttgattagatgctgagggctgaatactgagtgaattctgttttgagaccagtgaccctttacaaagccagtgaacttgaatttaaggacatatcatatgtgcaaccatttttgtcattttattgacagtgtactcctcttcccgcgctattccagcattgttgatgatctctagagtttacttaactaccatgaagttatttgcagtctctgataaagaggaaatgttttcttttactagaaatcatctattctcaaatggtacttttaccaggattatatgtattctccaggaagggtctgggtcagtcaaatcattgtgttagctggttgttgaggatgtacagttgaccattgaacaacatgggtttgaattatgtaggttcacaatgcaggttttttcaataaatatagtcagccctttgtgtccgtggtttgcacatgtgcaaccgaacgtggatggaaaatgcagtatttgcaggatttgaaacccatgtatatagtgggccagcttttcaaatctgctggttccagtcagcctggaacttaagtatgtggggattttggtgtatgtgggcgtcttggaaccagtccccttcgtatactgggggatgactagttttttttagaaaagaattaaaaaaaatttctttaacaaataattatgtatgtttatagggcaagaggatctagttcttaaagagtgataaatgagacataataagtactgctttcttagtagtacatttttgtttagagtgaagttttccagatcatcttcacattatatttacttcacaaaatggcctgtcaaaaagtataggcattcttatatagagaaggaaaaaaaaagaattagatggtgctttacaacttctgtttttaccagtggtttggagtcctggttttgttctgtgtcataggtcttgatttattttaagagagagtcataattctgaaaatactcttgattaagtttatatacaagagctgtgtagcatttctttttttttttttttgagacggagtctggctgtgtcacccaggctggagtgcagcagtatgatctcgcctcactgcaaccactgcctcctgagttaaggcgattctcctgcctcagcctcctgagtaggtgggattacaggcgtgtgccaccatgcctggctaacttttttgtatttttagtagagacggggtatcgccatgttgaccaggctggtctcgaactcctgacctaaggggatccacctgcctcagcctcccaaagtactgggattacaggcgtgagccaccatgcctggccgctgcgtagcatttctgataggggctggtggtagggaaggagcattaaaacaagaatattagtagcacaagcagcaccattcttgaatgtctgctctgtactaggaattgtaataggaactttagtcatttagtcatcatgacctggtgagtgaggattaggttcacttgaatagagtagaaaacccaagataatggtggcttcataatggaaaagtttctaatgtaaccaaaaaaaggcctagaaaggtaggtggtactgggtttgtatgatggttccaaagcagcaggactaggctggtaactagcacctctgctactggttacattcctgttttacaaattagcatttctggttggataatttgtcgaaggttatatagccagcagcaggggcatgatcagggtcagatttatctgactccacggtgtccatggtttttccatttttaccaccagcctcaatacctgaatcttcaatttttctcttgtggtggtgattttaagctaataaaaatataggacttaacctattgtctttatattgcaacccatacagatgtgggtgtagcgtatatctgaaacaaaagtttcaaaatactgtttaattttattgtctgtactgtgctcttatattttctgtttcatattttttaagtaacccattaaattgattttgtaataactcttctagtgggatgctttataccagaagtgtccaaggaagagaatacagtcatgggttcctagtttctgtttctggttgggtcggtaaagccccttcctcctccctcttttctgcttatcactagagacagaaactaaaatccatggctttcaggcgctaaaagcctaaaagcaaaacaacaacagaataaggcaggttggacaagcttgcttttatgccttctaagagcttggtaaattggacttaaatagcttctttgaaacagtgatatgataaagcagacagctttttataagatttactaaggctgctttgaagtattaaatatgatactgttcttatatttattgtaggcttcctgttggataaaaaaattggagtaaatcaaccaaaacgaattgaaaatgctaaaattcttattgcaaatactggtatggatacagacaaaataaaggtatgtaactctactttttaaaaattaaaattactgcccaggcagagtggctcatgcctgtaatcctagcaatttgggaggccaaggtggtggatcatctgagatcagaagtttgagaccagcctgaccaacatggagaaaccctgtctctactaaaaaaaaaaaaatacaaaattagctgggcatggtggcgcatgcctgtaatcccagctattcgggaggctgaggcaggagaatcacttgaacccaggaggcggaggttgcactgagccgagattgtgctactgcactcgagcctgggcaacaagagtgaaactccgtctcaaaagtctcaaaaaaaaaaaaattgctggattctataaactcaggaatcaattgcactaaaaagcttggaataggtatgaatctattgtgtatatacacatatatatacgttggtaaaaatgttgaaatatgctatgggactctttaaaaagagtaatgaggcctggcgtggtggttcacgcctgtaatcccagtactttgggaggccaggcgggcggatcacaaggtcaggagttcaaggccagactgaccaatgtgagatggtgaaaccctgtctttactaaaaatacaaaaattagctgggtgtggtggcgcacacctgtaatcccagctgcttggaaggctgaggcaggagaatcacttgaacccagcgggtggaggttgcagtgagccgagattgccccactgcactccagcctgggcaacagagcgagactcaatctcaaaaaaaataatgaaactgatgctctctttatgcttcgtttgtcttagatatttggttcccgggtaagagttgactctacagcaaaggttgcagaaatagaacatgcggaaaaggaaaaaatgaaggagaaagttgaacgtattcttaagcatggaataaattgctttattaacaggtctgtgtttgcttttaagaaaggatttttttccatgaaagtttatggaatacttcatatttacttatattgaattagattttttacctaggaactgtcttagataacttcacttaaattatggatttttgtaatcagtaaattgtgatttatgcacacttacagtgaccagaattacgggattgatttatacagttactataataaagaacacttcttttcaatactagtaatggatgcattagtactatagttgataaactctaattatataggtaagaaatgcaatcttgttctaatttgcatttcttttacttgtggtaaaaatgtttacatgttttttagtctaatgtagtttatcttgtaacagttgtgagcataatgttttcatgtattttatttacaggcaattaatttataattatcctgaacagctctttggtgctgctggtgtcatggctattgagcatgcagattttgcaggtgtggaacgcctagctcttgtcacaggtatggaaaaaaggtattgttttctaacaaacacaatagtcactcttgaatttgttatttgttactatatgcaactacctttaaggagtttagaatttcagcagttattctgaaatctattctcttggatacctttaatttagatacatagatacattacatttacgataccaagttatataccacatttgccgtaggtatagatttctttcattgtgtcactgttttaaaggtagatttttggccaggtgcagtggcttgtgcctgtaatcccagcactttgggaggccgaggcagccagatcgcttgagctcaggagtttcagaccaactttggcaacattgcgaacccacatccctacaaaaaaaaaaaattggccaggtgtggtggcaagcgcctgtgatcctagccacttggggggaggctgagggaagagaatcgcttgagcctgggaggcagaggttgcagtcagcggagatcgtgccactgcgctccagccttggcgacacagtgagaccctgtctcaaaaaaaaaaaaagatatgtatatttttttctcacaaacctgtaagaccgttgttaaaatctgaacaaactagagctttaaaaagtcttaagtctacttacatttatctagttcgtacatttgtttttattgcttagtaagtagttgaatgctttgtgtcctttgtagtagtacagttacaatagtaacctttattgaacatttactgtgtgctggagagtgggtcaagtactgaaacattgcttttgttaattttaaaaaatttctgaaagtaataaacgttagcatacgtgaaacaatcaacattgtataatgaaaattagtatacctcaataccctttaatagaagtatgagtgatataattccagttgtgtcaaatagaaattgtgtttataaatcagacatgtctgtctacatcacaatgacatgagttcaggctggttgcggtggctcatgcttgtaatcccagtgctttgagaggccaaggcaggaagattgcttgaagccaggagttcaagaccagcctgggcaatatagtaagactgtctctacaaaaaattagctgggcgtggtggcacatgcctgtagtcctagctacttgggaggttgaggcaggagatctcttcagcccaggagtccaaggctacagtgagctgtgatcacgtcactgcagtccatcctaagtgacagagcaagaccctgtctttaaaaaaaaaaaaaaaaatgcagcttgtttgctttttattgtggtaatggtttaaaaattattgtttattaaatttttacagatttagggatataagtatagttttgttaatggttttcatagtacactctaagccctggaaaataagtttaacacttttctagattttaggtccttgaaaatgaatgaataggttggaaagttggtttgggaatgagaattaaggagacctgggttatgagttgtgaagtcagtagggctgtcacactgtttggaactgccatgaatattagaagaaattatagtgtactaacctttggagagtggacttggtctcatcccagaatgatctcttaagacgttttttttaatcatttgagaagcatagtcgtcttctaaccaagagacattttcctttaattacttgaagtgggtttacttgctttaaagttacttaggagccattgcgtacttgatgctttaaggtgacaaataaacacaatttaagatgctcatgtttatgtaattcattctttagttccacaaaataaagatgtaagaggccgggtgtggtggctcacgcctttaatcccagcactttaggaaggcctaagtgggcagatcacaaggtctggagtttgagaccagcctggtcaatatggtgaaaccctgtctctactaaaaataaaaaaattagccaggcgtggtggtgggtgcctgtagtcgcagctactcgggaggctgaggcaggagaatcacttgaacccgggaggtggaggttgcagtgagctgagattggcgccactgcactccagcctgggtgacagagcgagactccgtctcaaaaaaaaaaaaaaaaaaagatgtaagaagtaaatggtaataatatattgatgggataaacatatcgtaaggtcttgacatgaaattgctctatacccagaagaatgtttattaagtacaccaactgtatgtctatgaaggtgaccacatggtggctcccatccttaaaagctcagtggttgtcaaaggtgtatgatgacattggttcttgcaagtgtcattaaataaatgtcttgcactgggcatggtggcatgtgccagcagtttgatctattcaagaggctgaggcagaaagattgcttgtgcccaggaggttgtgctatgatggtgcctggtgaatagtcattgcgctccagtctaggcaaggtagcaagacactctctctttaaaaagaaagaaaagtctcatgtagaaggatgaagtgaaaagtttcataagccaagttagtcttatttttggatatgacgtcccaaatatctgttgtgtctcacatctagaacacaaagcagtctcagaattttgccagccaaaagtaaaaagaactttatacaaattatgagtataaattagtagtttcaaagaccagagtctttatgaatttattataaaataaataatagagcattgacagatttatcagtaaggcataggaaaagaagggttgattgataatatatgcaattcacattatgaaaggagtagtcagctagagaaaaggattttgaaatggaaacctgacttttgcttagttaggaaatagggaacgaagtggctgacctgttcagtttacagcatggaagatggagggaaaataggaatagaaatgagacataaggactaaattaatttgttcttattaaatttggtctgggaaattcttagtatgcatttcttgtttttttaggccttaggacatttcatttgtgataattagagatatcaggtgcttattaagcagttcatgaagtgtatagtggttgacttataggacaaatattttcatgtcttgtgctgggaattgtatcatgaggtcttagtcttataggttggattcagaagagaatctgaatttaaactcaaaagtaactgctttaagactcagtttaaccttgggaaggtagtattgtatagtgtgtgcttataggtctgaagccagactgcttgagtttgaaccccagctttttatattcatcctagttaggtctttggataggaaggtaaacctcttggcctcatttttatcatgtgtaaaatgggataataatggagcctatccaagaggattattttaaagattaaataattagtcgatatgaagtatttaaaaagagtgccaggaatataatcagcaatcaatttttaaaatgtgaaacacattacctatcattatctatccattactgcttattagaaaacaggaattttaagcctgctgtgcatttaactaatacatgtttatgtttataggtggtgaaattgcctctacctttgatcacccagaactggtgaagcttggaagttgcaaacttatcgaggaagtcatgattggagaagacaaactcattcacttttctggggttgcccttggtgagtgattatgtagatcctggttagggtgtctaaattcttgctaggctctgttgaagtaaaggttattgtagttactagaatagcatatcttacaagtcttaactcttcagaagcatgatacatactttgtttcagtctcttgagtcaacctcatatttaccgtgtctttgtgaacagtgcatgttcaacagttttttttccttgataacttagaaccattatgagccttgattgttggagaatgtataatacaggaagacaggtcagctttcagaacccagtaatataaccaacaccggcataaataatagaaggcaaactttttatccctaagtggtcactgtgtcttttaattttaggtgaggcttgtaccattgttttgcgtggtgccactcaacaaattttagatgaagcagaaagatcattgcatgatgctctttgtgttcttgcgcaaactgtaaaggactctagaacagtttatggaggaggtaagcatttagaaaatgttgaatatatttttaatttcttaaagtacaatataagtcataagtggttttaatggttcttacagaaatcttatattgcttttgcactaaattttaaaatgcttggcatatcttaaagtcagtaattcagtatcttggagacaactaagcattgcaatattttattggaattttaatctttaggctgttctgagatgttgatggctcatgctgtgacacagcttgccaatagaacaccaggcaaagaagctgttgcaatggagtcttatgctaaagcactgagaatggtaagttaatcaaaatgagagatccgaacttaagttttgtggttattgatagttttaaaatgagtagaaaatgaactggttaatactgcttttaaatttgattctggagtttctcctcttcgtgagcagtaactgaagcagattttacattgttcctaaatgtataattttaaaaagctatcctagttaggagtaaatcagtggttcttacagtagagtgagtagttacttgttttcttcattttcatagttgccaaccatcatagctgacaatgcaggctatgacagtgcagacctggtggcacagctcagggctgctcacagtgaaggcaataccactgctggattgggtaagcaatcaaggggaactttgtggccgttgttaaaagtaactcttttcactaagctttttttttcttttggaacataaagagttacaataaccgtataaaagactcttttggactttgtcctcataatcattacatgtgctgggaaaatgtgtgtgactttatatgctcagcatttcccaaactttgttattccataagacatgtaaaactggttagaagatttgtaactatttggtatataacgactataggatttaaatataaacaatacttacattctgaaaaataacataaactattatgttgtttatacaatcagtattaacttctaatttcatagtaaacttactgcaagataatcttgagtacagatcacagatctctagtccatagataaaagtggccaatgaggcagatttaattcatattgaaaaactttctgacaagctgtgctggacattatagagtagtcttaagaaggtagataatcctgtcattgaacaagagggagcaccagttaatctgtgagaaaatgaagcaggattctcacaagaagagaagttgggtaggtaacttatgaattttcttccatttgttttttattatttgatatgttgtcttctattaatatgggtgatcagtagttgacattattgttgttattactattattataactgacacaatggtcttgctctgttccccaggctggagtgcagtggcaccatgataattcactgcagccttgaacccctggctcaagcagttctccttcctcagccttccaagtagttagggctaaaggcatgtgccacaatgcctgactaaattatttttattttcttagagatgggggggcagtctcactatgttgttcaggctggcctcaagcaatcctcctgcctcagcctcccaaagtgctaggattataggtgtgagccactgatcctggccccttttattttatttatttattttttgagatagagtttcactgttgttactcaggctggagtgcagaggcatgatctcagctcactgccacctctgcctcctgggttcaagtgattatcctgcctcagcctcctgagtagctgggattacaggtgcccaccaccatgcccggctaattttttatatttttagtagacggggtttcaccatgtttgccaggctggtctccaactcctgaccttaggtgatctacctgcctcagcctcccaaagtgctgggagtacagatgtgagccgctgcacccggccccttttaatttttttaaaggctttctttgagctcatttgtaggcttatctacctactgagtaaagtagttgggtgtcctaattttattaataggattaatttttattataaatcattagagatgttttgatactttagttaaaactgctttttagtaaatttgtttttctttgcagatatgagggaaggcaccattggagatatggctatcctgggtataacagaaagttttcaagtgaagcgacaggttcttctgagtgcagctgaagcagcagaggtgattctgcgtgtggacaacatcatcaaagcggcacccaggtaccctaacacttttctcagaaaaaattactaacagcaaaacaaaatagggagctgtatttattttataattagagttaatgaaaagcagagacagttttgcctggataaaagtatgtaagttatttaaaatatcacaactcttaacacttaagccagaaaaacttaaggggaaagagggatgggcagctgaggtagctcttaggattgaaaaggcacagaaagagccatgcttggaaaggtcaagtactgaggacagtagatgctgtgatgctttctattgtctttaaacagaatgatagcaaaaggaaactgagttctgtaactaaagtgttctagggcaaggtcatatagccacacctactcccagaaatcttcacaagaagtcagtgccctcacccacagttgaaataacgcttaaaaaatgtataataccttgtttggtctgatactgttttagagatcaggtatcttttattagcaaattctgagtaatttgcaataaagaaactgaattttaactcagccttccagacctaccagaccatgggcttctttttcatattccttattaatctccagaagactttttttttcagatcagtgccctgtgacagctgcttcataactcttgacaatggttagcatcctagtccccccataagctaccaagggtgaaaagtttatctctctatatgatccctgtataatgctgtactctttgatctgttcttaagcttcttcagcttctcgtaactgttgtgtttgcctctaaaagcagtgtttctcaagctttagatccttgaacaagcattaagtacaaatttactagtacccttatcccatctttccaaaagattgttctatgcccccttattgtatggtcatcaaagaataaaagatgagaatagaaggtgcttcttgttggtgggggtgtctgcagagtcccaaggcagaacagtcctgatgtggtgcagggcatcacacagaggagggggctgagtggctagctcaggtctgtcttcctcctcacctaaagccagcagtcccatcctatataacccattagtccatgacataacttggtcacctcttaaaagcccaacttccaatactgccacattggggattcagtttcaatgtgagtgttataggggacacacatgcaaaccattgcagagttataacagttttaatacaggattctagttgtgtttgtatttagtataatactttggataaaatcatgctcttcatttttcactattgacttttttcttactctcataggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaatta

SEQ ID NO: 36027 - DNA, 16106 bp, Homo sapiens; identical to SEQ ID NO: 36026

SEQ ID NO: 36028 - DNA, 3687 bp, Homo sapiens
gtctgcgtctcgaggcgagttggcggagctgtgcgcgcggcggggcgatggggggctcgggcagtcgcctgtccaaggagctgctggccgagtaccaggtgcgcgggacgcctggccctggggagctcgcgtgcgggcctcttctcgggagcagggtccgggagctggctgcggggcggccgcggcctcccagcggtccgctaatccccgctctggctttgccttccaggacttgacgttcctgacgaagcaggagatcctcctgtaagtgctgccttgaaccctgcctccgaccccgggatcctctagagacagcttcgggggcgctgtcccgagggaggggcgggggctggcctgaggtctgcagaggagcgggagctggaggccgggagacctagcccgggctgcgccctcctcccggcacgccctccccgccctcgcctgaggccccagcgtggcaccgcggagccaccttacagcctccaggaaaagttaggcgctctttgaccctgggctccactagcttcagcactgccgaacttcctgccccagtccggcaggggccgaccttgcccagtggctaaaccacagaagccttggggagcccggctccttctcccaactttacctgaataatacagtaaccgttatcgctttctgagcactcaccatgtgccagggactgtgctaaatggttgcctgcgttacctaatttaatctttaggagagaggtactggacaatgaaacaggttcagaaaggtttggtaactgcttaagacaacactctgagtaagtagatttgaacttgggctggaagcccttttgccggatttatgcaggccaggttcctgtggcaaagataagctcatgggaaggaggtggaggccgaggaggacagttcagtgtggttgctaaaaaggaggctttgagggtaagagatccctggagtgaaggtgagaatgagatttttggttttgctcttttctccgtttttttttttttgagacagcgtctcgctctgtcgcccaggctggagtgctggggcacgatcttggctcactgcaggctctgcctccgggttcaagtgattctcctgcctccgggttcaagtgattctcctgcctcagcctcctgagtagctgggattataggcacccgccaccatgcccggctaatttttgtatttttagtagagaaggggttcaccatgttgctcagactggtctcagacgcctgacctccaaagctccgcccgccttggcctcccaaagtgctgggattacaggtgtgagccaccgtgcctggccaattctttagggccaacttctggctcctttcccaacttcttcatcccttggggatctctagaatcagtgccaagcacatagtaaatgctcagtaaatactcattgcaagaatagactcctaggctgtactgccttgtgacatgtccttttgcttaccgttgcctgatgactcggaagttctgtgtacgtggttttagctcctcacctggttgacaatgagcagcaggcaaggagtgggaatgaacacacagggagaccgatcgctgagaacaccgacagttcccctctctctaccagagcccacaggcggttttgtgagctgcttccccaggagcagcggagcgtggagtcgtcacttcgggcacaagtgcccttcgagcagattctcagccttccagagctcaaggtgcaagcgctcccctcctttgacacctctcccaccactccctccctgctagaccccctaactccatctgccactagctttgggatcatggggtcactggtccccactctggtcatttttctgcttagttctgattttctaggggcaaggactttaccaaaatcacctggcagaattatctagaatggtgcttttcaaatggggattctagaacataatcttggaagttcaaagaagttttgtcccttaagaggagttgaggtacctcattagagtttgaggaaccgtgttctagaggctgattgccactccgtaaggctgctgcaaaatttctgtgcaaagggcctggcccggtgcctgtaacacaatagctgttcaagtaaatatttgtgttttaaaataaccagcccatctcgttccctttgtttaggatgacttcttcttccctctctgcccacacttacgttgtatgtgacctgcctttgggttaaacacttgactcccaggaagccatctcagtcccttccccagctgggtcagtttgctttcctgtgcccccactgccctccatgttggccccaaagcactgactgttcacccccacgaggctgagctcgctggtgctggtcctgtgacctgctctctcaagtttctggtaggctttaatgagcgtgtgacctgggccacgtcctgtggcgtttgttctcctaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttggtgagaaccaggagcagcccggcaggacaccaccccttcccacgtgggctttgtggtggccctgcttgggaaatgggcgccgtttggggaacctcagagcccctcccaaccgtgtcttttggcttcctgtgtctgctctctagactttgatgatgacggaaccttgaacagagaagacctgagccggctggtgaactgcctcacgggagagggcgaggacacacggcttagtgcgtctgagatgaagcagctcatcgacaacgtgagcagctgagcaggcctgggagcgggagggagcagttggggctctggcctgaaactctccctttcccagatcctggaggagtctgacattgacagggatggaaccatcaacctctctgagttccagcacgtcatctcccgttctccagactttgccaggtatgacagtggtcccccttcattctgggtacctgcaggttccgacctgctgcctctgggcctagggcatggctacaggaggtggtgccagggtgagagaaagccccagtccccacacacagggccggctaagctggcagtctcgccccgggcaggggcagccctccttgtcaagacctctccccttcccactgccattgtcattgctctgtgtttgtactcattagtaataaaggtttagaagctctgacccagtgtgtgggtccagaaagctccctctggatgtctcggggagttcttgcagagggggctgacacacggaacatagcccgttccaaagaagggtctaaagggagaagggggcaagttcgggtttagtccctgccctcctcttccagcagaaaacccaccgcttttctcttgttcagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttgaccct

SEQ ID NO: 36029 - DNA, 26229 bp, Homo sapiens
gagcgcggttaccggacgggctgggtctatggtcgctccgcgggccgctccgccggctggtgcttttttatcagggcaagctgtgttccatggcagggaacttttggcagagctcccactagtaagcgatcttccgtcttctcacctggggccggtttttgggggagctgtgaggacggggcctgtgactcccctgggcctggatcccagctcagttccgagtgccggggtcctcacgggagaccgcagcggtcagaatcaagatgcgcttttctgaggcgactcccctccccgcccccagccccagtttcggggagggaaggatctgtgagggggaggggtgggagagagtttcgtctcccgggaaggaacgtttcggagtttaatttcggattcttggtttagctaggccgcggggggtcggatagagtgggcacaggtacgggaagtgtgactcagctcaagactgtgaggctacctgttcaggacagttgtggcgtgcttttacctggggtttcttcgggtgatcggcgtcgtggtcttttgtcattcactgtatatcttgagtggatttaatattatgaggagaggagagagtctggcttgtttctgcctactaaccgcttcttgcgcgtactttatgtctagatggagttttatattgataaggtatagggcaggtgccctctaaatttatccatttcattagcctgtgctttatattttgttttaaaggcctatttttccagtgactttgtttacctgtttctttaacctttttcatgaataagttcttgtttctgtcagtgaccatgtgagagctagaataatattaaaaacatttatccctaaatacatttgtttaagcaggcaggaaggtgcgttatggggtaaattgaacatttgagtaggctttccactgtatagttgaaagatgaacagaatttgacaaggtatcttggtataattttttatgctaagaaagcattagtaagtaatttaaatttcgattctgtgaataggatctgttcctgatgttcattttttagccctttgcaaagagaaaaaaagaaacaatgaactcagtaacctatttaaggaaaagcaggttttcctcttgctataaagtgattctgtggagatgacatgttaaagaagctttaccactgatcatatgtgtgtgtgtgtatatatatgtgtgtgtgtgtatgtatatatatatgtgtgtgtatatatgttgcattgttttcacacactgaaatattgcttgggcaaaattaaagtatcgaaagtttaggtattggagttagagctcctgaaaaaaaaagtttaggtagtggagaagagatattctgataaactctgaaagaagctgagagaattgacaagtagctgactgttgatttttcagtttttcaacttaaaaaaaaaagatcctgccttattttcaatagtgttctcattatgctttcatttattcatagcattctaaaaatatgttttcacttttcaaatataaaattattataaagttaagtgtacttctttgaaactattcttttctcccaattcaaatagtcctaaaagaagggaccactttgccttgctcaaatcccttgagcagtcatggagtttcttatctggaaaaggtaacgagtgtggaagacaagacaattctggaaaaacaaacgaaaagattatgaaaggccattgtcttaggtgaatttggtgaaagagggcaattgatattaaatatgctatatttcatgcttctaagatgcacgttttcacactttaacatctttgaaatcagcatggcagttgctttcatagcatatgaaataatgatgaatcctagatgtaatcttaaatttgatgaaatgcagtatttataaagttttttagtttattctccatacagagttctgtgaggaaaactcataaaatgtttgtgaaatttatctttttaaaaacataaaatgactctgtggggatgaaattaattagcaaaccacagtgtagttgaggtagaacaaaacacagtctgtgaccaaaatgaactagaagggcactaagtatttgctggttaattgaatgcattaatgaacaagtaacaaaaataaaaactacaaaactaactgtggatactttattggtatccacaggaaactgaaaatacagttacttactatctagaaaataacatcataatagtaccatatatggaatgtaaccaaagcttgaatgtattagaaaatcaatatcctgaataattgagagataatagaaatattctatttaataatattaagaaggaaacatgaaataaacctaaagaaacagaaagacttaaaatagataacgatgctaatatattaaaaggaaaaaaattataaaagctaattcttagagtaaataaaaacagtagaccaaactactgctagttaaatcaggggaaaaaggaatgatacaaaaatacaaaattaggaatgagaaaagtaaacccaggggtacttttgggttatctccagggttttaaatttgaaagccaaagcaagttaagagtattacccaagagctatgtgttatttcatgggtaaatactttccatctttcaagagaatctccttttgaaattgttccatttcatacagaaagaagaaaagctttctaattctctttatgaagccatgataacacagaaaaatctagcaaagggaacactaaaaacagtctcacttttgaatattaatgcaaacattgtaaatgaattattaccaaatgcagtctaacattacattgaaagtataaaacatgacattggattttattatagaaatatagtcaatattaagaaatcaagcagtaaaggtattaaaaaactaatacaattcaacatttatccttgactaaagctcttactaaaacagaaataggatgcttccttaacatgaaaaacataaagcatcagcagtggtgaaacattgagataattagggtgcctatttaagattttaccaatatgctagtcaatacagttgatacaaaggagatatagaaagaatgacaaaacagggacaaaattatcaatacgtggaaataaaattaatgagaaaactcagttaattgagaagttattagaaataataaaggtttaggaaggtgaccagttataaaatgcaaaaataaaagctttttaaaaatggatagagaagtataatttacattagcaacagaaaatatacagagggaaaaatataaagaaatatacagaacctgtaggaagaaaactttaaaagtccatagtggcacatacagattttaatagagtttgaattcttggtaagatgtcatttctccccatattgatctttaaatgtaatgtaatcacaaaatttgaatggatattcttttttaggactcgacataatgcttctaaagtttaggtcttagaataattgtgatagaatagtcagaaattttcagaagaatagaagggagtatttttcatatcacctattaattacttaattttctatgttttaaagtagcacagcatatgaagaagaaaaaaataggaaattataaagaagatccaagtataatgatagaattataaatcaggaaataccttagcacatttggataagcatttgacaacatatttagctggatccctgctttatactctgtaccaaaataaattccagatggatcataaattgaaggaaaaaagctcttaagggtattagaaaatatgggtgaattgttttttatcgttttgaatcaggaaaggccttgctatgcctgacaaacatgaaagtaaaaggtagatttaagtaagtgattcagatttctgtattacaaataaatactgagagatatttaaacttgggagaaattttgcacttatttgacaaacaaatgatttattatttatactatacaaattttagatcagaagaatctcttaatcattaaaaaaatcggtaatcccattagaaaaatggtcatattagaattaacattgtacaaaagaagaactgtatttgaccaataaagacatggaaagatgtttaacctcaaaagtaaactacagggaaaagaaacagtgacatactactttgcctttaagttacaaagtatttaaaagtggcagtaacccataggaattttttttttttttttttttttgacagagtctcactctgtaccccaggctggagtgcagtggtatgatctcaactcagtgcaacttccacctcccgggttcaagcagttctcctgtctccgcctcccaggtagctgggactacaggcgcacgccaccacgtccagctaatttttgtaattttagtagagatggagtttcaccatattggtcaggctggtctcaaactcctgacctcaggtgatccacccacctcggcctcccagagtgctaaaattacaggcatgagccaccgcgcccggccaggattaaatattataagattcactcatgaactgttaatacaaatggaaattggtataatgtttttggagggtaaactgacaatgtgtatcaataagttaccagcaacactaacccattaatcctacttctgggaagttatttcaaatatattattaatcaaatatgcaaggagaattacaaagatattcattaagaagaatatcattcaggaaaatagtaggaagagagtttttttttataccagctattaattacttaattttctgtgtctaaaatagcacagcatgtgaacaagaaaaaaataggaaattataaagaagatccaagtataatgatagaattataaattaggaaatacctccatgcatttggataagcatttgacaaaattttagctggatccctactttgtaccaaaataaattccagatggatcataaattgaaggaaaaaagcccttaagggtatcagaaaatatgggtgaaaaatgacgacctgtatttccatcagtagagattggctaaataatgatccatccataaagctgtataaaagaatgctgaataacaagttcattgacataagacttcaaatacatattgaatgacaaacacaggttcaagatagttttttctttgagtcatgtcaatttcatatctggttaaaaatagcacacttgactaggcaagaggaggaggctatcagtgtaacacattctgaggcagtttttaatataattagatttgtgaagtaaggaaattaaatgccatagttacccatgaacagctggaaaactatatacttcctcaaatctaagccaccatcaattggtgccaaataattccaccattatcttatatcactaagaaagaataaacatgctgccaattaaaacacgaaggcatcacagattgtaagacatatcttgatatcagagccagaatcaatgaaatacaagctagtaacagactaaggaggaagaaggaaaagattagagcagaattttttcaggacgtatttacatttattagtgagataattcttattagtcacgtttcaagaaatgtgagaaataattgtctttaaggttactttttgcactttgtacttctcagaatatgaacaatgtgttcaatcttagagtgtttcctctgaccttgcttgttgattttctgtaacatgtcttttctagtttgcaatggattttggataaacaagatctgttgaaggagcgccaaaaggatttaaagtttctctcagaggaagaatattggaagttacaaatattttttacaaatggtaaacttttttaaaaattggttcaaattgtatagttggttacctctgaataaaaatgtttttgtgtggtaatttgtgaactgttttagtgcatacctaacatttttgcttatacaggtattctttttacaacatattcatttatctttctttttagtgatccaaataaagtttttttgtgtgaattttacatatcacaggcactcaagacaatttgaaagtgttacctaatctccctaagactttataataattattagacccagttcaaggttggctaaagcaaagtactttgaggataaatgattctttggattgacatcctatagtggtcgtttctcttagaactttgctttgaagggaagaagatgtagggatagatctttactctgacatgtagtaggtttgtcacataatttttttaactttcggttcactattttgtaaacttatcttttttttgaggattcgttatggatttttatgtattatttatttattttggtgagctgtataaagctaagtgtggtggctcacacctgtaatcttagcactttgggaggcagaggtgggcagatcacttgaggccaggaatttgagatgagcctggccaacatggtgaaattccctctctactaaaaatacaaaaattagctgggcgtggtgaggcacaagaatcacttgaacctgggaggtggagattacagtgagccaagatcgtgctactgcattccagcctgggcgacagaacgagactctgtctcaaaacaacaaaaaaagtggtagtattaacaagtttcataggtgtctaatattttctttttatatttattataaagatactatgaaaagcattaaaaatatttagaagatagaggggaaatatttattcaacttccttaatggatgaataattttttcctgtggggcaatttctgttttgttgttgttttgttgttgtttatgcatacctatatatttcttaacacatttgcaaatcctagaattagaccactgtgactcacatagagcatgtgtaggttttttcctttgttaaaaatgaacataattatgatttaaccacatggaagttactgttcaatgttaatattataatgataccagaagatacatttaaaatttcattatttgccttttagttatccaagcattaggtgaacatcttaaattaagacaacaagttattgccactgctacggtatatttcaagagattctatgccaggtaggattgtttttattttatttatttgaactcttatctaatgttgatgaaccttagcacagtgtaaatgaatcatgtgtctaccatagagttatcttgatttttttcccagtgtgttttctgtatgaatgatatttaactttgttttatcatattttaggtattctctgaaaagtatagatcctgtattaatggctcctacatgtgtgtttttggcatccaaagtagaggtataaaacaattttctgttcttcatcaaagtgtagtcaatgtatgttggttaatctgccccagttttcacatggcctatgtaaaattaataaatggtaatttatgcaaaatactaaaattgtacaaaatcaaagaaatatatacatatccttatatattcacttaacagacacatacagcacttactgtgtaccaactgacttaatctttgtaacaaactggaatacatagtagtagtattcccattttataaatgaggaaactgagacagagatgaagaacttgcttaagatgatatagctagtaagtgtgagagcccgtgtttgaaccatgggagtctcgttaccaatcctgtgttcttaactactttcctctgctgcctttgagacatctattgtttggcactgagtagtattcagtaagtaccacagcttgcctaccataacctgagaatgtcccttatgcttctcacccatatgcttatcttctcctgtcttccctcccatcatcctgatgattggctgcctaccaagccagaaggaaggcaaggattaggggaagctatagctatatagagtctaacaagtaaaagttgaggttgtgagcgtagagaaattaggtaagggagagaagatagataggaacttgcggcagagactgaatttctgttcaactgttttacctttgtagtatttttgaaagagctcagctaaagtccagaaaataatagcagatattggctgtttttcataaataatgtagtctttggtggtgtgaaatctttgcattatgtttctatttttggataatgtcttagagttctattcttagagttgtattcttgaatattgaatgtgatttttacctagtaagtttacattccttttggcacccactttgatttagttttgttttagccatgatttaaggttatccatgacatctttcccaactgttacctaaataatgacaattgactctgttagaaataatattaagacaagctttctagaagtttatgttttctaattgtgagtggtagtttaagaaggcagaatcagttaaggtccttattatggattgagttttctaattctaataattctatgtaatatttgattttatttaaatattaccatgtaataatttaaagtctcttaagcacaggcagtatggaggaccaagacaaaaaatctttataaacatttaatcttgtagattaatttgaggattttaatctatcttacttgttaaatattgttatgtgatttactgagtagaactctgtgatgtgatttactgaatgaaagttttccctttgagttttggataaagaattattcctaggccgggtgtagtggctcacacctgtaatcccagcactttgggaggctcaggcgggtggatcacctgaggtcaggagtttgagaccagcctaaccaacatggcaaaaccccgtctctactaaaaatacaaaaattagccggatgtggtggcagatgcctgtaatcccagctactagggaggccgaagcatgagaattgcttgaacccatgaggtggaggttgcagtgagccaagactatgccactgtactccagcctgggtgacagagcaagattgcatctcaaaaaaaaaaaaaaaaagaattattcctgagaaagagaatgtagtctttcagatttggtcgtagcattattattattttttttttatctctgtgaccaaatctttctgtattttctctagttttatggaaattgtatggaaagctcatttaagaacatgtctcaggcttttactttttcttttcagttattatagttggaggtttaaatgtaaaacaaatatattagtacacatacatttcccctacacaggataaggatgtaggctgaaggtatttaaatagatttttagtttagctccttttgttggataagaaaccaactcttgatttttttattttaaaatgaagtgaaggctttagaaatcttacgaggcaataaatgaaacagtatatataaggtggatcataataaattttagtattttcacaatggtggttgttcagttgaaagaggaaatgggaactgactttggaagtcttacgtaattcctgtctccctgttctaaaaaggatagtaactatttatatggtttttttttttttttagttcttttggtgattaattaaggtttatcttattcacaaattcaactgttttaccatagaatggcatgaagtatctgttaatacaggttgaattgaataggaaacatacttaatattcttgcaattaagtatagaatgtaaacaatcttcttggaaactaatttaaatggaaaaactgacactgtaaccttaaggcttggtttctaatttggtaccttttattgttattaaattataaaattattttaaaatatgtcttaagttgtagcaatttgggggagaggtaatacaggcagaatatccgtaatctgaaaatcctaaatgctccaaaatttgaaacgttttgagggccaacatgacattcaaaggaatgctcattggaacattttgcatttcagatttttagattagggatgctcaaccagtgtaatgcaaaatattcctaaatcagaaaaatctctgatcctaagcatgtcagataaggggtaatcagcctgtacatttaggagtgtaagtacttcacacctcaagtagttagaaggtgaacagattgtaaacaggagcaaggaaatcctgttttgaatagagttcagatacccttagattcattgggttaacatgtacctgcttttctttctttaggaatttggagtagtttcaaatacaagattgattgctgctgctacttctgtatgtaagtgcaaaaagtatatctgctttaaggatgtaattctaaagaaagctccagagtacatagatttttttttttttagtttatgagacatatgagattggttggctttattaaatttcctgaggataactttatatctagtgtatctggcaaaaaaatcaagctaaaaggtttttttttaaaaagatataaagatattacttttaatgttaaaatggatagtaattatcaatccaaaaacatcaactcagtggcttttaatcttgtaagagtaaagaaaaaattctgtttccgaattttattgtattttattgttttctaatgactattatgtcattcttatgggtagatattaatatctatgtgcaaacccgttcctgtgttgttgggttgttatgaggaccaaatgagttaatataagcttttagaacagtgccttgcttagtatgttactttgctgaggctgccataacaaaatgccacagaacaggtggcttaaacaacagaagcgtattttctcacagttttagagcatggaaatccaagatcaaggtgtctggctattcttacatggacctttctgtgagcacacacactcctggtttgctgtcttcttcatgtgaggacaatagtcttacagaattaggccccactcttatgtcctcatttaatcttttttttttctttcttttttttttttttttttttgagacagagtctcgctctgtcgcccaggctggagtgctcacttcaacttccgcctcctgggttcaagtgattctcctgcctcagcctcctgagtacctgggactacaggcatgtgccaccatgcccagctcatttttgtattttttagtagagacggggtttcaccatgttggccagactagtctcaaactcctgatctcgtgatccgctagcctcggcctcccaacgtgctgggattataggtgtgagccaccatgtctggcctgtcctcatttaatcttatccctttaaagaccctctctccaaatacagtcacattctgaggtactaggagttagggcttcaacatacgaattttggagggggacatatattggtccacaatacttggtaaactttaggggctatcatcatcatcatcatcttcaatgacaacaacatcattatcactggaaaacactgtgccaatgcagtggcattggtaccaaggtaaaatacaaggaatttaaggacaaaaaaagaagacagaaacataaaaatattaatacagaaggaaataaatagtataagagagttacagagaatgctgtgaatgttttgggtgggaaaagattgtttcatgaatccagaaaggattaagtagaacttggtgaaggaagttgaactggggaaatgcaagagatagacagtctaagaacactgaatagtttagtcaaatagggaaagctcatgagttagattaactgaatggtgagtaaggaaatagtggggaaaactccttacctaatttcagctaatagagggccttcgatgctaaatgaaggaatctgcactttgttctattgacagtaatgaaagttagttatttgagatggagtctcgctcagccgcccaggctggagtgcagtggcacgatcttggctcactgcaacctctgcctcccaggttcaagcgattctcctgcctcatcctccctggtagctgggattacaggtgtgtgccaccacgccgggctaatttttgtatttttagtagagatggggtttcaacattttggccaggctggttttaaactcctcacctcaggcctcccaaagtgctgagattacaggcgtgagccactgcacctggccagttttatttatttttacacatgagggtaatgccagcattgtgcattaggaaggtaaatctgacccacctcagcctcccaaagtgctgagattacaggcgtgagccactgtgcctggccagttttatttattttcacacatgagggtaatgctagcattgtgcattaggaaggtaaatctgacagaattatgtaagatgaattggaggagagggcaggtagaattagacaaattttgaagttatttacatcccacaacatggatgaaccttgaggacattatggtaagtgaaataagccagtaacaaagacaaatattgtgtgattacacttacatggaatacttagtcaaattaataaagatagaaagtagaatggtagggctggaggaagggtggtatagggagtgattaatggatacagagtttcagttttgcaaaaattttgtatatcttaacacaatttaaaaacaaaaaccttctgaaatacagtaaaactgcaaactgtattgagtgctgtcacttaccacagggtgctatgagaaataaaacctaacaagtttaaagtggaaaaaataatttttaagttgctgaagtcatcccagtgaacactaatgaaggcttaaacgaatattggcagccagcaagaagaacaaacaagccagatttgagcgatagagtcagcagttcttataaaaagaagggatttaagaagagtcagaaatgtgttttgaggtttttttgcctgggggttggggagctgaagctggtactgaaaaagagaataagtgagttctgaaaagaattaaatttaatctttgacattctaagtataaatatgttagtagaacatcctcttaaaaatgtgaggccagcagtagaaatttggaatttgataacatttaagagttgcacaggccaggtatggtggttcctgcttataatccgaacactttgggaggctggagcaggaggattgctttagaacaggagttcaagaccagcctggacaacatagcaagattccagctctgcaaaaaattaaagaaaaactaactgggcatggtggcacacacctgtagtcctagctactcaactaggctgaagtgggagggttgcctaagcccaggagttcaaggctgcagtaaactgtgattatgccactgcactccagcctgggcaatggagtaagactctgtccctaaaaattaaaaaaaaaaagagttccacaatgtcttatgctgcatagaaaaagatgtgaaccaaagaaaaaaacatctttgagagagaacatagtgtcattaacaatgtgggggtggaggtagaagccagattgcaaggaattaagaagcaagtaggtgctgagaaaggaatagtctaactatattaaaaatatatgaaacaacttcagtgaagggaattgggggaaaggtgttgacataagtagctttggaaatgattaagagtgtaagagtaaaggcaaaaggaactacacataagcactgtactctagttgataaagttattacccatgggtgtacaagttaacaattctgataatgctatacatgtatatgggaattaaacaattacgtaaatcaatagcaaatgtttgagagccgggtttctcattgttggagcgggaatttacagataagcaaagggctggaaacagcatgaactcgtgtaccttaatacaatatagatggttagttacatatagaaatatttatagataagtgtatatacatgggttagtgtgtgtatttcttggctttctcagctgaaagggtctataagcaatgacatcccagtagcaatgagctcacctagtacccatatcttggtttctaatatcattctccaataaaaggtaccagggctccttggagaaatggttgattctaggactggggcaagaaatacacaagatggacctggaccatctcttaatgccagtaataaagaagtattcaaaacaaacaagaaaaacaaaaacgtctattgatgaggatatgtcaaaaggatataggagctaactaagagagctcccactgaccaaagctgaaagaatttgagcatcaaaattttaaaaatagcattggataataactcaaagtataaactaaatatccatgagtccatactgatataaataaatgagggagaagagacatgtcttccatgctgaagaattccaaataatatatgtaactattctgccctcaagtagagggagcataactccccactcctaaggtgctggctatacatgttaacttcctgctagtgtgtacatatggaaagggaggaaaaaggtaactttacagtggggaaacctgagaaatactgccttagccaggcgatcaaggtcagtagcaacagtgataaatcacattaatatcatgtatcattgatgtgatatgatgaagatggtactttatctcggtggtcttcctgtcaaaaacccattttctctagtctaatgagaaaaacatcagacaaattccagtagaggggcatttgacaaaatacttgactggtactcctaaaaactgtcaaagtcatcaaaaacaaggaaaggctagaaaactgtcacagccaaacagtctaaggaaacatgacaaataaatataatgtggtatcctagataagaccctaggatagaaaaaggacattggtacaaactaaggagatctgaaaaaagtacagtttagttaataataacatttcaatattgggtcagtaattgtaacaaatgcgccatactaatgtaagatgttaatagtaggggaagctgggtgaaggcatgtcttagtccacttgggctaatataagaaagtaccatagactgggtggctttcacaacagacatttatttctcacagttctggaggctgggaagtcaataacggtgggtataagagaactgtgcatgatctcagtgtttgagtctacaaaaataaaaggcagaggaatataattaggtagagtttgttttgcttttttcaagggaaatttgagcatattagtatgtgatggaagatttactgaaggaggaaggttaaagatgaaaaaaatagcaggagttatcaattgaatagatgataataagtgtataagtggtaagacaaacaatagagaggagggatgtatttttctccaagttggaggaaaaggattaaaagacagaaaaaaatgcagagcagttttagcatggagtaacagacatgtgacagtatcaggtaaatatattctcaatagaggtgttaggtgtcaaggtccaggggatggggatgtagatttgttttatatacagagataattttactttgttgattgtctaccattatataagaacctgttgtgctggtatactttacatcacaaggatttgtaaaactcagaaaccttaataggtacgtcttaaatttaaataaaggagagaagaaaggaaagattataaatttactaatgtcaagtttaaattattctaggtttcaaatcctggcagatattacacatctaaattagctgtagggcactgaatttgcaaaacaaatctttttgaaaacatagtgcatagaagaaatggaatttctttctttttttttttttgagatggagtctcactgtcacccagactggagtgcagtggtgtgttctcagctcactgcaccctctgcctcccgggttcaagggattctcctgcctcggcctcccgagtagccgggactacaggtgcatgccactacactcgcctaatttttgtatttttagtagagatggggtttcaccatgttgtccaggaggtctcgaactcctgacctcaggtgatccacccaccttggcctcccaaagtgctgggattacaggcatgagccactgtgcctggccagaaatggaatttcttttaatttcagtgaaatcacttgggctttgtacaaatggaagctgacactaaacattttttaggacctgtcagtagttacttggttgaattaaatgtgtcataatggcttgaatacagtttctcaaatagtacttatgtgtatatgctcacaccattttaaggagatgggggattgatggttaacatttttttttcatttgtactttatttagtgactaaccaataaagtaatagataatagagtactaactttatgtgttactactactactttatgagtaactcgagacctttgcatatatattaatgcttttattaaaatatatattttgataaatacctggtcattgtaaaaagtttagaaagtgcagattagtaaaaagttcttaaatctcacaaataaccactgttaacatttttttggtgtactatcctcccaatattttatatgtatattttttaccaattgtatatattgtaaacacatatgtaacccctgtgttccttctaagctcagtcactggaaaacagaagaataccattctgtagctgaaaagattttagaaatgataaaagccagtgatttttttttcctgatctttttcttttttaaacatcagaatcctttcttaaggtagtaaatataaaattgaagctgtgtagagtgtcctgccccccagtctttccccttccctgaaagtaaataaaaatctgcgtccgtaagtgttgccaagaattcctactgaaaataattttgctctaccctctaatattctgctctgttaaaggaattttgagttaatttatttcccattttctcagtttaaattttttttttattttctgcagtaaaaactagattttcatatgcctttccaaaggaatttccttataggatgaatcatgtaagtatatgatataaaatggaacaattatcaaagctatatataaactagctctattttatattagactaaatttaatagtttcctagaaatggcagtttcaaatattacataaatacagacattattctaaattaaagctaaatagcttttaccatttaaaaaaaatacttcatagtggcgattatcaaccctggctgctcattaaatcaccttgggaacttgtaaataatactgatgttggatcctttccagaacaacaaaatcagaattttcagccttggggctcccaacattggtactgtgtaaaaggtcccaggtgatactactatttagctgggattaaaaactaatggaacaatatgaaatataaggtgaatttctattgacattttaataggtatgtcctttttccaccttgcaagggatttgtttattctctttaagttacattttttaaattaagtagaaataattgtatttttgcatttgctgagtagaaagtatactggaaaatctgatggttttacaggatattttaaataaaagtgagtaataagaatgattgtgagaagctggcttttccttacaaggattaaaatccttataatcataattgcatttctaatagtaattttttattgcagatatttattttaatataaactatgtttattgtctggatttttaaaactttttagtaaaaatttttgataaattactataatgtctgtaatttatgttagattaagtggacttatctaatttggtttcatattgacatttcattgataatctttgttttaaacagatattagaatgtgaattctatctgttagaactaatggtaagtaaatcttctgtgattaatagattaaaacatttttaaattaaatgaagttggaaattatttaaagaaatgattttagagaggtacattttaaaaccatccacctaatatgtgatggtgaaatcatggtagcctatttatattagcacctagagtctctctgaagcctgtaaaataatttgtatatcctacttaggatgggaaaatttttctgttctatagtaagtaactataatgaaaggattacaaacagacaagtcaggacattaaaccaccataaattatgtgcacaatttgtgtgtgcgtgcagtgttatttaaagatagattatgtctttggcagaattctgctcctccagttgggaattatgaatttataggctaataagaggtttcagtgtgttgcagatgtgacactttgagtctctaagggaatgaatggatgctgactgactgccaaccgatttatcaaggtatattccagagagagcactgccttcactattacggtagagtttagggctgtcatactgctagcttaagagaataaaagggaagcaagcatgagttagtgaaattcactttgaaatacacaattacaaatcagttgggtaatgataacatttttgtgttgtaataaatctgttttttatacatacacattttttaaactgtttctaggattgttgcttgatagtgtatcatccttatagacctttgctccagtatgtgcaggacatgggccaagaagacatgttgcttccccttgcatggtaattagaacagaagttattaatagtgtaacatgttattagataggaaggttgacaattaaatatgaagttaagtatttttaaagtcattaaactattgccccaagatattttatgttgagcaaaataccacttgttgaattttaataactatagtggtgtaaatgccaaaatgaaaacaatcctaaattatctgttccataaatatacctattaaaatttaattttatacaaaacacagactgttaacataaaaattaagactgaagttatctttaaagtaatcagaatactttttggtagtctgcaacatacatataaatttactgtataatttctggttttttaatttgatttttctgatttttaaaaaattagaaaaatgtgtttataatttgttatgagattttgaaatttaaaatatatttagctgtaattttattcattgatatgtgcttatttgttgtcacattcatgtatccatccttttgccttgatgttttcacttttatagctgtgcttcagtagtataaaaggaaataaatgtgtgcaaagatgggaaatctggccctctctggaggaaatatacaatcagatgaggtagttctgctttcagtaataatatgatttacatttctataggaggatagtgaatgatacctacagaacggatctttgcctactgtatcctcctttcatgatagctttaggtatgtaagcatggtgtgcctttatgagttaaattgttataaacttatttaggtcatcctaaactaaatttcaccctattgtactttatgtttttatgttccatgaagtaatagactaatccttgcatgtgagctttcaataatatgaactgcaactgtcataaatcaggattattattcccccaccccctttttggtaagttttttttttttttttttgaaaccattcaaaatagttttaatcggtgtctgaatagaacatatttgtttgtttagagggaaaagttcagaattaagccagctaatattagttgtagcatgtaaaataattggggctttcatatcctgagcccaaacaaatactcagaggttgagtaaaggagcatctgtggtccataatgcttggctggaggaagacgttaagtacattcattctacagtctgtggaaagcagtgctgtaatgggtggagtcagatagtcctaggcttaaactttacctcctttacaattgtgggaaaattatctgacctttccgtgtttgtttccttaattgtaaaatggagagaatactaataattccactgagccgtttgaagaattaaatgagataggttgtagagcaccaaataatgcctgttatatattgggcacttgttaatttttgttccttttccttctattgatttttttttttttttttttttgagatggagtctcactctgtctcccaggctggagtgcagtggtgtgatcttggctcactgcaacctctgcctcctgggttcaagcgattctcctgcctacaggaggattataggtgtccaccaccatacctggctaatttttgtatttttagtagagacagggtttcgccatgttggccaggctggtcttgaactcctgacctcaggtgatccaccctccttggcctctcagagtgctgggattacaggcgtgagccactgcaccccagccccttctattgatttttataactccatcctcttgattttcccctcttattttccattggtttgtctttgttcagttgttcaattattccttaaatgttgatgtttcttggccttcttacatcagggctgacaaataggttatacttacacttctgtattactggcagttccctgaaaggactggatttgaaaggattttgagtggtgtcctacccagtgggtaggaatactgggatctgcataggtaggaaggaagggataacagaacatgtgtcacatctttgccatccctgctgtcttcttcttgggtactttaactgagattcatggcttctactatcacttacatgccgaaacatttaaatctctttatttagccaagatcttgccacttggcagttctttatatccatcttccttttacatagctccgcttggcatcccaccagcacctcagactcatgatgaggattgagcttatcactttgccccaaaatatgttcctccttttaatgtctttgccagtttggtgaatagcactagttatataccttagttggaaacccagcagttaggccctttcatctccctcaatacccacatgtagttgtttaccagtacattttgtgccttcctctcgattgttccttctgtaatctcatagtcatcttctcatttctatccatgttaccacagcagtctcctaactggcttattagcctccagcactcccatcctcagagagcctgtctatcttccaaactgttgagctaggctagtggtttcacctggggataattttgccccgaggggacatttggcaatgtttggttttagttgtcataactagggtagggtgctactagcatctagtgggtagaagccagggatgctgccaagcatcttgtagtattcaagacagtgtcaaagaattgttcaacctaagatgtcagtagtgccaagattgagaaacccggagctagccaaattcgtctcccaattgatatacatactattctcttctcccactctcattttttttttttgtaagacttggcttagatatcagctcttcagtgaccctcccccaccctttcagcatcacctcagtctgggtttaggatgcttcctcaatcttcagtgtactctatgcatgcccatgttaatagcattgtccactgtattttaatttcctgtttttatcatgtcagtcatttggttttttttaacctcttcttgacctaagccctactcatagctttgcttgacttagggcaaccagtgtgtcagttcacatttgagttgctatttgcctagaatgtcatccttagcaaagacatggataaccagaccacggagtataacttaagctggagtgggttaagggtatacaggctgctcagtagaaattgttttaggcaaaattatgatgtagattcctctcttttgttagtttatattgtatataacatatataactaatattgtatacagtatattacatttattttctaacctttatttgattacaacactgaattctgtaaggatgtgcccagctttcacataacttgatcatgtgctaataatgaaaaggaagaaaaaaggccaggcaacactgcttttaactgaaatgtggaaacacagtcaacattgttaaaacctagtatattaattaacatttttgtttgttttgttttgtcacactgacttctgggtgcagtttaacggctactttgtacactactcagggataacttcccttttctgctctcctcattggatgtttttcctctttaacgtgcctgactctcaaggcaactgcaccatgactagcacgcagtgaggaccagatgtcaagaacttgatgtaatctagtaattttttctgtctcggattacattgatgagatggtcagtggtaactctcatatgtagctgtttaatgttttttaaagagtgttggaaaatacacaggaaatagtgaaaaatctttgttagatcatatattctgtgtttgcagttaaacatggacagttgtctctcattttcatttcagcttgcctacatgtagcctgtgttgtacagcagaaagatgccaggcaatggtttgctgagctttctgtggatatggaaaaggtattcccttagttgtatgtaaacttggatgtttaaaaattaatgtcatatttacttatcatgagcctaaaatcttgtgatgtccaccaggctaagaagattattggttacaaaatattaagaaacatgggctgggcatggtggtttgtgtctgtaatcccagcactttgggaggcctaggtgggcggatcacctgaggtcaggagttcaagaccagcctgaccaatatggtgaaaccccgtctctactgaaaatacaaaaattagctgggtgtggtggcatgcacctgtactcccagctactcgggaggctgagacagaattgcttgaacctgggaggcagaggttgcagtgagccaagatcgtgccactgcacgcgagcctgggcaacagagcgagactccgtttaaaaaaaaaaaaagtttggtaggaagagttaatgctgattatttaagttatgtatctcttttcagtttaggattaaacagaatggtaaacttttggtttaattggttgcaaagtagcctctcattcccaggattattttaaaagctccctggtaaccactgaatactactgtgaacttctgtaacatagcctatctcctggcagaatggcttttgctgtgtttctagcttttctgctcaagtgttaaatgcattaaaattaatcctaaggttaggttctactcaggtgggaaaaaaatagctaatttgttaactagttgtttcaaatttgtagctgccagtttttgagcaccttaatgtatgtgtagtaacagagaatcaaaacatcttttgtgcactacccccgattaagttgtttaaaataatttatactagaggagtgtgctctatagtggtatattccctcatgattagaacctttattcttagtatgtttcagtttaaaagataccatcagatggaaggaaatcagctgcagagatagataagaatggacaatgcacacatgctgaaaaatgagatgctagaaggaaaatcctaaacagcactgtggtgaaaaatactgctttcaaatttatcaggatttaaggacagagactatttactgttttctgagggttgtgtagtgatgtatgctctttatataaaaaatgttgcttgtttttgccactgagaacttttcaaatattttcttctagattttggaaataatcagggttattttaaaactatatgagcagtggaagaatttcgatgagagaaaagagatggcaaccattcttagtaagatgccaaaaccaaaaccacctccaaacaggtactttgtagactttaattattgatgtcatttaatcatatatcatacttactatatttttcttagattatgttgttttgtagtttttaaaacatttcttccaaaacttcatgatccatgttaattttattttttaaatttgtgatttgattgagaatgtctcatttaaaaaaatcactaatctgattagtaacttttcctaatgcagtggaggtatattacaggtatctctcaacatatggtcatataccataaatttaaagctgacagaattaggtaagttcatctgaaattcagggcagaattcagaactatagtagtttcatgtcagtttgattctgtgccatcttttttttttttttttttcactgctggctattgtcctgttttataaatttcagtagcaattttcaaaaatttcaatgaatgatctgatattgtaaagataaagaattttggtttttaagtgaccctaaggtccatggcacataagaatatatttttgctaaaaatgaatcacctgtgctaagagggttttttttgttgttattggggtgtatgtgtgtgttttaagtaagatgtgttcatttagttcagtggttctcagccctcactgtgtatcagttcatttggggcagggagaaaaagtcagaagggaaataaagaaatgccatccatcttaattgtttctttagaaaaatgattgttatataacaagatagatttatggattgctactcataagttaatgttacaatttggaaaaagttaatactttattcaaggagctgtttaaggcagtcattcaaacagctacctttggatgcattttttgcagaaattccctgagtgattctccactagtggcagggcctgaagctgcaagatgatggtggacaagataaggcaataatcctattgccaaagttactggtattttcagttttagttatttttaagtattcagcatttttattttaagtattcagcattttccaggaaattaccatatttcttgctgacttataaaggtttgctgtatttatatatgattttattatgcctttggacaacagttttggtttttttttttttttgaagaacacttcttgtttttcataaatagtaggaataggattttatatgtaagatttaattttataggaaatttgtttagaagaagctgtaatctctatgttgagtgatacctgtaataacaatgaaatcccataccctaatttaaagtttttgagtatatatggacactaacttccagaatgcttgttatatgtgagggcacaaagttatataagaataaaaacataaaaccaatgtttgttagtcttctggattttaatttttcacgtgtcttataatgaggaatgtctttgttttgtatagttgtgccacagaataatgaatttaaaagtcagtaggcttatcagggtgtaaaaatggatcttttaattggtataaaatctctttcttccccatttgaacagtgaaggagagcagggtccaaatggaagtcagaactctagctacagccaatcttaaaacattccgaagaattccatagtggaccacttggaaataaaccattggacagatttcagtaatgtcttcagtggaacacaaatgaaaatgaatagcttgtttctgtcaagcatattggaaagtgattttatttttgcaaaataagtttttctttaatatgattctagtacataattgattaaaatctcttgattataaatgtttggaaaggttctaaggggacctacagacagacatacatagacatttcaaaattaatagcttttgattagtataatatttcttaatttggataataaaaattgtagctttttattaagccaggaaacatgaagcataatttgtttaaaattctctttggtcattgagggaccaaaaaaggacgtaaaatttacagtcaatctatgagggtttttttccctccataagtttaactttaaaactgtatttaaggaatcaaatcttacaaaatcctggaagattttggtaatgatgttgataatttcagggaaattaatcaagtacctatattgatttaaaagtgtattttattcagtagtttgaggatcttgccatggaagatactagcccagcctagcagaaaagtgcaatatgtatagcatactttgacattttaaacatgatagtccataaccattttgaaatgctgggcaaactacatgaagttatttataattaattcacagctaatcaggcattttgaaagcttaattggattcaaaaaccataatgttggaatttggtaaaattttaatgttgatttttactgtgaaaaggtttttataagatatacacaccctagtttaatgttgtgtcttggtgtggatttacagatttactacaggtattctgaaccaggaacacaatcaggtttcaggccagtttgatactggctgtccttaattctaatatgagagtaggacatcatactaaatgttatgtcagtgggactgtactgtctgtggaacttagcaaattaatcattttcttcagacttgaaggagagtgataaataaaatttggagtcataggatattgatgcacaatttaaggattaaacatttttaatcaattgtggatgatggcttattaaatgttgacttcctagtataaaactgcaagaataaaagtaacttctccagctgt

SEQ ID NO: 36030 - DNA, 239862 bp, Homo sapiens
ggcgggaggagtaaagatggcggcgcgagggtctccgccctctgctccgggctgaagcgctctgagagaggcggcagcggcaactcgagccccaacagtaatttagtgttggtagttttggcagcagctgccgaggccggagcaatggcggaactggagcacctaggagggaagcgggcagagtcggcgcgaatgcggcgggcagagcagcttcggcgctggcggggctcgctgacagagcaggagcctgcggagcgacgaggcgcggggcggcagccgctgaccaggcgcgggagccccagggtccgcttcgaggacggtgctgtctttctggccgcctgctctagcggggacaccgacgaggtgagaaagcttctggcaagaggtgctgatatcaacacggtcaacgtggacggcttgacagccctgcaccaggtaactcctttcttggtcttagaggcgtccagtctcctacagatgagcctttgaccctgcgagccaccccatggggagtatcagtgttgccgccgactccttctgcatggacactgcccttttgggctaatcggtttcattcttggccagcttcctccactaatcaagtctttttctgaccccagggtcttaggaatagcgtcaccccgctgcttggtcagtgtttgtatttccctccacctacttgtgttgtcatggttactggtgatttttgtccctggtcttatccctgtagattagttatcttcacttatgtctggttggcgtgcctgcacaccgcgtcactcataggcacagtgtcatttgtttgatgccctttcagaaaattcagttgttgtgtgtccccgttatagaatatcttatatcacttaaagagtaaagccctttactgggtaaagacaagcaggtctgaaaccacacctcttgttttgttgatttgtagtacttcaaaacagtttgtgttgcctctaggctacagctcctagaacacgctggacctcgttgttttaggtatcttaacttccttctcagcagtgctacctccctgagagcttcctatggagaactaagttactgaattacctctgtttgatacttatggaatagcttttctatttttctatttttttttctaaagtgctctatagaaatcccatgccccatgtatagctatactatatggattgtggataatctgtgcttggtaacgacacctttacttctgtcacctaatgcagcaatattctctgtctactgactgccatgactaactacccctctctcctcaaatggaacttcatcagttattttggtgagctgagagccggacacccactcttaatcttttgtatttttcttcttctgccgtctgtgcaaagtgaatgtattggcatgagaatctacttctaaataataactcaactttatatcagaccacttccctaaatatatttagccaatagcttaaaaagttacttctcactatgtttgcaacccttctatttcaggtagaagaaactctttcaccctattttgtacccatttttttttcctgctgataatatttccccacctgaggtagtaaccaatatttgtagagtgctttgctgtttgatttcatatgtcttaccccatgtgagtttcagcagtgatcctttgaagtaggtgtggcaggtagtgttgttattctcattttacagatgaggaaactgaagctcaggaaaattatttgtgcaaagttagaaagtaaagaagtggcccataggcatggatttttcagacttatgtcacagagatctctatctcacttaataaggagctgaatgtaaaatgagataaaagctaagagaaccacattaaattctaaactttaaatttctgaactctttgggaaggtgaattcttgtttttctttttctttttctttttttttttttgattcagagtctcgctctgttgcccaggctggagtgcaatggcgagatcttggctcactgcaacctctgcctcttggtttcaagcgattctcctgcctcagcctcccgagtagctgggattacaggcgcctgccaccacgcctagataatatttgtatttttagtagagatgggctttcaccatgatgaccaggctggtctcaaactcctgacctcaggagatccaccctccttggcctcccaaactgctgggattataggcatgagccgctgtgcctggcctagtaatctattgaaataagagaagaaggggatgacagctatggatttttttttaacatctataaatgcaatataagcattcctttccatttatagggctgacaaggagttgaactgaacaagtatactcgattctagacaaattcagctaaaaattaagctgcttaaagatttgaggtctgttgagaaactgtatctttgaatcaagacaacgggcctttattggcttcagaacattacaagtcagtttccgaagagttacaatgtgtgtctccatgacttggagaagtttttgttgttgttgttgttgttgttgttgtttaaaaaaaaaaaaaacagtgtctcactgtatctcccaggctggagtacagtggtgcagtctcagctcactgcatgcaacctccgtctcccaagttcaagctattctcatgcatcagcctcccaagtagctggaactataggtgcccaccaccatgcccagctaatttttgtatttttagtagggatggggtttcgccatgttggccaggctggtctcaaactcttggcctcaaatgatctgcctgcctcggcctcccaaagtgctgggattacaggcatgagccaccgcgcatggccgacctggagaactcctaaggtacataaaagactattttcaaatgggagactggagctgttggtagctgaaccacctactttacaatggattcaccttctgtgaaatggagagtgagtggtacaattatctgaattatttatttaaaatgtccatttgttatacaagcacgatataaattatctggataattgcttcttttctctcttttggccatggccacttgaccaactgtggattattgtcttggcatgttagaagcccccagataatactgggggacaatttttctcctcctacaacgtcacagtagatgatttgcactgcagcttgtggtgccttgatgcttcttttggacttagagaccttctttcttggcagcctttgctgagaccacgaggtgcttgagtcaaagataacaagctccagggggcctattaataatacttgagttagactgggataagaagtatctcaaaggttagaccaactctgatgaaagccttggaaactgatgcagactaaatttcagtgactaaattaagatttggtgtgtatgcatgtgttgtcctagagtccttaacaaggtattaatctgattatagaacccttgaaagcacttgtttgctcacaaaggaatttctgtttcatttgcgtatacacattgtaaggccaggaatatttgttaataattctatgtggaatagtactttaaattttttcttttatttatttattaagtttgactgttagcacctatcttgatatccttagcattataatcttaggtactctaggcctagatacatgatatctaccaaattattgctgtgggaagaggcaagtgcctactttcagaaaagagatttttctaggatttattaaaatgaatgcttacttacttcagcatgtattatgttgactcttaaatctgtgctgagtgtggtgagggatgctggatttcagtcaccataggtcttgtctcttagcacggtctgatcagtcttcatctggagggctaccaaggagattagaataattccatacttgactcagaaattcacactggcggccgggggtggtggctcacgcttgtaatcccaccactttgggaggctgaggcaggtggatcacgaggtcaggagttcgagaccagcctggtcaacattgcaaaatcccgtctctactaaaaatacaaaaattagcctggtgtggtggtgcacacctgtagtcccagttactcggggaggctgaggcaggagaatcgcttgaacccaggaggtggaggttacagtgagctgagatcacaccactgcactccagcctgggtaaaagagtgagactccgtttcaaaaaaaaaagaaaaaagaaattcagactgtctttgtaatgtgcagggtccaaatttggaccctcaaggtcacaccagactggaattcagtttgtagttgaataagcctttgtcattctagagttgcctcagtctgacgctgtagacttagggaggctaaaatcacgtatttctcaggaagagagatggagataggaacaagtgaggggaggaggataggctgagcaatttatattcagacagagacagaagatgagtaagatgaatgtgtgttcagttcaatataaaatagtatattttgtgtgctaactcatatggtaaaataaaacttgtgcttttaaccttttctcttttattctacatttattactcattcctctcctggttccacctgcgaagttacttttgccttaccctgaatattgatgaattctgcttagtgtcaggacccatggcaacataggattcagaaaaatcctgtttgctcctttattattgtgcatctagaatagtcatctatcctgagccattttagtagcttacctcttcaaattgcttaatatgttgcatcagactatgttggacctcaaagccatattgggaaattcagctttttgtctgtgtggtttttttttttgaaagtataaataaaaatgactttcatttgttccgcagaatttcttccctattcttcttctttgtgtgtgtgtgtgtgtgtgtgtgtgtgtgtgtgtgtgtgtgtgacagggtcttgccctgttacccagactggagtgtggtggtgtgaccatggatcactgcagctgcaacctctcaggctcaagtgatcctccccacctcagcctccttagtaactgggactacaggcacaccccatcatacccagctaatttttaaaattttttgtagacaagggggtctcactatgttgccagggctgatcttgaactcctgggctaaaacaatcctcccccctcggcctcccaaagtgctcggattacaagtaggagccactatgcctggcctctccccaattcttcaactcctgctgaataactgtatatcaccatttgggcttttagaatcttctactctgtgagtattttgaaataggcaacctgtcaatatatatggattaagcacaattctgccaaaggtaaggagttggaccagtcttgttgttaacataaaactaagtagtttatttttttcttttaaaatattttaaaactaagatatactttatatacaataaaattcactctttgtagtgtagcatcgtatgagttttgacaaatgcgtacagttgtggaaccaccactgtaatcaagatgtagaacgttaccctcaagattttttgtgctccttggtagacagctcctcccaccctcagcccatgacagtcattcatcagttattttgtcccaataatcacaatagatggaggctgaggcaggaggatcacttgagctcaggagtttgagaccagcgtgggcaacatagcaaaaccttgtctttacaaaaaaataaaattagccaggcatgttggtgcatgtctgtagttgcagctacttgggaggctgaggcgggaggatagcttgagtccaggaactggagttgcagtgagccatgatcgtgccactgcattccagcctggatgacagagtgacaccctgtgtctataaacaaacaagagccaccatgcctggcctagagtaaagtttttgatatttgaataatatgccattaattacatgtgtcccattcttttttttttttgagacagagtctcgctctgtcagccaggctggagtgcagtgcacgatctcgactcactgcaacctctgcgtcccgggctcaagcaattctcctgccgtagcctcctgagtagctgggattacaggggggtgacaccacgcctggctaattgttttttttgttgttgtttttttttttgagacggagtcttgctccgtcgcccaggctggagtgcagtggtgtgatctcagctcactgcaagctctgcctcccgggttcacgccattctcctgcctcagcctcccgagtagctgggaccgcaggtgcctgccaccatgcgcagctaattttttttgtatttttagtagagacggggttttgggcgggtggatcacgaggtcaggagatcgagaccatcctagctaatttttgtatttttagtagagacggggtttcaccatgttggccaggctggtcttgaactcttgacctcaggtaatccacccgcctcagcctcccaaagtgctgggattataggcgtgagccaccatgcctggccgtgttccactatatttttctctttagaggttttcttagattcttaattaacaactaatattgaatgtctaaatggtagattgtaagtctgtactagagtatatatgtggtataatttctgccctcaaggaactaacagtcaggtttggaaacagataaataaaaaaaagattccttttagagttccaaattctatgataccctggaaaggatgtattcctaagtggaaggacaaacgaaggcagtccaggatggtagagcagcatgggcgaataaataggaatgggtgtggtgtgtaggcagaggatgctaggaaatcctaatggatgtgtttgaagggttagagatgagagagagtcagggtgacatcctagagggctttgaacatcaaacatcaggccaaggtggcttgatggactccttagtagagaatttttgtgggtttgagcagggtcgttacccaaccaaagcagtattttaggattctgaagcagcacttggatttctgaatgaatggagagacagagttgagagaaccagctgagtgaatggagatgagaaaaaagtgtagtacaattctagcttgtgagtctgaaagaattgtgttattcaggtagaaatagtattcagtcaacgattagactgaggtactctgaagacgtacaaatagaaatctcctataggtgtttagcatggtggcccatatctgtaatcccagcactttgggaggccaaggcgggaggattgctggagaccaggagtttgagaccagcctgagcaatgtggtgagaccctatctctccaaccccctccccacccaaaaaaaaattagccaggtatggtggtgcaaacatgtggtcccagttacataggaggctgaggtggaaggatcacttgagcccaggaggttgaagctgcagtgagctgtgttcacaccactgcactccagcctgggtgacagagcagagcaagactgtgtctcaaataaataagtaagtaagtaagtaaatatcctgtaggtatctatgtgactcaaggctagtcactttcctatctatgctccagttttctcatatttgagacaagagacttgattttagcataaaggtgagagttgaagtaatgagtgtgaaagaggaaagggagaaaacatacagagaagagcagaaaacacaagcagctggtaggcagagaatgcagaaattcaagttagagctgttggaagatgtggtaggctgactaatggtgccccaaaaatgtctaagtcctaatccccagaacatgtaaatatgttaccttacagggtaaaagagactttggggatatgattaatttaaggatcttgagataaggagattagcctggattatccaggtgagcccaatataatcacaagcatccatataagacaggcaagagagcagaatcagaataggagatgtgatgaaggaagcaagagattgcagggattccaggaaggttctgtgagccaaggaatgcaggtggaccctagaagctgaaaaaggcaaggaagtggattcttctctcagagcctccacataaggaaccagccctgccagcaatttgacaactcagcccaatgagactgatttcagactttttttttttttttttgagactgaattttgctcttgacccctaggctggagtgcagtggcacaatcttggctcactacaacctccgctgcccgggatcaagcgattctcctgcctcagcctccttattagctgggattacaggcgcccaccaccacaaccagctaatttttgtatttttagtagagacgtggttttgccttgttggccaggctggtctcaaactcctgacttcaggtgatccacccgccttggcctcccaaggattacaggtgtgagccactggggattacagttgtgagccactgcatctggccatgattcagacttctgacctccagaatgctatgataataaatttgtgttgttttaagcaactaagtttatggtaatttgttatagcagcaataggaaactaatacagagaagaaccgacaaacagtgatattgaggtatttcaaggaatggatggtaaataatgtaaaaggaaattgaggagaaggcctgtaaaaagactgttggatttggtcatttaaactttgaaagagcactttcagtagagatatttttgaagacttttgtggaggttatatgaagtttttttttgcattaaggataacttgtctttctgttgacttttgggagaaaaaatatagattttccatcaatataattgtaatttaaatgagggcccaaaatatgtggcaagacactttaaaagctgaattctggctagttcaggtggtttcattattcatcagttaagaatattttaggatattaaacctgataataggggcaagaaagttatgtccctattactgatggctgcttatctagtttattttacttctcagtctagtttggcccatttcccactcattagcacttccactggaaggcagccttgggggaacagtgatagggaggttagtaccaataaacagttttttctgccattctcttacatttatttcttgagtgtctactgtgtatctgattctgtgctgcttgttacttttacttagcagtagatacaatttagaaactaacttgaattttgggattggtctccagaatagttggttactattataacttataataggaaattggctacataaccgatttctgttctagcattctggctcttgaggagtgtcaggggagtactatatttatcagtatttgagactattttatgcttatggaggagaattacatatatatcttctctaagatggtgaaatatggaggtttgggatgtctaataaatctttaatggttcaacatagtaataataaatccagattaagaccttggcccagaatgtcatataggacaaggaattgaagcctcatttggattgctaattgagtgcttgcccaatttgttgatgttgtttttgtctgtgaatatgttggggtttttcctgcttttgaagtgtcatttaaaaaaattgtttcttctgatcttagattgtaaccagtttgagtaaaatttgggggcttaaagttttatcaggcatgcagagtttatgtttgtttcatgaggcaattcaattgaaaaactgaagctttgcccaggcgcggtggctcacgcctgtaatcccagcactttgggaggccaaggcaggcagatcacgaggtcaggagattgagaccatcctggctaacacggtgaaaccctgtctctactaaatatacaaaaaattagccgggcgtggtcgcacgcgcctgttgtcccagctactcgggagactgaggcaggagaatcacttgaacccgggaggtggaggttgcagtgagccaaggtggcaccactgcactccagcctgggtgacagagcgagactccgtctcaaaaaaaaaaaaaaaaactgaaacttgagttttcagtattggaaattgacttgcatgtggtttttaatgaaatattctacttcattatagttatggaataggtttatacaaaaatttagagatgattttatatttagtatacttaaatgttatgacacagtgataatctgttagaatattaatctaatgcaaatttggggaatattttatggtgccatgctctaaatattcatgatatatctggcatgatatatgtatctggtttttctgtattaattattggtctagtgactctcttttaagcattttattatggaatatttcaaaatagaagatacaaaagtagagagaatggtataatgaattctcaaaagtgatcaacttatggccaatcttgtttcatttatagatcctcatctccagtatactggattattttatagccaatcctagatatcacataatttttttttttcttttgagatggaatttcactcttgttgcccaggctggagtgcagtggtgcgatcttggcccactgcaacctccacctcccagggtgtctcagcctcccaagtagctgggattagaggcatgtgcccccacgcccggctaattttgtatttttagtagagacaggatttcacatgttggccaggctggtctcaaatgaactcctgacctcaggtgatccacctgcctcagcctcccaaagttttgggattacagtcatgagccaccgtgcccagcttatattttatttgtaaatatttcgatatatatctctagaacgtagaaatttaaattaaaaaaaaatcagctgggcgtggtggctcatgcctataatcctagcactgggaggccaaggcaggtgaatcaccggaggtcaggagtttgagaccagcctagccaacatggtgaaaccctgtctccactaaaaatacgaaaaattagccaggcgtggtggcgtgtgtctgtaatcccagctactggcggtggggggtgggggtggggggcggtgctaaggcaggagaatcacttgaatccgggaggcggagcttgcagtgagctgagatctcgccactgcactccagcctgggtgacagagtgagactctgtctcaaacaaaaacaaaaacaaaaacaaatttcattggcacacctaaaagtcaaaatcttgtttcttaaaattatattttagtagtgtttaagtttccctgattgttcacaggtgtgtgtgtgtgtgttttaacagttggtttattcaagtcatgattcaaataaggtctgttttgattgatacgtattttaatctatggtttcctcctcattttttttctcttaccttatttgttgaaaacctgggttgtttgtactttagagtttctctacaacctagatttttctgactgcttgcttgtggtgttaaggtgttcttttgtcccacgtgttttctataaactagtaattagagattaggtctgattcagattccaattttttggtaagagtacatcataagtggtggtatgtacttccatgagaaggcaaataatgtcaggttatctctctttgtgatttagtggccattgatggcctgcaaaaattttgaagtttcaagccagtcttgactagacctgaattccattaattagtgaattattctaattatcatcacatcacaagaagctccttgtattgcgcttctaattgggttaccagtgatcagcttaaaaaatgtaaattggccgggtgcagtggcttacacctgtaatcacagcactttgggaggccgaggtgggaggatcacctgaggtcaggtgttcgagaccagcctgccaaacatggtgaaaccctgtttctaccaaaaataaaaaatttagctggggctggtggtggacacctgtaatcccagctacttgggaggctgaggcaggagaatcgcttgtacctgggaggtagaggttgcagtgagccgagattgcaccattgcactccagcctgggcaacaagagtgaaactccgtctcaaaaaaaaaaaaaagtaaattgtgaataaaatagttaacataggtttagtgtattgactgttgcaaggcttgacaaggtgcctaatgttgagattagtagtacccttcgtatgtaaatattttccgtgattggcagtggagtaaactttttctactgtcatttcatatctttaccattagctcttttttttttttttttgagacggagtcttgctctgtcacccaggctagaagacagtggcgcgatctcggctcactgcaagctccaccttctgggttcatgccattctcctgcctcagcctcctgagtagctgggactacaggtgcccgccaccacacctggctaatttttttgtatttttttagtagagacgaggtttcaccgtgttagccagaatggtctcgatctcctgaccttgtgatccgcccgcctcggcctcccaaagtgttgggattacagttgtgagctaccgctcccggcctccattaactcttaactgaagttccctatattagtctgtttttgttgctataaaggaatacgtgagactaggtaatttataaagaaaagaggtttaattggctcacagtactgcaggctatacaggaagcatgaggccagcatctgctcatggtgagggcctcgggaagcttacagtcatgcaaaaggcaaaggggaagcaggtgcatcacatagagcaggagaaagagagagaggtgggaggtaccatactcttttaaacaatcagatctcctgtgaagagaagaactcactcattgccatggaaaggacaccatgccatttatgagggagctgcccttgtaatccacacatttcccaccaggccccacttccaaaattggggatcacatttcaacatgaaatttggagggcacaaatatccaaaccatatcattccccttattttgaaatattgttcagaattccagttcagtaatatggtttcttattccctaagtcaactgccagcccttgaggtccattatgaaagaaaacttcaaagggaacgctccaaagaaaactaaaaaaaaaatagtaacttggcggtgcaaggagaagaaagagacctgctttataagagataggaagagtgtccattctagctacatcagttttgggcagtcaactgtgggcaaatgatgtgcttgtcttagaaaatggaagtgacattggggcattcatatggagattgggttgattggctggcttttgttgtgctctttgaggcctaagagaaattggcccttctaattgaatgtgaatttcacagtgggatgtatggttttatgaactgttttatttatatgcgggcatttcaggggaggcagattactttttttttttttcctgcttcttggcaacatttttgccaggtttctttttttagttagtgatttttattttttttaaagttggttggtctagcgatgaaatgtgacgttaaaatgccaaaacagattgtgtttgggtcctgtggatgcagcttcactgttttgtaattattcctcttgtattgattttcctccccatgtttaaattgttcctccttgacagtagatagcatgaaaaatgaggtcaaaagaataactcacctcattataaatcactaggggtaatggaaagtgattctgaaggatgaccaggattccttccatctgttaagaatcatttcacctgttgaagagttcctacagcacaaggactctagtggtgagccgcatccattccaacttcacaattgccgtacagggctagtattaggagaatttgactgctagaactctaagtgcttaacaggtattttttaaagcaggcaacatctttatcattggcaccagttttcagttgagagtggagactgccttgcttcagctctgtgtgtgctatagccagttcatgacagaatcagcaaggcccagggtttttgttttttttttttgtaataaggaaataactttgaaaaattaaaattataaatttaatttttctgctcattacctaaattattgcaagaagattatcttcatttttcttaatatcaagataaatgttctgtcctgtctctataatgcacttctgtagtttgaatgtttatttatttatttatttatttatgtttgagacagagtttccctctgttgcccaggctggagtgcaatggcacgatcttggctcactgcaacttctgcctactgggctcaggtgattcttgtgcctcagccccctgagtagctgggactacaggcatgcaccatcatgcccagctgattattgtattgttattggagatggggtttcgccatgttgatcaggctggtctggaactcctggactcaagtgatccacccatcttggcctcccaaagtgctgggattgcaggcatgagccaccatatccagcctgtagtttgaatctttaaacagtcaaatgatctgttattaattttggggggcacatttgtattgagcacttcctggatgccagatgctgttgtatactgggatacaaacatggcatacaactgtgtcttgctctcaggcatcccacagttactgacaaactcataattttaaagatctattctggtctatattgcttgtacttcatgttgattccatttcctattaatctgttcatagtaaaagtggagaaaagggtattgatcattatctacacatttacctttgtatgttttaagataatcaagaccttgtcattagccttctctaataaggataaacatgtgcattctttaatttagtttccaaatcattaatcgttttgtctatctctcctgggaatttctagttccctttgggtcccctggctctgtgagaagagactgtaatgtcttcagctctggggaccaccactagggtgaaagactattataggaccacttgaaagtacagagttgcaggactgtcagatatgcgtttgttttattagaagattatgaagttccaggatattatagcaaaaagaacattagaggacaccatttgacccacctgtgccattttattttattctatttatttatttagagacagagtctcctgtttgttgcccaggctggagtgcagtggtgcgatcttggctcactgcagcctctgccttagggttcaagtgattctcctgcctcagcctcccaagtagctgggactacaggcacacgccaccatgcccagctaatttttgtatttttagtagagacgggtttcaccatattggccaggctggtctcgaactcctgtcatcaagtgatatgcctgccttggcctcccaaagtgctgggattacaggtgtgagccaccatgcctggcccattttattaatacaaatgagaaatatgaggcctagaaaaaagctaaaggaataccttaagcatggtacagaaataagatataatgaaatgttctatttatcaaacttctgcttgatattcttttctgtctatggaaatgtagttatttgcaaattattagtactttgagaagaagcaaaatgtgctctaaattcttttgaagaacttttgaagaaggatgataccttatagttgtattcctctttcaaaaacttcaaagtaatagaaacatcaggggtcattattcatgttccaagataactaatctaaggattctattaagaattggttttacatttgacttattcatctctatatgtatctactactaagcaacatgataacattgcaaggtcttactctgtcacccaggtaagagagcagcggctcaatcatggctcactacagccttgacttcctgggctcaagcattcctcctgcctcattttttaattttttaattaatttatttatttttatttatttattttttttgagacggagtcttgctctgtcacccaggctggagtgcagtggcatgatctcggctcactgcaagctccgcctcctgggttcacgccattctcctgtttcagcctcccgagtagctgggactacaggcgcccgccaccatgctcggctaagtttttgtatttttagtagagacggggtttcactgtgttagccaggatgatctcgatctcctgacctcgtgatgggcccgcctcggcctcccaaagtgctgggattacaggcgtgagccacggcgcccggcctcattttaaaattttttgtagagatgtggtctcactgtgttgcccaggcaggtcttgaactcctgggctcaagcagtccttccacctcagcctcccaaagtgctgggattgcaggcatgagctaccgcacccagccagcaaaattttttaaaacaaaaaacaattagtacaaataccaccctaacatattaattggttttttttcctttgttcttcctcaggctgtcttagcttttgcaaatattttaacatagttgaactcatggtatgttaaaattaccataagtactgtggccagctttagtggctcatgcttgtaattccagcaccttgggatgccaaggcgagaggatcacttgaggccaggagtttgagaccagcctgggcatttttagagacagggaaatcctaagtctaaaaaaaaaagccaattgtggtcgcctgcagttgtggctactcaggaggctgaggcaggaagattgcttgtgccagggtggttgagccaagattacaccactgcattccagactaggcaacagagtgagacagtctctaaaaaagaaaaaaaaaaagtaatttttactgagtgctgctttataccaagtgttgctatgcattttgctttttaaaaattatctttacatcaacagctctaccaaataggtggtttattccacttaatgatgaggaagaagaatcaaagaaggtaatttgtcctaacctagggatcacacgtcatgctggtatttaaattcacatctgtctgactcagaagcttttagtcttctacctaggttgtgctggttttctgaaatcctggctcacctctccatttagacctctttatttttttaaaagcctcttagcacctgtaatgacagcactttgggaggctgaggtgggcggattgcttgatcttagcctgggcaacatagcaaaaccccatctctacaaaaatacaaaaattagctgggcatggtggcatacctctgtagtcccagctactcaggaggctaaggcgggaggattacctgagcctgggagtttcgggctgcaatgaactatgattgcaccgctgcactccagcctgggtgaccgagcaagaccctgtccctccactcccgcccccccacaaaaaaacctcttagagacatagttttatagagataggattcttttagcattccattactactgagatttttatattatcagaattctgcacctactcagtgtgaagtaatagctaaagcattgttttcctacctccttcatgtcatggtatacacagaagacgacatttgtgtaagacccctggtaaactagagaatatttgcaaatttggtataaaaattcattgttgctgggtgtggtggctcatgcctgtaatcccagcactttgggaggctgaggcgggcagatcacttgaggtcaggagtccgagaccagcttggccaacatggcgaagctccgtctctactaaaaatacaaaaattagccaagcatggtggcacatgcctgtaatcccagctactcgggaggctgaggcaggagaattgcttgaactgggaggcggaggttgcagtgagccaagaacgcaccactgcactccagcctgggagacagagcgagactccatctcaaaaaaaaaaaaaaaaaaaaaaaatcagttgtgttttcttaatacagtaatgataacaaaatacattaaaaatcagacattgagcaacagaataaaaatgtatgaatattaaataaatagactaagaaactacaaaattatgttttatttaggaacacctaataataccagatgtattaataatgatgatgttgattataatgcttttgatgacaaacatacatttagaaattgtggtgctattagagcaaattaaatagaaaacttcatttacatatgggtgcaaaacgtagaacctcactgattgttaaacaatgtagactaaaataaaaatatagactaaaatgattcaacaggaagatcaagagaaggggctatttcatggagtcactgtactgtgccatgtgcatagttttatgtaccaaaactatggtacttaagtggttccatatagtgaagtcatgtgcatagttttctgtaccaaaattataattaggaagtttatgtagagaactatatgaattaaatataactttacccatcctgaatttttagttggttgcaaaacatttttaatacaatacaaaattttattcagaagatctttacattacactacttataagccattttagaacaataaatgattgggaagatctgatataaagccttttagctctaacgtattgatagtaagcattcagtaaatattgagtattgttatgtttagttagtaaagcaaagtggttaagattatgagctttggaatcagacatagttggtttctaatcctggttttgctacttacataagctttatgtaagctgtctgtgcacagtgccttattcttagtaggcatttaggtgattttcttttagactaagatgaggataaaaatctttagtgagtcttaccgtgacctaccagacactgtatcatctgatcccccattagctctcagtacttgtctttcccttgttcaacccattccagtcacattagtgtcctccttgtttctcaaaaactccagttgctaggaatagatgcttaagggcctcacatctgtttttccttctgcctggaatgctattccatcagctacacacatggcttgcaaatgtcacctttgtagtgaagcacttccaggccatgatatctaaaaatttcagatgaactttcctcaccttctcatttttttaaattgaggtaaattttacatatagtaaaatgcatagaacttaaatctacagtttgatgggttttgacaacgtatacaaccatgtaaccaatatggtttggatatctgtcccccgcaaatctcatgttgagatgtaatctgcaatgttggaggtgggacctggtgggaagtgtgtgggtcatacgggagggtccctcatggtttggtgctgttctcaagatagtgagtgcagtctcaggagatctgttttttttttgtttttttgtttttagagacggagttttgctcttgttgcccaagctggagtgcagtggtgtgatctcagctcactgcaacctccgcctcccaggttcaagcgattctcctgcctcagtttcccgagtagctgggattataggcgcctgccaccacacccggctaattttttgtatttttagtagaaacagggtttcaccatgttggccaggctgatgttgaactcctgacctcaggtgatctgcctccctcggcctcccaaagtgctgggattacaggtgtgagccactgcgcccggccaagatctggtcatttaaaagtgtctggcactgccccccgcaaccttgctcccattctcgccctgtgatgtgcttgctccgcttcgccctccactgtgagtaaaagctccctgaggcctccccaggagccaagcagatgtcagtgccatgcttgtgcagcctgcagaattgtgaaacaattaaatctctttttttaataaactagtcagcctcaggtatttctttatagcaacacaagaatagcctaatatggtaaccatcacccaaatcaagaaataggacatttttgcctcctttgaaagttctacccaccaccccttcatcctcccccaggctaccactgttataatttctatcattctagaattagtgttggctgtatttttctttttttttttcaagaaatattaactattctttatttgatatatataagccatataaaatgccttttaataagttaaaagaaccattttattttgagatggggtcttactgtgtcacacaggatgggttgcaatggcaggatcatggctcactgcaaccttgactcctgggcccaagccatccttccacctcagcctcctgagtagctacgactacaggaatgcaccaccatgcctggctatttttaatttttgtacagatgaggtctctctatgtggtccaacttgtggcctcaagcaatcctcccacttcagccccaaaaaagtattgtgattacaggcatgagccactatgcccagccaaggaaccattttagacacagagaattctaattaaattgacatagttaagaccagaaatataaagtagacattgttaccttatctttagtctttgcctttaagaggcacgtgaacgcagaacacaggtgggtcttgcttggttctgagacagtgaagacatttccccagtatttaaatatattcatatagctagttatataaatctaaatataaagccaatctctaataggttttaagatggcattcaccatctttgtgaaaagttgaacactacgaattaagtccaatcatagttttagaagggggaaacagtgataccatttactgaatcagaattactgttaaaattttaaaaaacccaaatgtattcatttaaccacaagcgagtcttaattaaatcaggactgctcaacaaaaatattctgtgagttattcatgatttgaattctgatgtatattagagagctattaaattatgtacacataaaaaagtcatgtggtcaattattactgattattagcttttctgagataagctatcaagtctgccctttctgccttcttcttagtgctgacaatggtcatttttgttccagggatgtacttcttgggattctgcaaatactccatcagtgtctcctctcctcaggtgatgcctttgttctcattggcgtctgtgagagaattcagtggcctgacctgtcttctgcataaatagaccatggagatttggctcactcttgtacttgcctcgctttaccatggtgtggcattgggcacactttttttttttttaagacaagttctggctccatcatccaggctggagtgcagtggcacgatcttggctcactgcaacctctgcctcctgggctcaagccatcctcccacctcagccacccgagtagctggggctacaggcatgcaccaccatacccggctaatttttgtattttttatcaagatggggtttcaccatgttgtccaggctagtcatgaactgctgggcccaagtaatctgcccacctcacctcccaaagtactgggactacaggcgtaaactaccatgcccggccttgggcacacttctgaacaaaactcttcttgcctttctcaacatcacccatatttaattctgtctctcatcactggtactacgaacttcctgttcagaagccggacatcccactctttcagttttagctgttttaaaaggaatatagaatatgtaccttttaaagtttggtttcttcaactgaacataatgtttttgagatttattcatttttcacgtatccatagtttattgttttttatggctgagtagtattccattgtgtgagtattccaaaattagtttattcttctgattattgacatttgagttatttccttttttttgctattatgaataaagatgataaagatgctgtgagtagtctacaaatctttttgtagacatattgtttttatttctcttgggtaaatacctgagaatgaaattgctgggttatagagtatataattttttttttttgagatggagtcttactctgtcactaggctggagtgcagtggcacgatctcagctcactgcaacctccgcctcccgggttcaagcgattctcctgcctcagcctccctagtagctgggattacaggcgcctgccaccacacccaactaattttttgtacttttagtagaggcaaggtttcactatgttggccaggctggtctcgaactactgacctcaggtgatccacctgcctcagcctcctaaagtgctgggattacaggcatcagccatcgtgcccggctgagaatgtaaaatcttagctttattagcaacttgctgttttctgatgtggttgtaccattttatactacccctagcaatgaattagaattctgtttgctccacatctttgttgatatctgatattgtcattttttttgaacacgagttccatttgctccacatcttttttttttttttttttttttgagatagagtctctctctgtctcactctgccactcaggctggagtgcattggcttgatcacggctcactgcagcctcaatcttccaggctcatgcctttctgccacctcagccttccaaatagctgggactacaggtgtgcaccaccacacccagctattttttttttttttttttttgtagagacagagtcctgctatgttgctcaggctggtctcaaactcctgggctcaagcgatcctcctactttagcctcccaaagtgctgggattacaggcgtgagccactgtgcccagcctacatctttgttgatatttaatattgtcagtgcatttttttccttttctttttaatattagccattgtttgtatagtgttatttcattttggttttaatttacacttctgcaatgactagtgatgttcagcaccttttcgcatatttattcattatttggagtgtgtgtgtgtgtgtgtgtctgatttcagtcttttgtacattaaatttgctttttgttttttattattgatttgtaggcattcttgatgttttctggatataagtccttggtcagataaatatattatagatattttaccctggtctatgccttgtttctttacgttcttgttttgttttgaataaactttttatttagaagtgatttaagatttacaaaaaagttgcaaagatagtttagagagagagtatttgtatacccttcacccagctttcctgaatgttaacattttacataaacatggtgcgttattcaaaagaagtttttttgttgttatgttgatattctggatgccatttccttcattatagtttcttttttttttttttttttttttggagacggagtatcgctctgttgccctctgcactctgctggagtgcagcggcatgatctcagctcactgcaacctctgcctcccaggttcaagtgattctcctgcctcagcctcccgagtagctgggattacaggcacgtgccaccacatctggctaatttttgtatttttgtagagactggatttcaccatgttggccaggctggtcttgaactcctgacctcaggtgatctacccacctcggcctcccaaagtgttgggattataggcgtgagccactgcgcccagccccttcattatattttccaatcagtttttcttatattataaaagtaatttttggccggttccagtggctcttatctgtaatcttagcactttgggaagctgaagtgggtggattgcttgaatccaggagttcaagaccagcctgggcaacaaagcaagaccccatctctagaaaaaatacaaaaattagccaggtatggtggtgcgtgcggatagttccagctactcaggagtccgaggagggaagatggcttgagcctgtgaggcagaggctgcagtgagctgagatcaacactaaacttcagcctgggtgacagagtgagaccctgtctcaaaaaaaaaaaataaataaagcaattttgcctggacaaggtggctcacacctgtaatctcagcactttgggaggctgggcaacatagagaaaccccatctctacaaaaaaacaaacaaaaaaatagctgggcatggtggcatatgcctgtggtcccagctacttgggaggctgaggtaggaggaccacttgggcctgggaattcaggtctatagtgaactgtgattgtgctgctgcacttcagcctgggcaacagagtgagactctgtctcaaaataaaaaaaaataaaaaagtaaaaaataaaagaaaaaagaaaagcagtttttaaaaagtagtagtagtatttatttgattttcttactgaactatgttgttggctttctcaaattctggatttttcagttatatattagcatctgttaatcctgatgataatttcttttttttttgtaagatggagtcttgctctgtcacccaggctggagtacactggcactatcttggctcgcagcaaccttcgcctccctggttcaagtgattctcatgcctcagcctcctgagtagctgggactacaggcgcacaccaccacgcctggctaattttttgtatttttggtagagatggggtttcaccatgttggccaggctggtcttgaactcctgacctcaagtgatcctccctcctcagcctcccaaagtgctgggattacaggtgtgagccaccgcacctggccactgataatttctttttggttttgccccaaaggtttaaatctttgacactataaagtttttaattttgatggtgtctaatttctctaatttttcagagaaaaatttgagaattttgttgcttctacttttagtgttgtatctaagaaactattgcctcttcccaagtcacaaagatttacacctatgttttctcttagagttgtgtagttttagctcttacacttgggtctttgatacattttgagttaatttttatatatggtgtgagctaggggggtccatctttattcttttgcatgtggatatccagttgtcccagcaccattgttgaaaagacccttatgccttcctttttttattgtcaggtcttcatttttaaccagaacatttagaacactattaataattgtgacagaagatatctttgttttttttttcctttaacgagaatgtcactagtgtttctactagaaatatgatgtttagtttccagtagcttctttgattaaggaattttcttatttctagtttatgaaggtttaaaaaaatcccctttttattgcaaaatttaacacacagaaaagtgtacataaaacacaaatgtataacttaatagatttttgtaaagcagaggtttgagttaccaccaccttggtcaagaaataaaatattatttctaatggtcaagaaataaaatattatttctaatggtcaagaaggtatattaattttttgatacccttgattataaaaccgttaataaccctgggaaatttaaaaggattattgggatgatgtctcacatagtatgctttaaaagtgacagttatcagctgtagctttaactgaggcactgaggctgccattattttacattttctcctgagctttataactatatatccaactggattctcattatctttccttgaaggcttttaggtacctcagactcaacatattttatatgaactgcttctcctctgtttactatctcagtaaagggcacctccctttacccagtcattatgccagaaacctaggtaacatctgtgattccttgtttttcttatttgttcaataatgtttatacagcagttaactatgtgctagatacctagcactgtgaatatagtagggaataaaagagacatggacctctcatgctggtcctctcatgaggttgtagtcaccaaatcctgtggatcatacctcctatatgttaatcaaatccatctgctttcatttgtctctctcttttttttttttttttttttttgagacggagtctcactctgtcacccaggctggagtgcagtggcgcaatctcggctcacttgcaacctccgcctcccaggttcaagcaattctcctgcctcagcctcctgagtagctggggctacaggtgcatgccgccacgcccagctaatttttttgtagttttagtagagacagggtttcaccatgttgcccaggctggcctcgaactcctaatctcaggcagtctgcccgcctggtctcgaactcctgagctcaggcaatccgcccgcctctgcctccgcctcccaaagtgctaggattacaggcgtgagccaccgtgccctgcctcatccactttagtccaagtcattgtctctcacctgggttacagaaacagtctgctgaatgatttccatgcttctattcttctttctccaactattttcttcttttctttttttctttagacagaggctcgttctgtcgcccaggccgaagtgagatggtgcgatctcagctcactgcaaccttcgcctcctgggttcaagcgattctcatgcctcagcctcccgagtagctgggattacaggcatgtgccaccacgcccggctaattttttgtatttttagtagagatgggctttcaccatgttggtcaggctgatttcaaactcctgacctcaagtgatctgcctgcctcggcctcccaaagtgctaggattacaggcgtgagccactgcatctggcctctcaaactattttctatgcttcagccaggaaaacctgaatatttcacacctttcttaaaatctttcagtggttgtcattgccctgttctctagtctcacttcttgttgttcccgtttttgaattctatgcttcagccacactgatcatttttcactttctcaattatgtcattttctcatctcctagtcttaatacatttccttctcctacttccacaatccttattgtctctcttctttgactaccaattttacaggtctcaggttcaacatcagtgcctctaaggagcctcccatggcataacctatactgtgttttccctttatatcttttccttgtgtttttaagagatagggttctcactatgttgtgcagtggtgtaatcatagctcactgtaacttcaaactgctgggctcaagggatcctcccaagtagataggtctacaggtgtgtgccaccatgctcgagtaattttttaatctttattttgtagagacaaggtctcacggtattgcccaggctggtctcaaatgcctggcctcaagcagtcctccccctcagactcccaaaatgctggcatgagccatggcatcccgcccccactttgtttcttatagcttacctgtcataacacttgtcatatagtcttatagtttaatttgtcatatattcttatggtcaatacactttaggctctgggaagggagggagtgtgcctaacttattcactgttatgttaattgcatctatggcagtatctattaagtcttaggcattgggaataaagatttgttcaatgaatgaactgagcagaggaagggggtggtggcaagaaaagagcagtgaggtgttccagttgataatttaataagaataatcagagttggaataatcagaatttgtatttcaaaccttataacttcctttgcttaaaaatatttgattttctttcttaataattcttgttttaggtttttttttattagttaaactttggttggttagggcttaacagggaattaggaatttgatagcatgttcttacatcttttaaagaccaagagaactagaaggagagcataaaccaggattttagatgctaaaaatattacagaatttagatccttgaccttcagggagtgtatcaatgtgaggagtgcaactgttaggaataagtgccttggatgttgaaagttcttgcaaaatttagacaatttgctgtgtcataggtattgaatcagctggaagcaaactgaaagtataaattgaatggatggatagaaacgtgagtggtagtaagaataaaacaaactaaattttaaaaacagtttagggattggtatgaaaatacaatcttatatataaagattgcatccttttataagttgtatgtggattaaataaaattagtcttaatcatttatttgatgtaaaaattaccctggaagttgttatttgtagtaaaggaatatgggaaggattattaaagttttttcaatataatataaatattaaataataggatagtgcactaaccagagttcatcagagacaatttttttcaaccttatacctttttattctttttgaatgctgggaggtgaatcttttacaccaagcttgtccaacctatggcccctgaggccacgtgcggcccaggacagctttgaatgtgacccaacacaaattcataaactttcttaaaacattatgagatttttttggcttttttgttttgtttgtgctcatcagccatcattagtattagtgtgttttatgtgtagcccaggacgattcttccaatgtggcccaaggaagccaaaagattggatacccctgttaacaccatttggtgagctaagacatggtgtcatgaaaacagtaacaactagctgtttaaggcgggataattatggaatgaatacactggctaattagtgtagatgttctgagaagatagaggttactttcaattgggaaaggcatggttcctggcaggttgggtatctcgtaactgcttattaaataaacgggttgaatattttggagtagtaatgtgagaagggtagtatctttttttttttttcgctctgtcgcccaggctggagttcagtggcgtgatctcgactcactgcaagctccgcctcccgggttcatgccattctcctgcctcagcctccctagcagctgggactacaagcgcccgccaccacgcccggctaattttttgtattttgttagtagagacggggtttcaccgtgttagccaggatggtctcgatctcccgacaccatgatccgcccgcctcggcctcccaaagtgctgggattacaggcgtgagccaccgtgcccggcgagaagggtagtattttaagtgattaatttgataagactgtgttggatggattgattggaggaaggagggatgagttaagatgtacagtagcttattagcctctagggcaatagtgaaaggcatctaagagaacagtaaagtaagatgtgaataggcatttaagaaaaataaaggatgttgagacttactgattatggggagcaggagaaagaaaggtcaaagacaggtgtttttttttttttttttttttttttttgagacggagtctcgctgttgcccaggctggagtgcagtggcgcgatctcggctcactgcaggctccgcccccgggttcacgccattctcctgcctcagcctcccgagtagctgggactacaggcgcccgccacctcgcccggctaattttttgtatttttagtagagacggggtttcaccgtgttagccaggatgatctcgatctcctgacctcgtgatccgcccgcctcagcctcccaaagtactgggattacaggcgtgagccaccgcgcccagccaaagacagttttaagattttgagaatactgatatttcacaaatatttattaagcatccgttctgtgctctcttcttcttttccttaaaatgcctcaagttgtcttcattctttttttttttttttttttttggtctttattcttaaaaatggccaccaaaagaactttctttcagtcttacctgtcttgcaaaccactgacccatctctttcctttctcttcaaattctccttaaggagtagtgtaaacccactctgctactttgctccattatgctgaaactgctttctcaaaggtcatcgcagacttcctaaatgccacgccttatcatccttctaattctttttttgttgttgttttgggacagagtcttgctctgtcacctaggttggagtgcaatggtgcgttctcagcttactgcaacctctgcctctcaagttcaagcgattctcctgcctcagcctcctgagtagctgggattacaggcatgtgccaccacgcccggctaatttttgtatttttagtagagatggggtttcaccatgttggccaggctggtctccaactcctgacctggtgatccgcccacctcggcttcccaaagtgctgggattataggcatgagccatcgcgcccggccatttttctagttcttatccttttggagcattttataacgttttatctacttgatctccatatgaattaaaacgcttattctttggcttccaaaacaatgctttttttcccctcagatcctcttcttacctcctgaatcactcttctgctcacgattcctcttccattgcccactctttgcccagatttctaccccaacccactttctctatattctttcgtctttgtaaccttacccactcccatggcctcatccctcattatgtactaatgatgtcgagatctgtctgaccctgacctgtttagacttgacttttttcctggactcaagatatgcatttccagctgcccattagacatcttgatgtagatgtcttacaggtttctctcggtctcagtatttccagagcaaaattgttctcatcctatcacaaaatttgttgctcctcctgttttctcttcttgaaaagaaatatcatcagccactcagtcatttaagtcattgattcccaattgactgcatgagaatcacctgggggcacatgttaacaatagaggctgctgaactgtatcctccaaagagcctgattcattaggtctatggtaggacccaggaatcttttattctgatgcttatccaagtttggaaatcactgatgaaaactgatttgctccctccgtccccatctccaccgtctactgagttaccaggacttgtcagttctatctgtgtaatgtctcataactctgtcttcttgtctccatttacactgctagtattctagttgagactgtcatctttatgggaacttgtaggtacatagtaggtatttttaaaattcttgttgaataaatgaatgcatgattgccatagtctgccataggtctattttttcccctaatttcacatctttacagtctatttctaatagtaccttgttatttttaaaataccaatctaatgatataacttttctttaaaaaacaatccatcattggctttcgagcttggttatacatcagaatactcattaaatgcagattctgtctgtttaagaatgaggacaattaaagaaaaatacagatgcctgagccccaactctggaaatttcaatttagtagatctggagtacagcacaggaatctgtatttttaccaggtatcccagagattctgatgcaattttgcattttgaagccattcacatgcagagtaaaaacgcatataaaatgctttcaacctgtcttaccagtttttttccctaccattcctcaacctcattcacataccttctcatttgttatttgccatctcctgagcactccatgaactttttgttcataccgttctctttgcttaactgctcctgctccccttctatgcctcgtaaaaccctcctaatcacttcaaggcttggctcaggtgtcacctcctctgtgaagttctaccctgtcaggatttattcatccttccttcttgttctcatgatacgttgttgctggtttagcaaaccacaggtgatattatcttacacaaacaacaagttgttctgtggcaggcagaagactcaggaggtgaaggagtttcattatttacctagagtttccagcccagggctgctgttgccctagtggagagttttataaaatggttttgatatgacctgtgagtaaagaagaaaatgtgtttgaaacaatttctgtgaacatgatttgaactttgggttattgtatttgtttcttatccattttagagtgaatgttcaagctgtatacccacctcttcccctgagagtagagccctgaagctttatattctcaacaccccccccattccttggctctgtcttctcagtgtcaatagataccttctctcttcttcgctgttgcctgctttggttacagattccagagcttttcctgacttttctggtaaattattactctgaacttgagtgtatccctttgaagatctcctgtgcttgtaccaaacaaatgattgtgtatatgccttttgaattcttcatatttgagtcatgctctgttctaacacttgaagtattaaaatctcaagtatctatagtgtagtctttgaaagtcactgtcttttgatcaagtgttcatgcggttgttagggtaattaattggattgcactgatagtgctagaatttataaagcaattacttcctttactaatgactacccacgttctctttcttattcatagatgctctctcttattgacgtgtacataaattgtatctcaatagcattccgggatttttatacatatacatttctcatataaatgtgtctgtattcccttgcacacacacattccatacatacatatgtgtacatacatacgtacttttcagattattgaaatccccaaaggacctcaaggttatttggaattattcagtgtaagaacaataactctatttcttctctgaatttcagtgggggcaagagtccctagtgattatctatcttacccttagagaaaaaggaagaaaagggaaagaaaaaaaaggaccttttggtttgacctgatctagatatctgagtatttttcctttgtattgatgagcgtgggagtggttttgatgagctttggggtgtgtgtgtgtgtgtgtgtgtgtgtgtgtgtgtgtgtgtatcatccctcaactgcctcctccagcctaggccaagactactcatggagcagtcctttctagacaggtaactgctcatcctggctttcaattatgacataggaaaatttccatcagtgtttttcctaagctaatagggacccacatctagctactggcatattcaactctaagagcttttagaccagcttgaagactgtccaagaaggaaagtcagtattgcattttccatggcttctgggaatggcctaaggaaaggatatctacaaataattccaaatccttcctttatggtatctgttaatacgtagcatgttaatattagaattttacctttgtcctttctcctaaccttctcatggactagtgagtagcataaagtccagaattattagggcaacagtaagttagtaagagaaacaaagggctggaaggatctgtaaaccaacaattgtagaacaattgacccaaccattccattagtgggtgtatacccaaaggattataaatcatgctgctgtaaagacacatgcacgcgtatgtttattgcagcactattcacaatagcaaagacgtggaaccaacccaaatgtccaacaatgatagactggattaagaaaatgtggcacatatacaccatggaatactatgcagccataaaaaatgatgagttcatgtcctttgtagggacatggatgaagctggaaaccatcattctgagcaaactgtggcaaggacaaaaaaccaaacatcgcatgttctccctcataggtgggaattgaacaatgagaacacttggacactggaagggggacatcacacactggggcctgttgtggagtggggggaggggggagggatagcattaggagatatacctaatggaaatgatgagttaatgggtgcagtacgccaacatggcacatgtatacatatgtaacaaacctgcacgttgtgcacatgtaccctagaacttaaagtataataaaaaaaatatatatataaaagaaaaagaaaaaaacccactttatttaaaaaataaaaataaaaaggcaaaaaaaaaaaagaaacaaatctccaacttggaaagtttggaaaacaaagcaccttaagttagaggaaatgaatttctttgagagctttaaaaaaattgactgtggctgggcatggtggctcacgcttgtaatcccagcactttgggaggctgaggggggtggatcatttgaagccaggagttcaagaccagcctgggcaacatggcaaaaccctgtctctactaaaaataaaaaaattagccaggctggtggcatgcacctgtaatcctagctgctcgggaggctgaggcaggagaatatcttgaaccctggagccagaggttacagtgagccaagactgtggcactgccctccagcctgggggacagagtaagactctgtctcaaaaaaaaaaaaaaggttgactgtgagatgtgtatataaaatccaagagtactttgtaatattattatttaatagtgatatcaataaagtttaaatcttgttgatccatcaaattttttagactggtttcattatgtagagatagttatagaacaaaaagaaattgtcatcatattctcttcatccaggacaagtaactaaaaaatttcaagtcaattaagtttgcaattgttcatgttttaagaactgcatagtctaactgccttagggtttggaattttgatatgaggaagccctaatgctttttacaatcccatcttattaaattaagaagtcttatgagatattgtttaactgtgcccagctgaccaacttcatataaggtttatgaaagtcagcttaagagatagaccattagcaatacagttgaatatatcttcatattttttacttcataggaatgtatccctaaatattttataatattgtcttacatttttatgatctataaatgacatcatattctatgtatccttttgctatgtgctttttaaaatttcccatatggccaggtttggtggctcatgcttgtaatcccagcgctttgggaggctgaggcagggagatcacttgagatcaggagttaaagaccagcctggccaacatggctaaactctgtctctattaaaaatacaaaaattaactgggtgtgggggcacacgcctgtaatcacagctattcgggaggctgaggcacaaggattgcttgaacccaggaggtggaggttgcagtgagccaagatcccacccttgcactccagcctgggcaacagaataagactgtgtctcaaaaaaaaagaaaaagatataatctaaattatatttgttaagatgtatctcttttgatatacacagcacctattcatttatcttcacattgatacatataacaataatttattttttacattgttgtgtggtagcccagtgtatgattataccaaaatttatttcttttcttactgatggacatgtaagttgtttctaggatgttgttgcttgtttgcttttcttttgtttgcctttgatacataatgttgaaataaaaatccaaaccacaaagtgatattacttcacacccactaggatggctttaataaaaagacggacaataacaaatattggtgagggcatgaaaaaattggagcctcatacattgctgatgggattgtaaaatggtacaaccactttggtacacagtctagcagttcttcaaaatgttaagcataagaattaacatttgacccatgagttctgctcccaggtatatattcaaaataattaaaaacatatgcccacataacaacttgtacatcattgttcacggcagcattattcacaataaccaaaaggtggaagcagcccaaatgtccatcaactgatgaacgaatatgcaaaatgtagtatagctataaaatgaaatattattcagccataaaaaggaattgaagtactgatatatgctacaacttggatagaccatgaaaacattacgcgaagtgaaagaagtcagacacaataggctacatattatatgatttcacttatatgaactgtctagaaaagacaaatccacagaaatagaaagtaaattaatagttgctaagggcttgggggaaggggtgagtggaaagtgattgctaatggaacagggtttctctttggagagatgaaaatgtcctgaaattgcataggatgatggttgcacaattctatgaatgtattaaaaaccattgaattgtacactttcagaaggtgaattttatggtatgttgattacatctcaatgaagatgttataaaagacaattaaaaaatttatagtgctactgtgagcattcttgtacatggtttcatgtgtaaatgtgttagaattttcctagggtttatgtgaaagattaaacatttgtgcatcttcactgggtaagtgatgttcaaagtgactggctatgccagtgtacacttcctccaactgtgtaggaaagctctacatttccacttacaattgctgttgtcatatttttatatcactaatttctcagattaaaactgataataattctttaattgattattctcaaacaatgccaagagtgtgatgctatttgcaaatggctcttgattattgctgcttggatttcctggtgatgagctgcaaaatatcaaggcccaagtgatgtattggtttatatttggggtttgtgcatgaccaacttcatataaggtttatgaaaatcagggaaagattgggcagatctgttacagaaaatcttccttagcatctcagaaaattacatctgaacaatttatgcttagactgttcagtttgcatattatttagactgtttacatcttttaccatccctctcagtagtttcttcttcatgcagcagttcttttttcccagtggcttcttcttagttgaggaagtgttgtgttctgtactagatgttttaaaaagaaatatctaaattcaacttcagattcaacatctggaaaaaagaagctcattcaaatagcaccagcaaacaccataaaaatcttgacataaactcattactaaaataaaaacattcattttagttgtttctcgagttttttagggtattaaaatctattggaaattgtcctagagtctttgggggctgagatcagtatagaataatacagctggaagctaccctagtgatcatagagctcaaccctctcatttttacagatcaaaaaacctgaggttcaggaaggtgaagtgagttgtgcaagggctcacagctaaatctatttcaatcatacaataactgtcacattttcctttgtcatattattatggattaaatgtttagtccaagagggtttttttgtgtttttgtgttttgttttgttttgcttttttagtaaggattttattcaaaaggtttactgcaagggatgaagggacaattataataaggagactgctgtaaccataagatttgcaagtgcctcaagagctatttttcttttttcttttttttttttgagacggagtcttgctctgtcacccaggctggagtgcagtggcacgatcttggctcactgcaagctccacctcccgggttcacaccattctcctgcctcagcctccctagtagctgggactacaggcgcccgccaccatgcccggctaattttttgtgttttcggtagagacggggtttcaccgtgttagccaggatagtctcaatctcctgacctcatgatccacccgacctcccaaagtactgggattacaggcgtgagccaccgcacccagccactcaagagctatttttctatagtaaaaaatacatggctaacttcagaatgtaaatgtaaatttgaatacttatgatgggtttctgtgtatttatttgtttatttttatttatttattttttgagacgaagtcttgctctgtcacccaggctagagtgcagtggcgcaatcttggctcactgcagcctccgccttctgggttcacactattctcctgcctcagcctcccaagtagctgggactacaggtgcccgccactgtgcccagctaattttttgtatttttagtagagacggtgtttcaccggggtctcgatctcctgacctcgtgatccacctgcctcggcctcccaaagtgctgggattacaggcgtgagccacggcgcctggcctgggtttctgtgtatttaatatgttctgttgactttctttgacatttggcaaatttaaggcactaaataatagtgaaagagctgaagtactattgtatttaacactttgacagaggttttgttgttttttttttctcccgtgggtagtatatttatcctactgttgtttgatttttataatatgctagtcttcatgaaggccattttcatgagaatatatttaggtatattttcgcctaaggactttgccaaactgcaattaaaataatggaattacacaacttttcatggcatcctattcttttacagagaggaatggagaagtgaaataaaaataagttaggtgataagaacattttagaagagcttttgttcattgctagtcctaacttagtctagtgactaagaagatgcaactattgatgtttatatttgcatgcagttattgattttgtgtcagaaagccttctggtacttgctgtggtctttccaatgctgttaagctggaagaatgactttgctcttggcctttactatagcctttgaaaacaaagtattaacattattttaagcctttgagtttttgccattcagccttaagttggcatactctgtcaacaacgtcagtgtggcatattaacaagactaactgctccagaaaataggctgggctactaccagttatgtagaaggtttcattgagttctaaaatttcagagcaagaaaggtgaaacttagtctcaaaaagatatggggatcatctctgcttagtcttaattaagtgaagactttggcaccctgaaagcctaaggagtgaggtctctgttggtatactgctatttcaggttcatttgaattaatctctgaggttgttaactagatagctgtaactccaaaaagacaacttaaatgtgccggctagctatttggctactccttaaacttggcttcattttaatgtttcgatggtacaagatttttttttttcctgattccggtaaggtagaaaaggattatttaatgatttattaaaaggccagtcattagactgttcaaaaacaaactccctatttgatccgtttctgcctatcccttcagatttgactgttgtgatcttctaggtcacattctactgggtgagaaggcagttttctataatagatgcactagaagtttaatctagtgtcgtagggtaattctgaatagcagatttgggaagataggagtgttgtcactttacctttaaagcaagtctttgaattgccctgtgtcacacagtaagaatatatgcaaattagttgtgggattaacacatagttatgggatagactagccattgtttaaaagcagaataattctaaggtaaatgaaatttcagaaaaaaaattatataaatttaatttgaatcaatacaaaatagtttttcaaaccatcatttggaatataataggtatacatttaagaatgtaatgggaaagaggatcctgttcatagaagcagcaaaaaaaaaaaaaaagagaaaaaatcacaaaatccttaggaataattgcccaggaagaaatatataagacttttctttttttgagctggagtctcactctgtcaccgaggctgaagggcagtggcacaatcttggctcactgcaagctctgcctcctgagttcaagcgattcttctgcctcagcctcctgagtagctgggactgcaggcgcacgccaccactaatttttgtattttagtagagacgaggctaatttttgtatttttagtagagatgaggtttcaccatgttggccaggctggtcttgaactcctgacctcaagtgatccacccaccttggcctcccaaagtgctgggattacaggtgtgagccaccacgcccagcctataaaacttgtaggaagaaaatataatactttattataaagaacatgaaagaaggcctaaataagtggagctactgatagaaatagtattgtatcatctctctttcttaatattgatctagtagtactacaatagtaactacctcatagaattgttagaattaatatatgaaagatcttaaaacagtttctgacacttagtaggctccatagtgtttgctattattgtttttattataaaatccatgtaactctagtcaaaatttccatggaaaaatttggcaagctcatcctgaatttcatctgaaagaattaatatgcagaaatagtcaagtaaatccctcaaaattcaatgaggtgagtcttgacctaccagatgtcaaaatatagttaagtaattaaaatgctatagtattgatagaggaatagataaacagataaatgaaagaaatagagactccagaaacagactcaattacagataggaatttaattttgataatggtgacatttcaaattaatggggtaaaaattgtgttaggaaagttggctctctacttggggaaaaaaattataccccctaactctcaccatctgaaaagtaagttccaaggaatcaaatagttaatataatttttagaaggaaatataggtgaatatttttataactaggaagcaaggaagaggtgggagggagaagacttcctgagtaaaatgaaactcagaacttttctatgacaaaaaacatcctaaaaaaagttgaaaaacaaatgacagaccaggaaaaagattttgtgatcaaggattaatatccagagtaatgaactctttatataaacaatttaaaaaatttaaccggccgggcgcggtggctcatgcctgtaatcccagcactttgggaggctgaggcgggtggatcacaaggtcaggagatcgagaccatcctggctaacacggtgaaaccccgtctctactaaaaatacaaaaaattagccgggtgtggtggcaggcgcctgtggtcccagctactcgggaggctgaggcagaactgcgtgaacccgggaggtggagcttgcagtgagccgagattgtgccactgcacaatgggaagtagttaagtaataaacatatgagataatatccacatggaaggccgggcgaggtggctaatcccagcactttgggaggccaaggcgggaaatcacgaggtcaggagttcgagaccagcctggccaacatagtgaaaccctgtctctactaaaaatacaaaaattagctgggcatggtggtgcacgcttgcagtcccagctactcgggaggctgaggcaggagaattgcttgagcctgggaggcggaggttgcagtgagccaagatcgctccactgcactccagtctgggcgacagagcgggactctgtctcaaaaaaaaaaaaaaaaaaaatccacatggaattgcaagggacccagaatagccaagacaatcctgaaaagaagaacaaagtaggaagactcacacttcctgattttaaaacttactacaaagcaatggtaaccaagacagtgtggtatcagcacaaaggtagacaagtacatcaatggaatagaattgagattgtagaaatccgtgcaactatggtcaactgatatatgacaaaggtaagaccattcactggggaaggaatagtgttttcaacaaatggtacagggggcagctggataacatgcaaaagaatgaagttggagtcttacctcacaccatacaaaagttaaaatagatcaaagacctaaatgtaaaagctaaagctataaatctcttagatgaaaacatagcagtaatgttttccatgacctcggattgattaattgattgaatttaatgatgagctatcaaattggatccatgacctcggatttagcaaaaggttcttagatatgtcaccatagcatgagcaacaaaagaaaaaataatttgaattcataaaaattaaaagctttatttatttatttttaagaggaagggtctcactctgttgcccaggctggagtgcagtggtgcgatcatggcccactgtaacctcaaactcctgggctctagtgatcttccaaccttaacctcccaagtaacaaggactgcaggtgtgtgacatcacatccagctttttttttttttttttcatatgggttttgctatggagcccaggctggtctcaacatcttggcctcaactgatcctcccacctcagcctcccaaagtgttgggattatgggcatgagccaccaccactcctggcctaaaagcttaaaatacttgacactatcgagaaagcaggtagatcacttgagtcctggagttcaagaccagcttggggcactatagcaggacaacatctctacaaacaatttgaaaaattagccaggcatagtggcacacacctgtagtcccagctgctggagaggttcaggtgggaggatcatttggacctggaagcatcgcttgcagtgagctgagatcgtgccaccgcactgcaggctgggtaacagagtaagaccttgtcccccaaaaaaagaaagtgataagacaacccacagagtgagagatatttgcaaattatatatcttgtaagtgacttgtatctagaatatataaagaactttaataataaataaataacttaataataagaaaaaatatctcaattaaaaaatggacaaataatctaaatagacatgcctctaaggaagatacacaaatgaccaataagcacctgaaaagatattcaacatcaattgtcatcagggaaatgcaatgaaaaccgtaatgagataccactttgtacccactaggatgactagaaccaaaaagtcaaataatgacaagtattggtgagggtgtggtgaaattggagctctcatatactgctggtaaaaatgtaagatggggcagccgctgaaaaacagtctggcagttcctcaaacaattaagcatagagttaccatatgatccagcaattctactcccataaatgaaaacatatgtccataccagcaattctactcaggtgtattgaagataaatgaattatcttcaggtgtactgaagataaatgaattatcttcaggtgtactgaagataaatgaattatcttcaggtgtactgaagataaatgaattatcttcaggtgtactgaagataaatgaattatcttcaggtgtactgaagataaatgaattatcttcaggtgtactgaagataaatgaattatcttcaggtgtactgaagataaatgaattatcttcaggtgtactgaagataaatgaattatcttcaggtgtactgaagataaatgaattatcttcaggtgtactgaagataaatgaattatcttcaggtgtactgaagataaatgaattatcttcaggtgtactgaagataaatgaattatcttcaggtgtactgaagataaatgaattatcttcaggtgtactgaagataaatgaattatcttcaggtgtactgaagataaatgaattatcttcaggtgtactgaagataaatgaattatcttcaggtgtactgaagataaatgaattatcttcaggtgtactgaagataaatgaattatcttcaggtgtactgaagataaatgaaaacatgtgtccatacaacacttacacaaaaatgttaatggcagcattattcataataaccaaaggtgaacacaacccaaatgttcatcagcttatggataatcaaaatgtgtatccatacaatggaatattatttagccataaaaaggaatgaaatactgattcatgctacagtttggatgagccttgaaaacagatgctaagagaagtcagtcacagaagtctacgtattatatgattctatttatttgaaagtccagaatagggaaatctctggagtgggaaagtaggttggtggttgcttagggataggaggagggagggtaagaggttgaggagcaatagctagaggatacaggacttcttttttttttctttttttttttgagacagtgtctcactctgtcacccaggctggagtgcagtggcgcaatcttgtctcactgcaacctctgcctcctgggcttaagtgatgctcccaccccagactcccaagtagctgggactacaggcccacaccacacctggctaatttctaattttttgtatttttgctagagacagggtttcaccatgcttctcaggctggtctcaaactcctgagctcaagtgatccacctgcctaagcctcccataagtgctgggattacaggcatgagccaccgtgcctgaacccagggcttctttttgagatgatggaaattttctaaaattgactgtggtgatggtttcacttatctatgactataatttttaaaaaaagtacctttgaaattatatacttttaaatttaattaatttatttttccaaagacaggatctctctctattgcccaggctggagtgcactggtgcgatctcaactcactgcaacctgcatcttttgggttaaagggattctcgtgcctcagcctcctcaggggctgggactacaggcacacaccaccaagcctggccaatttttttgtatttttagtagagacagggttttgccatgttggccagggtggtctcaaactcctgacctcaagtgatctacctaccttgatctcccaaagcgctgggattacaagagtgagccactgtgtccagcctgaaattatatactttaaatggaccaattgtatggtatgtgaattatatctcagtatagctgttttaacattaaaaaaaatttaaaacacatgagaaacttctcagatttcattgttaattagcaaaacgcaaatcgaaacagtgtttttttttttcagttctttaacagaaatttaaaaattagttcttttttttttccttgaaccaaaagaattagttctttcaagcatggatattgatatggaattggggaaatgggtgcacttaactgtcttgtaaatgggcaaagccttttcagaaggcagtttggcagaatttataaaaatatatgcagatcatttggctcctaagttttatttctttccttattctagcatatgtacagaaagatgtatgtacaaaaatgttcttttattccttgtttatagtaaaaaattaaggaaaaacctaaatttatataaatgggggaatggttagatattcacagtatggaaatcttttgctgctatgaacaaaagaagtagacccaggtctgggcatgatggctcactcctgtaatcccaacactttgggaggccaaggcaggaggattgcttaaggccaggagtttgagaccagtctgggaaacatagcaagaccctgtctctaaaaaataaataaataaataaaaaacaaaagaggtagacctacataaacctgtactaacactatgcaagaacattctataagaatattgtaagtagaaagaaaaactcactgaagtacatataatatgtccccatttacgcttttaaaaattctggaagatggccgggtgtggtggctcacgcctgtaatcccaccactttgggaggctgaggcaggcagatcacgaggtcaggagatcgagaccatcctggctaacatggcgaaaccccatctctactaaaaatacaaaaaattagccgggcatggtggcagtgagatcgcaccactgctgagatcgcgccagccaagatcgcagctgagatcataccactgcgctccagtctgggcgacacagcgagactccatctcaaaaaaagaaaaaaaaaattctgaaagatatatgaaaagtacatgtaagcacataagtatctggacagtattttagcaggatatattgtagttagattttaattttttttctcttaacaataaaaatatactctgtgttactagattactttaagaaaatcaatttggggccgggcacagtggctcacgcctgtaatccaagcactttgggaggccaaggcgagcggatcacctgaggttgggagttcaagaccagcctgaccaacatggagaaaccccatctctactaaaaatacaaaattagccgggcatggtggcgcatgcctgtaatcctagctgctcaggaggctgaggcaggaaaatcacttgaacccatgaggcggacgttgcggtgagccgaaattgcaccattgcactctagcctgggcagcaagagtgaaactctgtctcagaaaaaaaaaggaaggaaggggaaagaaaagagaaaggagaaaaaagaaataaaagagaagagaaaagaaaagaaaatcaatttgggctggacctggtggtttacgcctacaatcccagcactttgggagactgggcagatcacctgaggtcaggaattcaagaccagcctggccaacatggtgaaaccctgtctctactaaaaatacaaaaattagctggatgtggtagtgggcgctgtaatcccagctacttgggaggctgaggcatgagaattgcttagacctgggaggcagaggttgtattgagttgagatgatgccactgcgctccagcctgggcaacaaagtgagactctctcaaaaaaaaaaaaaaaaaaaagaaagaaaatcaatttgaagaaaaaagctatagtatacctgatattggatggagctttggtttggaagttaggaacccacagcattagttctgctattgtcatagacttaagccctctcaagttgttcaggtttcatttgtctcacataactcggtgttaggaagcagtattaggaccatgttgttccccattgtcacttcctgagcattatttcttatactgtcttataaaaataaaataccgccgctcccttgattctcatgccaccttttaactccctcattcatcaaagacttagctcacaacttactctccatctcattttgctatcaaatcatccaacattcacttgggtgactgttcctgaaaatgtttctcattttgggtgatttttccctccaccttgctctgtcacccatttccacagttatacccacgacacaaatgtcacctatatctgctcctcctctaatgcatctggctttttggccataatgtggaattgctagttcaatcactgctattataaccagttctaattgggacttccaattctttttcccatttacttctttataattcatcagctttccttcttctcttgcttagattctgtttactttaataacactttccctaaaccctaaactcgttacctctctgaaatttttgaacttatctggcaacgtcctaactggatgaacctaactctgatttctctgtggttacacctaagtggatgaaaatcaccaaatagtatacgtttttatcactttacattcatggtccccaaattcaaatagatcctttccattgtctggaaacccagtcgtatgtccctggccaactcactcatttctctggaatgatcatttcatacttctgtatgctcctcacccttctgagcattctacttcctccctttttctgaacagtcgataccacctcctactgctttgcttcctactccacaaccactctgatctggcttttgtgtttatcactgcaccaaaaaaacccttttaacaagtgctttaacatgagacttgtgaaagtctctagtgccctataggttgttacatttagagttggtataataaaatggttcagaattatgctctggagccagactgattggatttgaatgctggctccttagtttttagccatgtgaccttgggcatgttacttaatcttctaaaaatgatgatgatgataataatagtaatatttatcttattagcttgccaggaggatttaatgaatattaattcactgacattcattatgtggggcagtgtttaatgaatattaattcattaatattcaatatatggggcagtgtttcacccatgtatagtaagcccttaataaatgttaactgatattattgctcctaccactacctctgttactactgtgattactactacttcacagataaaacagagaaattagatgggaatttcttatttgttattacttttttgagacaaagtccctctttgtcactcagactgaagtgcagtgtcgcactgcaaggcttggctcactgcaagcaatgcctttggggctcaagtgatcctcccacctcagcctcccaagtagctgggactataggtgcgtgccatcatgcgtggctaatttttgtattttttgtagagatggggtttcaccatgttgcccaggctcaatttttatctctaaaccactctacctatgtctgaggcattctcttttccttccctcctattgcagtggagagtttttcccatttaaggctaatccttctgtctttattttggagcctttctctttaatctcacgctatccaaccttattcgccaaccttttctttttatgtgaatgcttctaaatataattaaagatgctcaagtctctttcattttacaataacaacattttatggccccttcctggcttccatctatcactctgtctctttcctccctttcttagccatatttttcaagacttatcaatgctctcatttcctttcactcttcattccattcttaatcttgctctttcccgattactgcactgaaacatttcaagctcaggtcctccgtgacctttacattgctaattctgacatgtcctttcttcagcttacttgactgttagcagcatcaaccactctttcttgaaacactttcatcctatgacttccatgctaaatttgtttttcttttctcttctctggttataccacctttactcactcatcctttcctacatggtttttaaatgctagaatttctcatagctttgtggtaggttgtcttttcacactactctcttgccaggtcttgtccacatgcccagcttcaaatagaccagaaaaaatattggctgctatcaccagtattatgatattcctcaacctttcccttccttagaggacttttgggaagacacatggggatatatttaaaatttgagttttttggaagaaaggatggcattataacttacattattccattgaaattaatctagatctaaaatataagaaaacccaatccttttagtcagatatattaaaataacatattggaagaaaaaaagttgttgataatagtgtgtctaaagttactatcccttgagttagcaattatgagaatgtccaaattcagcaataattaaatactatgcatgtagctattttctggcactgaagaaaatcatgatagcaatggtagtagtaataacaatggcactggcaagaatacagcatagtcctaacataaatattttcttttttacttttgagatggagtcttgccctgtcgcccaggctggagtgcagtggtgcaatctcagctcactgcaacctccacctcctggactcaagtgattctcccacctcagcctcccgagtagctggactacaggtgtgcgcccctgtgcccagctaaaaagtattttctatatgtttgatttttttaggagacagtatgccaaattccttaaatttggcagattctcatagtatatgatctcatgctctgaaagagggaaatagaccactggaaaaatggatagttctcagctagtgcattacacgcacatgcatacacacattagaaacaaaagaagcaaaaacgaaaacccaaggacaaagtgattctgatgtcattatttccacagcaaacagctgggatttttacatatgtgacattaacttagaaaacttagaaaatgtaaagctcctacttcatcctcactgtcatgttagtgtcacctgggggctgtgatctgaatcttcactgaactctcttcgttattatagcattcattgattttgatgatattaaattgccttttggaaaatattcactatttagttgttggagtcccttcctcctttaacctgttctcccaaaacagctttggtttttttaagagacagtgtgccaggcatgctggttagcctagaattagtagacacaaggaaccttctgtcagagggattgttgtgtctggcacaggatcatttgggcacagtatcatagcttgcctggcagaagtctaagcaaaggggcacaacactcttggcaagttgagagtggcaagggtaatgtcttatgttgcccaagtaactctgttttagttagaatcctgactagctgaaaaagcatacttctctcaatggctttggtgaagccttttgatgattgactatttccttaagagtttaagagaaggctcaaaaaagggctttcattctgttaacttcttggtttttgctatgtacattgttatattggtggaaatttcacatttcattattttatttccttttcccctcactactaaacatatatatatattttttgtaaattgagggagatgagcttttgaatctctaaaacctagtgttgtgattatcaatgtgtggattctaagatatctgctaccaactaataacagcaccaagacaacctctggatgcttactggatatgcctggggatggaatattaacatggtaaattttactcaaaataggatattagaaattattttcatatttaattatattcatatttgtcatataactaggagatttctttcttttgacagggtctcgctctgtcacctagggctgcagtgtagtggtgcgtacatggcttactgcagcctcattttcctgggcctaagcgatccccctgccttagcctcctatgtagctgggaccacaggcatgtgttagcatgctcagtgaattttttaattttttgtagagatgagggctcattttgttgtccaagctggtctcaaacaatcctccctccttaccttcctaaaatgctgggattacaggtgtgagccaccgcacctttttttttttttgaaatggagtcttgctctgtcgcccaggctggagtgcaatggcgcaatcttggctcactgcaagctccacctcctgggttcaagccattctcctgcctcagcctcctgagtagctgggactacaggtacccaccgccatgcttggctaattttttgtgtttttagtagagatggggtttcaccgtgttaaccaggatggtctcgatctcctgacctcgtgatttgcttgcctcagcctcccaaagtgctgggattacaggcatgagccactgcgcctggccgatatttgtttttccttgatgatggatttaaaagatcttatttcatttattttttataatttcaacttttagattcagggggtacatgtacaagtttgttaatgggtatatcgtgtgatgctgaagtttggggtatgattgatcccatcacccagttagcaagtgtagtacccaatagttagtttttcatccctagcccctctccctttctctctccctccctctctgctctagtagtccccagtgtctactgttgccatctttatgtccatgaatacccagtgtttagctcacacttataagtgagaacatgcagaatttgttttctgttcctgtgttaatttacttaggataatggcctccagctgcatccatgttactggaaagcacatgattttgttcctttttatggcacataactaggagatttctatcctcgttattaatgtattagcttgctttctgtattgttaatatcattaagcaaatacatgctttgtgtgtgtagagcactattctgggccctggggatacaattagtaagtcatagactctgcatacaaggagtcttgctgagaatttgacctatcaaagataactacaataaaatccaatatactacaataggtaatgggaaactggtggtagtggctagtatctgctaggatgagaagaatagtcaaggcaggcttcatagtgaaggtaatgtttaaactaagtctttcagaccatgtagaagctctaagcaggaaaatgcatcccaggcagaggaaacagcatgtgtaaatatatgagggcatgtgaaagtgtggcacacttgcagaattgttagagattgttatggaaatggtttataatagctaacagcaatatgcatgagcagttaagttgtgccagacactgttccaactgctgtgtccatataaagatatgtaatcttcataataatactaagaaagaaatagtactgttattcccattttatagatggggtaactgaggcagaaagaagttaagtaacttatacaaggtcttatagctattaagttccacagctgacatttgaattcaaactttctggccaatgcactaaatcaggggtcagcaaactatagctcatgggccaaatccagcccactgcctgtttttgtacaacctataagctaaaaatagttttgcacttttaattagctgaaaaagaagtaaaatattttgtgatatgtgcaacttatgtgaaattcagatttttagtgtccataaaattttactggaacccagctatagtcgttggtttagtattgtctatagctgcttttacattataatgacagagttgaatgtttgcaagagactatgatctgcaaagtgtaaagtacttctttcttttttctcttttttctcttttttttttagagacagggtcaggctctggcacctacgctggagtataatggcacagtcatacctcactgcagttttgacctcctgggtttaagcaagttattcatctcagcctcccgagtagctaggactacagttgtccaccaccatggctggctaatttaatttttttttttttttttttttttttttttgtagagatagattcttgccacattgcccaggctggtcttgaactcctgccctcaagcaattcattcaccttggtctcccaaataaagtactttctatttggctctttacagagaaagtttgctctaaatcaatgcactatactgcctcacagtatattttgttttattaattaacacaaagaatagcatacgttaatagcaatacttggacttatgtactagttatctttttaaaaatctgttttcatatttgttgtcttgtgtcctcacatcaaccctgaaataaaaagaaggttaaatttggtgtttttcttgtatagctaagaaacttagctgtggaaagattaggatgggctgtgacattaaagtcagactcttttgcctatacagcatcttacaacatcctccattctgttctgaaatttctcctctacctctgtcctacataacagttgttcagagtttgggcttgaggacactctataaatgagacagttgagacagattgaaagcaaggtaacacacactctttccttaaccttcagtgcctctgcaacagcatctgaaattttctgtcttggcaagcttcacctaattctgagcaccctgctagtgaagtgctctgggaggctgggatttgactgcagataagtaagcacttaccatcaaaggagacagggggcgtttctcattttcatttccataaagggatgccattgctttgccaggctatgtggaaagtctttgccttaacagtgaatcttgagtcctctttcaggtttttacctgtccatattctacttttggaacatgaggtttctacctttttgctattcctgatcttttcctggacttaggaatgacttctcttaccaacaaatcacggaagcttttcttgttaccttggtactaccagtaagctagtcggggagagtggaatctaactcttctatttgtgatctcaagggatgtttgtgttattcattggtttgtatttttcattctacttcccttcttctaggacatagcagtctgaagtttggactacaggctatgttttgttgtatcattatgcttgatgctttcaggaaaaaaccaagttgttcagatttctcaagtcttaatctctagtgtgtgttctgttttcagcctcaatagtgaatttatattatcagatatacaaaattgattatacccagatttggactgttaaggcctagcagaaacaagacgcagctttaagagaggtcaactatgtttctgctcatagccagcatttccttggcctcggacagtgctgaggtcagagcaatgtagaaaaacaattttctgtccaaggggtcagatgcctgagagatgcaactcaaacacctacagtgaggggtaacatatacagacatttgtcaaaacttagtgaatgtatacctaagattcgtgcttttcactgtatgtaaattttacttcaaaagaaaaataatactgtaaagaggtatttaactctagtttatagttaagtatttggagaaattattactaatgtctgaaatgggatgaatggatgaagggatggatacatgacaaagcaaatacaacattaatagtggacgatagcttgtgtgggtatatgggggggtcactgtgaacttctttcaacttttctgtgtttgaacatcttcataaaaatttttgggaaaataagaaagtaaaggggatgggcaggtaatacaaattaataaagaaggcttggtgtaacacagtagagagagatggggcctggggcactgagaaacgcatgttctgcctaaagaaggcagctgccactcaactccaaccagttgttactttgtgggaatctggccccagtgttgtaatctaatttttaaaaaggagtttcaaatatagaatttttgtgtgcaaaaaatctttaattttaaaataccatatgggccaaacagtatatttttaatttaccaactcattttctattccaaagattaaaattttcgagaagaaattgggggtgtcctcttgagttgtaaagttaccattgttatcactaacacgtgcctttaaagagatttcagctgtagctgagaccttatactgtaacctcaattcccctgttgtgtgggctgctgtacaataatgccttgccaggcccatgccatggtattcatgacactgacccaaccaggactttgctgtggggcagggaacagctgtgaggctgggctggttggcactgatttctctaggctcacttttggattatttaatatggaaagggcaacagtacttgttagtttgctgctcaaatatagttcctgagtgtaagtcacttaggctttaagagaaattagcactagttgggaatcagaaacagaaaagacttctaagacttccttatattccctgttttgtctaagtggtgtcacaaatcacccatggtcctaagctcttaacaatctccatgttatcctttctcaccactgacattctaataagtgaccctttctgttcattttacctcaggggtacttctcaaatccatgtcctccccagtgtcttagctgccagtaccttacttcaagacctcatcctctcttgcctagattacaatttcctcactggtgtctctcatgagtttttccctcccagtggttcaatcttcatattcctactgcaattatcattctaagatacaattctgttagtatcactctctggtttaaaaacctcaatacctccctgttgtcttcaggataaaggtgagactctttatcatggatggaatatagggaccttcatggctgtcaacgtatcctaccagccacaattccttctattttccactagcctgtagggtaaagttccaatttctcagtatggcaaatgaagccctacttaaatttctatgcatgcccccaccccctttttagtctatgcatgcatagaattctcactattccaaaaaatggacattttctgtttcctccagacctttgcctatgttattctctttgcttcagattctcttcatcgctgctgtttcagtgttctctttcttctttataactcaggtaaataattttttatttttattttttaaatttttattataatttttttgagatggagtctcactctattgcccaggctggagtgcagtggcgtgtcttggctcactgcagctccaccttccagcttcaagcggttctcctgcctcagcctcctgagtagctgggactgcaggcgtgtgccaccacgcctggctaattttttgtatttttttagtagagacggggtttcactgtgttagccaggatggtcttgatctcctgacctcatgatccgcccaccttggcctcccggagtgctgggattacaggcgtgagccaccgcacccagcccaaataatgtttatactgggaggtttttcctgtagcccctcgaccaagttagcaacttcttactctgcactataacactttgtacttagctctcattttatattagagattatttctgttgcattgtatcatttacatgtctctttccaccactaaatgataaagtcttaatcattttttattactacatctccacctgaggaccatgtctggtatagtacaggccttagtaatatttgttacatgaataaatggaaatgcacattacagtcagggaacactgattactgagacaaattcttaacctgttctttggtaatgtgagtcagtgtcagatcagaactttatcttcttagattttctgcttgtgctaacaattagacttgatggaccctcagcagcccgtgactctgttatggtaaaacgcagtctaaagcccctcaacttcctttaccagctatagaagtcagctataggagccctggcccattgtttttcctttcctctaatcctaacttaaattaacttttatctcttatgaatgaaacctgactgtgatctgtttacatgtacaggaacttacatagagcttatattcatatttaagtataacattacttatatagaactatatttatgtttaagtatatcatttttgctcttgtgtagaaaggagggtcccttgttaactctggagataatacaagggtaatataataatagcagctaacacgtaacatttaactgtgtgccaggcttgaagtgtttttatgtacattagctcatttaatcctaattgtaactccatgaagtagttcttatgattggtatgataatttaacagatgaggaacctgaagcagacagaaataactcgtcccaagaacacaaaactacttaaccagtagacctgggatttgaactcaggaagtcttatttcatagtctgtgctcttaactgtatgctgtactgcttagggttatataactgctttctctcgtgtcttctaccatgtagtactctacctgtgggaggacatgacaataagtgttatggactaataatatattattagctttgactatataaaacgcttgatgaaaatatgctgggaaaataataaccttttatttaatatctccttttacggataatatttggtgtgctgatttatactttctgcagatttaaactgcctgtaatttctttgtggcattcactccttactcaactcagatcccaggattgtcttccttcttttccccaggcttacttgacagctatgaagcattgcccatgccatagctttcaggctgtgctcttgtgtcttgtgaaacacttgtttatgggcacagagtgatctggagttaaatagaaaaatccctctccatgggacaacaatttactctacatgccaacttggcagcagggtagaccactggggggctgtgattaagacaggtagccaagagaggaaggaggtttctaatccagactcatgctaataaacagagtggtaaccaaagcactttaatgagatctttgtgttttgcatttagtctagttaggagtaaccaactcaaattgaccaattggccacattccttatataaaattattggagtagactaatatcagtttacactgtatatactaaaataaagctatttttagggagatggtattaagcattgaaaatgttccatgaaccaagtagtttcttgaccctggccatgaactctatttcggacacctctaaagtggtaggtagaaagcatttaggtggttctgtgactgaatatatgaccttaaataagaatcatttaacttttccaaggctgagtttcttcatctgtaacatggaaagtcctaatgcttatcactctagtttccgtattctttttttcctttactgttttgttataatagactttttctaaggaatgtctttgatcaagtctgtaaaggtgtatcattccattacttagtgtgtctcagctcttatgtacagaatttgtaagaagccaatttcaataggactttcttatattcaagtgtcagagttactcagctatctcacctttgagctgaaagaaagtcatacttgggatttttatcacaattagtaggccacatttattgttcctcaaaattagaattatcagtgagtaacaaagtagagatttggagactggaacatacaacttctgtttgaagatgactcatgagctttgagaaaatgcagatttcattttctgagctcttcatcttctttctcctcaactttcaaaaaacatgatttgatgataagagatcagacgtgtataaccatagtgcaaaagttgccaagttgtaagacagctgaatgagtttttcttcttttaggtgaataaaagcatggggaatagagaagattgagggaaacattatttgaagcgaagggcttattagaatccaaattgaacacatttttgaaatttaagtactgttaacccttaggcaatatgatacttgctcttaattgaagggagatgttctctggtcccagcctgtaaacatttgcagtcttgaggtaatatgccagtttactgagaacaaaatcttaatcagtatgacacttcatggaaaattctttacttctgctctctcggctgtctctcttgaaagggtacagatctgtgtccagagcctgcctgaccactgagtacataatcagatatagttctcaccatctgagagccaaactgtctctgccagtggggttatgagtctttcacacagggcagacagttgctggtgtcacctgtcatgttggagcagactgctgtgatgatttccacttaagcagtagttatactatatcatgattggagtgaagagacagctacttggaaggattgactcaagctctggatcagtcaatcttaactactgataggttaaagccttcctgtagtgacgatctcctgatggtggagattgccagatttactgagtcctttatcacctttaatttatttgtactactggctctccatatccatgggttctgcatccatggagtcaaccaactgcagattgaaaatatttgggaaaaataaaaaataaaaatttaatattaataaaaataatacaaataaaaacagtatagaataatgactatttacatagtatttacattgttttaggcattttaaataatctagagatgatttaaagtatctggaaggatgtgcataggttatatgcaaatattataccattttatttaaggaacttgaccctcagtggattttggtatctgcagggggtcttgcaaccagttccccatggatactgagggacagctgtataatttcttggcatatgatttcttggccgtctagttggggcaaggggactttgagcttagaaatgttgggtttcacagggacctcatcaattagtatttctatcccagtttcagtcctcagccagaataccttcagtaaaatgcctcatgtgagaaccatgattagttctttcagggttttgctatttgagccagagattagttaaacagtttctaaaactttctatttaatgtagttgtcttttaaaaagtcatattataaatttattgatcacttttcatctgtcaaagaagggatcagttacagctgtgattttcagttactagtaaggattgaggatatggcagactctctaggttctgattctgattcgctattctatggcaagtttattagtttcctgtggcttctgtaacaaattaacacaaacttggtggcctaaaacaaaattattcaatcattctcccacagttctggagtccagaagtttaaaatcaaggtgttatcaggatcacactccctctggtatatatacattgcatgtatataccatattttacttatccattcagccatcaatgggctcttcaattgcttccacattgtagctattgtgcataaggctgctgtgaacatgggtgtacacatatctctttgagagaccctgctttcaattattattatttctttcttttttttttttttttttttgagacagggtttcattctgtcccccaggctggactacagtctctgctcactggaacctccacctcccaggctcaagcaattcttatgcctcagcctcctaagtagctgggattacaggcgcatgccaccacacccagctaattttttgtatttttagtagagacaaggtttcgccatgttgcccaggctggtcttgaactcctgagctcaggcagttcactcgcctcagcctaccaaagtgctagaattacaggcatgagccattacgaccagcatcaattattttgagtttatacccagaattcttctggatatatattcaaaatcctatttttgaatagaaaatagaaatggtaattctatttttaattttttgaggaacttccatactgttttccatagaggctataccattttacattcccctgagcagtgcacaaggattttaattccttgccaacacttttttttttttttgagatggagtcttgctctgtcaccaggctggagagcagtggcatgatctcggctcactgcaacctccacctcctgggttcaagcaattcccctgcctcagcctcccaagtagctgggactacaggcacgcgccaccacgcccagctaattttttgtattttagtagagacagggtttcaccatgttggccaggatggtctcaatctcctgatctcgtgatccacccacctcagcctcccaaagtgctgagattacaggtgtgacccacaacgcccagccaacacttttaaaatatttccttgcatgctaaaattttatttttatatttcattatttatttttagagatgggtcttgtgtgttgcccacgcttgagggcagtggtgctatcatagctcactgcagccttgatcacctgggctcaagcgatcctccctcctcagcctcccaaataactgggactacaggcctattttgtttttttgataatagtcatcctaataggtatgaggtgctatctcattgtagttttgattttcatttccctaatgattagtgacattgagcattttttcatatgcttattggccatttgtatatctttggatacatgtccattcaaatcttttttgcccatttttgaatcaggttgtttattttttgttgttgagttttaggagttctcgatatactctggatattaatcccatacagatatatgatgtgcaaatttaaaaactttattatgtacatatatttttgcttataaaaaatatggaatgcttcatgaatttgcttgtcatccttatgtaggggccatgccaatctctgtattgttccaattttagtatatgtactgctgaagtaagcattgatttgcaagtattttctcccactctatggactgcctttttactcttttggtagtgtttcttgatatactctcaacaattttgtccacatgatttgttgaaatcaaggaaagcgtgggctgaaaaatccaaacaagtaggtgttaggctgcactaagcccagcttctaacatatgcccagacacctggagctgggttttatggggaagagagttgttctgaggccaaggcaggtagtattagtgatattctgagacacaacagcaaggtcagctctgaaagctggcacttgctggtggcaacagttgcaggctattttgggaaccgaggaggctttgttttatgaggccttctctgcactgccagatttaaccctggcactgattgatatcagccacttttgcctttgatatggagagagcagtatcaggtacagtagtgagatcacagtgctctttccccagattattggtaaaatcaagtatttttccttggagattatcattgccagacaaatgtgacatgctgatgttgggaaactttaatttattacctggcagtttttctaaatagttccttcatactagtaattaagttatatctctatttcttaaggagcttagaacacgttgttactttagtaaaattcgatgtgtcttcaggaatgcaaaataggaggaaatggacttaaactgcatcagaaggaatctgggccaaatgcaaagaatttccccattatcatgagtgacatcaaaagcttgtttagcctgcttcccaagaaaaggaaagacctatctctctggaaggtttagcatagctctgtgtagaggtatggtgttgaagttcatgtccctggaaacagttttataagtgggcgaatctgctcatctaccatgcttcagtcgtgaatgagtcagcagcacagctgccgatggagtgggcagaagggcatctaaatttagtcgttattcacttgagaagattttcagggactatatgtctctcatccatgctttagtctctcatccatgctttagtcatattccttcttctggaggcaaaaaaaaaaaaaaaaaagcaagaaaacagtcactccaaggtgcttcatgagagtgtcctacaactctgttgattggtcttacctacaagaatgattctcttccaccttaactgggtgcatactattttattcatatagctcctgaatttaagaatccatggaattctgaacattagagagggaattttctgcagttagacttacaaacaagctccagaatcttgctagttcaaagacatttttaaccaaacttctttcctcctataaggtactgggggtgggaggggagggctgtgatcattgaggactaagtactttttgttttttttttttccccttgaggcagttgctgtgtgttacactgttgccttaacaacaacaaagtcaggaacaattccaagggcttatctcctttaatctttacaaaaccttatgaggtaggtggtactcccaatgctatagatgagtacatatgcttatagttaagttagataccccactctaggttgtacacatcagcagagctggtttgcaagccctggtctgtctgactccaaagctggtgcttttatttattttacaaatagagatggggtctcactgtgttgcacaggttctcctgtactcaagcgatcctcccacctcggcctctcaaagtgctgggactacaggtgtgagccaccatgcctagccaaaactgttttaaacaacataccatccttcactttgtggagggtatggggaatgatttagacagttggcctcctttattttctgtaagatggttcttcacagattgatgatcgccaaattacatttttagattaggctagttttgttgttcttgttgttctgtcaaacttccttacagtgtcattcccgtaaaattttgtatcaaactggctgtagtggcatgtagctgtagtcccagctacttggaaggctgagacagaggctttttgagcccaagagttaatgaccagccctggcaacagagcaagaccctgtctcaaaaatgttttttatatcaaggatttgggatttataagacacaatatcacaaaatttaaaagaagagaactgaagtagtgatgaggtgaaggagattaagaaaaggagaggagaagtaagaggggaggaaagagaaaagacaagttttctcccgtttgatacctggactagctgggcttattttagggcctctggaatgtggctgctgttgtctttaaaggccaaagaatgatcttgaaaacattggcttctaaaagtctgcttgatagtagtgtggacattagagctaagtttttagattgttctttcagagccaaagaaattttgcaactcaggaagaagcaattgacccagctgtcctggcctacacaggtttagacggcacatttgaccttcttgatataggagtattactaagggcaaagagtgtttttagcacaacctttaaaattcttttttcttattggacttcagtacctttttgaaagtgtccccttccatttttttacttaaaaacgtttatttacaaaaaagaaaaataaataaaataaaaatgttgatttacagtttttagtgagatactctgtgataagttggctagaccttgccatatgggattgcaaatgggcagacatacaatatatgaccaatttagtgataagcatacttatgaactatttgtaaatatgatgaataattatgaaacattttacatggtaaagaatgggatatacttgtggaagttgataaacctaagaaaacatcatagaagaaatataatttctggagctgctgttgaaaactagaccattatgaatactggctataaaagtcagattggccagaaggtcagattggaggaatatattatatagcatcaaatcaaacctagattgacagttttagctaatctcagtaactgtaaaagaagtatcaaatattttgggaaaaaataacaaagatgctgtttgtaaccaagttatctagttaaattttcgtctaaatgaaatcacccttttttcattcatccccttctaggcaggattgatatgaggtttatctctgaagggaattcctgtaagttctcttggtgtgatatgtactacttaagtcctgtagttacaagggccctctagagttctaactttaattctttccacagtaatcttttgccatttaaatagttgttcattataaccatgaaatatcttttggtatgcttgattaaaacagtggttatcaaactgatctcaggattcctttatacttaagaaatcatttaggactcccaaaatttaaccaggactttgtttgtattgattattatacgttactaagaaatttttaaaatatgtagttattaaatatgtacttattaagtcatttaaagcaacaatgaccctgcttacatgttaatataaattacatattttaattaaaaatagtgatattgttttacatttttacaaatttattttaatgtctgtattcaatctgctgtgatatattattttgatgaaagtatataaaatctggcctctcaaaggtatatatttggaaaagggaggagcattttaatagtctgttcagacaattgtagatgtttttcttggatattataccaaactccaacaagtgatggttcgtttccttttttttttgagacacagtctctgtggcccaggctggagtgcagtggtgccatcctggctcactgcaacgtctgcctcctgggttcaagcgattcttgttcctcagcctcctgagtacctgagattacaggtgtgcaccaccatacctgcctagtttttgtatttttagtagagatgaggtttcaccatgttggctaggctggtctcaaactcctgacctcaggtgatccacctgccttggcctcccaaagtgctgggattacaggcatgagccaccatacccgacctgatagtttcttaaatgtaagttttagaaatggtagtttaagacatgagtttcttaaatgttcatgcagtgtggaaactgaaaccatgtcaatggacttttcttactctgttacattaaaacgcattagtctaacttgtactttgaatgaatcttttacttcatgtgtgattttctaacactatgcatttgtttatttggaaaatataggttgattgagttacagagatcttacaaatctaaatacatttcattatataatatcaacaaatcagatttgttgatagtcaaacagatcttatcagaaaagtgaatactgggatgctgtcaagctcatggtggtagctgtttccagaattcttattttcacttggatggtcacattttattgcaacacatactgattattttctctgagtgacaggcttactttgttcattttcaagtccgaataatcataatttgttggttattcttttgaataaaagtggtgttattttgattttaaaaagtggctagttcatctcacacctgaagcagatgcacaagtggtgtgtttttatttttatttttgtttttgttttcgagacatggtcttgccctgtcactcaggctggagagcagtgatcacagctcactgcagcctcgacctcccaggcttaagccatcctcccaccttagcctcccaagtagctgggactacacgtgcgtgccaccatgcctagctaatttttaatttttttgcagagatggggtctgtgttgctcaggctggtcttgaactcctgggctcaagcaatcctaccacctcagcctctcaaagtgttgggattacaggcataagttaccatgcctggcccgaggtgctttttcctagaatcaaccatcatacctcaaaatgcagcagaagtgctttatgtatactttccattttctcacacagaatattaaaaaaaacatttctactacttcttcaaggttattcttaagtgaaactggctttcttttttatttttttaactgtatgtggtgaggaagaatatagtgcctgctggtagtttttgatgccattgtcttgcttcatgttaaggcaccagcggttttactcaccattgcttttgcatcattagtgtaaatgtcaatacaatgaaaatgcaagtaatatcttaatattattatgaaaatcctttgatttggataattcttcctgagctgaagttttagccttgttttttaaaggaggggattaaaaggcaagttttaaaaagggagtctcatttgtttcttggtcctgaattatcccaatggttttgtaaccatccaagccttggtaatggttatcattttcacatgtgggccttctaccacatttttattctgtagctatgtcaagatcttttggtttttttagatctcattgctgtttgtgactgtttctgtttgtcttatggtaagcctaaagcctttattcagaaagcttctgctttctcctaattgctgccatgaaatgagcagatgagactccctaaccatccataactgcaagcatactttgccatagtgtttgaagccattcagaaaatacatgaaaatacattttttctgtttgaaatgatcaccctaccctttctcaccaaagcagtgtttgtttagcaattctagagtcgtaaactacaacttcccactgagaaaaactgtatttgatcctgtgtgattttttcttttttaaatgaatgaaggaatgaatttttttaataatagagacagggtctcactatgttacccaggctggtctcaaactcctggcttcaggcgatcctctgattattttcttttaaaattaataagcatctgcgacaaataggtggcagtgaaataaaataaaattcatatacaaatcagtgttttgtaacatactttcctttttataatataatgatgaaacagcttattcatttgtagcactttagaaatcgctttcacaattaatcctaataatactataaataagatttaagtgtcataagccgggtgcggtggctcacgcctgtaatcccagcactttgggaggctgaggtgggtggatgacctgaggtcgggagttcgagacaagcctgaccaacatggagaaaccccatctctactaaaaatacaaaatgagccaggtgtggtggcacattcctgtaatcccagctactagggaggctgaggcaggagaatcgcttgaacctgggaggcagaggttgcggtgagctgagatcatgccattgcactccagcctgggcaaaaagagtgaaactctgtctaaaaaaaaaaaaaaaaaaaaagattaagtatgattatacatgaaactgtgtttcacagtttagatattaaggcatggagacatttaagcgcttgcataagatcacaaagcctagaagtcatgctctggacacagtatggaagaaatagaaattaatgtattattagaactgctgggcattgtcagtgcccagagcagtgtctggcacatagtggaactcaatgaatacttgttgaatgaatgaatggacttttcttttcaggcatgtattgatgaaaatttggacatggtgaagtttctggtggagaacagagccaatgtaaaccagcaagacaacgagggctggacaccccttcatgcagcagcttcctgtggctatctcaacatagcagagtgagtgagtctctgtgtgtgtggctttgtagtatttgtaggaatagccttcatttctcctctattcttaggaatttgaattttataaatagttataatctctctttattacagattacaaaagcagaaagttgaattatctttaagccataactaatacaatgttttgtaaagttgctaaatccatagttttttagttgaaactctttttgtttgcttctattttcaggtaatttatatttgctgggatatgcagaggtggctgttccactgtctgggttcactttctgaacaactgtagctgggcacgtatacaggcaggcctggagatgtttttctggattctttgtaaacctatttcactgtttttttaaaaaaatcagtgcttagtacaaatgaagataaaaaatgcctagcataccagtcacagcactcgtgtagttaatcgcagaagaatgagcctaaacatgtggaacaaaggaaaggtgggcactggcatgtgttctccacattagttgaatgggaatatttaataagatacattaggagctactaatctccaggacaactagttgcccctcccgtgggcagaagaatcctgaccatgtggtacctgagatataagaggcactgaataaatatctgttgtgtgaaggaatgattggggagtttatttttaaacaaggaaacatctttgaaatggcagtcgaaacatctttaaaatgaggcagttgagtgtatcctagatgagggtaaatttatattgttaaggtaaatttcctaaataaaatcatgatattctatgctcctttgaaaatcagattgcttgtgtgaaggcccttttcaataatatgattagagctccattacatttctcctgtccaggaaacagcagggagaattttgttggcagctgtgtagaggcctgagaatgacttcccacagaatctgatttgcccaggtttcctaagggagagcctgagttgctaggtttgctgctgacccagggatgctcagtgggagaagttaaacaaagggagagtcagagccagagaaactttaggcagcagcactggtgtttgactgggctgcttgttctaaaaagtggatgactgggttggccccaaagccaacagaaataaacaatgcagttttcttcactcttgattcctccctctgttccaatttagtaaaagtcagtaacctcttcatcccctaggctgcctattttcagagtctaacaggaaggagggctcttattcttagtcttatccagtaacatcagaattctgatgcctaagagttgaggtgattttacttaaaacatttatttaagaaacatttatagaacatgttggcctttcaattgctatttgttcaggtggcatgcttatgatatttgagctaccaaatctcattacattcaaggattcaattttttcctaagttttttctttcacttttctaaggagagctcatgcttagaattaggatcacttgtgctggcattatcctcctgtgtgtgaagctaaatacagagaatgattataattgcttttttttttttacagtgatttctttaattcgtctttatgaacaaatataattcttctggaagtaagttcacaatataacaatctctagctcaaacaaatattaccttgaatgaaataaatctgtgagagctactgtttcctaagacagactattataaattaaacttggaagtctgaccagtagagaggtgatctagaccagaatccattgcagaggtggggtggcggtgagatggccttctttattttatttttcactatacatatcattattagacaggttttgactttactgtcatctatttatttgcagtatgtagcattttttttaatatgcaatggaaaaaaaaacattgtttgtactgttcatttcggttgctttacctcagggccaatggagaatgttgtaaataagatcagtccgtgatgatctcgtcatttttatttttgtatcttaaagatcttagactttatgctcttattcccagaatcactaggaactctaaatttcaagggagtagaaatgagtaaaggcaaactggctttctaggaagaatccaagtacattctatttcatgtttcatggtgatctttttgtctcagtatgttgcatcaaaagcagggagcttcagaggcttttttcctcattttaaaatgagttcaggctcaatgctagttagctgggtgtttttacattttttttatgaataaatgtttcacttagaagcagcagattgacccaaacatacatcatttggctttatagtttattgagttgctaatttattctcagtttttgaacgtatttcattttctttcttcctcccttaggatagtagcataaagaccttgtattggtgttgagttaggaaggacaagaaggccttattttctaggggcatatttattgagctagtggctgtttgtgagcctttgggcaactgtaaggattctcagagataaagtagaaattacttcataggttgatatttattcttgtccaggtaaaagtaaaactaaagaggtttttaacttttttttttcctagaactggagaaaatggaaaaacagagagccaaattactttctaaaaattcgtcttcttgattgtagaacatgggaaaagcagggtcctgtatacccaagtgacattatgcctgatccagtagggatggaatagatgtcagagtagagtggttaagatatttcatgtaattcaagcaatatttatggaataccaagaggaaaaagcaagtgtcagatgtcatggcgatgatagtaatgaggaagacccagttgttgctattaaccaaaaactatctgaggcaggtctcaatcaatttaaaagtttattttaccaaggttaaagatgcgcacccaggaaacagatctgtgcctttccccagagatcaagttgagatcaatacttaaaagggaaaagcagcatggtcacattcctgaattcacatgttgccagagaaaaggagcaagtaggggaatagtcaattaaatgttcatctcacgctcagtaaatctcactttacataagataatgtgaacatagaggtaaacatagaacctgtggagatatttaactttttatctatagctatctgcttaggaacaaaaggtaaggcagcttcttgcatgactcagctttcagcttaattttttttcttttggaatagtgaaattagggtcccaagtttttattttcctttcacattgccttcaagtagctttcagtctgatggaatggttgcatcgaggtacagtgtaagtcatgactgaggtctagaattagtgtttgttggggaggagaagagggagtatggggttaaaggaaggaaagagggaattcagtttgtgagaacaggcaaaggtttcatgaaggcaaaagcattttaaatgaactttgaaagaagtgaaaggtttctacaagggaaaatagaagggagagtgttccacctagttggaagaaacaagctgtggaagagagctgggtgagagttgatgtgtttgggaacagtaagtggtttagtttgattatagagtatagggcacacttcaatccaggaaacatttgttgagtgcttactatgtgtattatttgcattttgatatttcagggttggggaggtgtagctgaatattccttttgcttaagggagaggaatcagaagagaggagctgttgaatatgtggaaatgaagggtaatttatgaacggaatactaggacttgatagaattaagaatacaaatagagggagttcgttttggaattgaataaggtctgtcttcctctgagactataagggaaagaaggagatggttaaaaggtgaattgtgaaggcttttgagctttatacatgtagaattgatctataaattaacaaacatttgttgaggccctattataccaggtactaggcactgagaaagcaaaaacatggtcttaatctaatctctattgattcttttccctctgccaactttttttttttttttttttttgagatagagtcttgctctgtcacccaggctgatgttggctcactgcaacctccgccacctgggttcaaatgattcttgtgcctcagcctcctgagtagctgggactacaggtgcctgccaccatgcccggctaagttttgtgtttttagtagagatgggtttcaccatgttggtcaggcttgtctcaaactcctggcctcaagtgatctgcccacctcagcctcccaaaggattataggggtgagccactgcgtttggctccatctgccagttctttgaatgcagtggccagtggccatatattatctctctctttttttttttttttttttaaatctcctacagtgtctaaaatgtggttcccatggccaggcgcagtagctcacacctgtaatcccagcactttgggaggccgaggcgggcggactacttgaggtctggagttcaagaccagcctgaccaacatggcaacacaccatctctactaaaaaaatacaaaaaattagctgggcgtggtgtcacattcctgtaatcccagctaatcaggaggctgaggcaggggaattgcttgaacctggaacgtggaggttgcagtgagccgagatcgcaccattgcactccagcctgagtgacagaccaagactctgtctcaaaaaaaaaaacaaaaaaaaaaggggtttcttcaatatagtaggggtccagtaaatgtttattgaattgttgaatggattgaagtctaatttgaatcatttttctttttcctttaaacacttctgagtatttgatagagctcctagcgttattagagttctcactggcccaaaagtgacttgatctaaagaaaagatgaactagatttgaagtcaagactggggctgtaccctctgccatttacccgctatgtggttttgagaaaattacttaatatgtatgaacctcaatttcttaaagtcatggtaataatacccacattgcctacttcataatgttgcctaagacttatgatataattttatgtgaaagcactctgaaaatcaaaaaggatctatgtaaggtattgaattatcagacctttcttcttcagaatcaagtattctatttggatttagaatttaattatttaacattttaatatttcttcttaagtaatttagtttcgtcttacagcacaggaagatttcatgtggatgtctggttgataggagagttttatggaggcataatttaggcagatttatgcaaattttaatgcacactttattcttctattttcacacccacagcactacttaataagctccagtgtggcactgggaaagtttaaggctgcatgccttctttatgttacttagaaattctcttgccatccactgggagtgagaggatgggagttagtaatatgagtgtgaaagaaatcctgtttgttggcattgctctagtcaggaaatggggaagccttcagtcttaattattgaagtttaaggcacatagaaattaataatggaatatcttaactgagaccatattttaaactcaaaatagagacttcgctgtgtattgaatgccagatgcatgggtaaaatttatattagattgacagataatattgatcctggatcttgtctacgcaggtatttcattaatcacggagccagtgtaggtattgtcaatagtgaaggtgaagttccctctgaccttgcagaagagccagccatgaaggatcttcttctggagcaagtaaagaagcaaggtaacctcatggattggagggggccaggaaagattctcaaacactgccatttacagaaaataatccatttgctgtgcagagcatttcactatcacatgacaggagaggatttgatctgtctgcactgcattaatcattaatccagcatcatgtatcctcataataactcagacaagaataggccagatgtcaaaaggatgaccaatcattccttgtttttgccattcagaggttgcatacccatcatacaattaagagtgacctgatgaggactgtgtgtatgcacagtactgtgtgtatgcatggtattgggatacagtgtaaatttgagaattggctaaactgagtttgtgactttgcatcttttcccttgttgagagctaaaagtggtgctgataaagatatttattgtaactaatcatgagaattagtatgataatttgttaaggtgaggaagctaacttagaataatatattctaaaaatgcttattcttattttatagttttaggagaatcgatttcacagaataggatggaatttttcaacctggaagtccctgggttctttttccaccacaaaactctgcggacaagatttgtagtgatttttttttttagtccttctgctaaactaccttactcacaatcttgcagttcatcccagaggatttagctccagtggtctttcccaatatgaacttttagaacagtcagggccaattcttgctatgcgcattgtttacatattatccaaaactgcttttgtgccacaacagcagagttgagtagtagtgatagattggatgaaccacaaacctgaaaatacatattggccctttggagaaagtatgctgatcctaccttaatatagtgatgttctaggtcagtaactacttgcttttgctgcctttcatgtatagtttttctgtcctattttgtttgtttgtttgttttttgtttttgagacagggtctcactctgttgcccaggctggagtgcagtggtgccgtctcagctcattgcaacctctgcctttcaggttcaagtgattgtcctgccgcagcctcctgagtagctgggactacaggtgtgcaccaccatgcctggctaatttttgtattttttggtagagacagggtttcaccatgttggccaggctgttcttaaactcctgaccccaagtgatccaccagcctcggcctcccaaagtgccgggattaaaggtgtgagctatagcgcctggctttgtgcgctattgaattgaagaattttatgcttagcttaacctccagcctcaatcagttttatctcctaagatttgctttaaaatgtacaaacaactttaaaaaaatcagttttaaaaaatagtttagattggagcaaccactttttctgttttgattgctgactcttcaatgagggaacatactctgttgaaaggggtattcatatatatgtttaactttccagcactgctaacacttctttgtgtttggagtactgatctgatttaaattggttacctcttcaccccatccatctcccaaaatcacacagataatacttaggtagttgacaggttctctctttttttttttttttgagacagagtctcactgtgtctcccaggctggagtgcagtggcgcaatcccagctcattgcaacctccgcctcccaggttcaagcaattctcatgactcagcctcccaagtagctgggattacaggcgcccaccactatgcccagctcatttttgtatttttggtagagacagggtttcaccatgttgatcaggcttgtctcgaactctgatctcaggtgatccacccacctaggctttccaaagtgctgggattacaggcatgagacaccgcacccagcagtttctcttttaagagctgaaagggagtagaccaagcacaaagactgctaatgagtgtaaaactttttgaatgggtatgtttgtatttgggacattttattattttgtataatggggtatgcctcaccctaaccccttttcactggcacagatattggagagttattggctaaagggaggaactcttggagttctttcataatgtttttaaggaaaacaaaatctgcattcccttgaaagcagacaggtttttaaactgcagatcacctactaatctgtcctagattatatatcttcaagtcagtgtatttacctgtatatggaaatgaactttagagatagttcaatttttaaagtatatcaatacctgaaaccaagattttggatactcatcctatggtatagtgagtggatagggacccagaagaggaatgacagagagggacccaggatatcggagttctagcggcaagttctgtcactaatgtgttttgtggctttgagcaagattcctaacctttctatttttatttcctcatctgttaaatgaagattgtaatatctattatatttaccttgaaggattgttgggaaactaaagtcatataacatgtaaaaagacttggaagtttatagctttgtacaaatattataatgtaaaaataatgtcccctttgtctttatgttctgttgaaaacaattttaggtgcattcccttaatggatctgtatcacataatatttaacctgatgatttaatcctggtaagaccattaatatgtgtacaaatgccattgatcttctaaatttgataattacccaacttgatggctaaattgttatttgtatttatgtttatgatgtgctttaatctaaggaaaatatcctgtcaaacttaagtggagctttagtaatcctggctgtctggtatctggtttctgtaggagttgatctagagcagtcaagaaaagaagaagagcagcagatgttgcaggatgcccgccagtggctcaacagtgggaaaatagaggatgtgaggcaggctcgctcaggggctacagcccttcatgtggctgctgccaagggctactctgaagtcctcaggtattgtccatttacatcaatcaggagtggttcactgggagaagatggaataggttttggaagcagaggctgaattagattttccgctatgacgtgtttccttttttgttggtttcctctctgattgtgcagtcttttctcacattttgctggtattcatccatggattgtctccctccctcctaccattcctctagcttctcactaacatgtatgatgtgaaacagagttgaggtacatggtcctaggaggggacttcttccagttctctgatttgtcattaatatccctgcaacgacctcttcttgtgacctgtaatacttgtgatcatttgttccgttttgacttatataatttcttttgtgtcattagattaattatatagatcttgagtatgcgatgtccagctggcacaggatagccaaacttatatgagggatttggactctactactctgtctgttccatttttccttacatccatacatgcttcttgtagctcttggtacttaatgttcacaggctttcccaaatacatgggttgccaaaggcattatatgtgcagttgttaactggactcttccagtatttcatatttcacctaatgcagggtttttaataggtatagcagtgttttggtgctccatttctgcctgatagcgctatccataagggccccaatgtggtttgggtcttcaggagtcaaatcttttctcttccatgcatacaagttaaattatagctttatagttagcaaaaaattggagatatgtgggtatatggtaaatatagtgtcctagaaagaccaaccagaaggctagttgggaaaataccctgaagagaattgagtcttcattttattttatttttttaaactttatctttattgttgacactattacagatagagagaatgaccacagcctattagagtcttcattttatatgttacttcttccctgcactggaaaatggaaaatgtacctttaacagagttatgtgatttggctaattgaattatgctttggttaatcttaggtacatacgtttccgtatactccccttgtatggtgtaaaatggatatgcctaggaaatatcttatgacttttttgagaggattggtaaaggtcatctatgattggtacgcaaagtagttaactatgaaacccaaactgtgccttagagggcagaagtaatcataagacccctgtggttcagggccaaaatctgaaatatcaattaggtaatagtgtatttgccagaaaattgtaatatacagaagatatatgtcttgttttgggttttctttttagacttttaattcaggctggctatgaactcaatgttcaggattatgatggctggactcccctccatgctgctgcacactggggagtgaaggaggcttgctccatcctggcagaagcactttgtgacatggatattcgaaataaactggttagtgagcctgaacctctaaaagaacaacgagattggtggctgggtctctagaataaaaggcttaacatctcttttcaatggcagtctgactgttgtgaaatatacatcactggtagctataatgttaccctccaccaccctgcctctggccctattaacacagagttatgtttgttatttaaaataaaactccgtggaccttctgattgtatttatgttcaagcctctaaaacaggaaaaaaatatatttgttcttggcaaaaaatgagctttgaggagcctaatgttattgtctgtggtgaggtatgaaagattttattgttgctgtattcatgtgagtcattaaaatgttataatgacaaagatccttgagtttggctgaaaatagtgttattcggtctcacttcaaacaacttagaagctctggaactcctatccctatgtctactgattttattttattattattatttttgagacagagtctcgctctgttgcccaggctggagtgcagtggtgcgacctcagctcactgcaggctccacctctcaagttcacgccattctcctgcctcagcctcctgagtagctgggactacaggcacacgccgccacgcctggctaattttttgtattttttttattagtagagatggggtttcactgtgttagccaggattgtctcgatctcctgacctcgtgatccgcctgcctcagcctcccaaaacgctgggattacaggcatgagccaccatgcccagctgattttattttaattaaactaatttttttttttttttaatggtagagatggggggtctcactggtttcccagctggtctcaagctcctgggctcaagtgattcccagccttgccacttgtaatcccaaactctgtgtttaaaggatttggtgtttctcgttatgtgtcctctgtgatagatgaaggtattatcataatgtatggtagactagttagggaagcagttattattggaattaaaggcaaaaagtgaatattgaataatactgagtaatcccaaattgttgggattacaggtgtgagccactgtgcccagcccatatatgtactgattttctagtagtgcagagatatggccttttaattagtagatattcttatctgtgtcacatctctcctgaacccaggtttcattctcagactgtgggtcagggttcttaattatgctgatgcttcctaaaagaattaactttcttgtcagtcctcccctcacttaaaggaagatgattcctgtgatttaatctttattaaacatgtgccctgaacctccctctgaagttttgaagagccctttatggaatttatcatagcaattaagaccattttagaacagatacaagtagggatttcacttgattatttgccaggtggcagtaaggattagaaatggtgtgatttctgcagtactgttgtacaaactctatatttaaaggatttggtgtttcttgttatgtgtcctgtgtgatagatgaaggtgttatcataatgtatggtagattagtttgaaaagcagctattattggagtcaaaggcaaaaagtgacttttgaatagttccctactaataaagtcacgtaattgctgcttctgttttctatcagtcatggtgctccttttctctgccagggccagacaccatttgatgtggctgatgagggtctcgtggagcatttggagttgctccagaagaagcagaatgtggtgagtttctgattggtgctttcaaaagttttctaatagtttgcagttcacaccaagtatctcaatcacttgtttcagttgtgtctgctgagagttgaaatggacatatctgcattccagagatgttaattgttcacttcaggaactataaacagtctgttagaagaatatatcccagaaaccattattgttcaggttttttgctcattataagatagccttcaagaagctgaaagttaaaaacagccacaaaaaactaataattacccttgagttctagaaaatgaatgtgatatgttcaaatcagatgtttttccaaatagaaagtaccagagtggaggatacctcatagcttttctttttcttattgactaaaagactatctttatttaagcacatttattacagagaagaatatatttcttaaaaaataagtaaatacacataatactaaaactgtcatttcatataggagagtatttggtcagtgattcatacttactccagttttatgaaacatctagaattcagtcctcctttctctgctcctcattttgaatcttttattgtttggtcatgcatgtctttggcttaattagtgctatacaggagaactacataagtacggtatttttgttcagactgcagaatggaaaacccaccccatatacagatgaagagtgaataagccatattttttactcataaagcagatgaataatttgagtggggagaataaagattaatgacattagggtgggacattaggggccaaaaaaatcaatgactttttttgtttttgtttcttttgcacgtgctgtcactcaggtaatgtaaactaaagtttaggacaaatgtggaaaacagcagttctgaatcaaagaactatatagctcaatgatgggacagatcaaccatacctaatctctgttgtgttcagcattatgtctggtatggtaaagtgaagattctggttattttaaggctcagtggaaaagtcacatacataaaactcatacaaacacaacttaaagttcattttgttctctttgttgagcagtcaggatcactgaaactaggattttcaaatgcagtgtcaatgctgttatttagcagcaacagccttcctgattataagttgtatactttgcagagttaggttcttttaattttaaaaacttttactgaaataagtttagactcacatggaagttgcaaaaatagagagttcctgtgtattctgtacctagcatggtaaggtttttgaacatcaatagtattattcatgaaataatatttctacaccagtgggaatagtacttatctttgccctctgcataactttgagttccaggaatatgaatacattttgtctagagcatgcatctaaatagcagaccattttccctaagggcttatttcccattcggtacctgtgttttctttagaaatattgccaacttatttcagtatatgaatcataaagaattctttcaggttccttttggctttttatccttcagaatctagacttttttttttgaagattgggtttggatatttgataggagcagttttattgaagttcttaacaccatggcttttctcttctaccttggatgaattctgtcatctaaggagacccaactgatatgtttctctttttctcgggttccccactacctctttggtgttggtcctattttcttcagaatgacagtaccattttggttctcaatactgctgatttttcaccaatagtcaacttcttcccttttctctctgttttctccatttccagcttcgaagtgaaaaggagacacggaataaactcattgagtcagatctgaacagcaagattcagagtgggttctttaagaagtaagacatttaggcttgagtaatgggatgagctttgctctgtgtcagtgacatacttaacttcagaatttataaagtgaagaaactctgtgtttgtatttagccgagtgatctataaacttgtgggaaacttgtgggaaactttgtgggacaagagagtggcattgatatgtgagggagacactaaggatggttgactgtgttttaaacttcagaattaattgagactgtgtgcagcattttaaaatcctggcttaggcgctcttagtctcaacttttgcctctacttactgtaagtttcatgaactcagagacaatgtctattttgtttatgactataccagtgcctagcatgattcctggcatgtaataagtactcagtaaacatttgttaaatgatttttttgaatatttacccactgtcatcaaaattcatagttcttcttttttctgtgtgttaagcaggccagatttccttgagccatactctgtcgtcaaatactaaatcttagtctgcaaaaatgaagggtttggaagaacacacagatgtaaagaagaatttgaatatgtttctgttattgcttccacatataggtttatagacttgttccctttattatacctgattatcatttctgaattatactcaagttgtcatctttaatttagcaaagagaagatgctctatgaggaggagacacctaagtcccaagaaatggaggaagaaaataaagaatctagtagctccagctcagaggaggaggaaggtgaagatgaagcttctgagtcagaaactgagaaggaggcaggtaatgcaaagatgttcatagtgaagatcctctatctccatagtgtaagaagattactccttgtcagagagctagccaggcctcacaggactccaaaaagagcttgaagtttagttttcaaggataagatatcaaattgccagtgaccacctgatataaaaactgtgagctatgttagactatatctaccaattcctgtgtagccatatgataaggtgcacaaagaattcttaggtgaatgctgggtacggtgccttagcactttgggaggccaagtgcggtggcttgctttaagttcaagacagcttgggcaacatagcaagaccctgtctctacaaaaaaatttaaaaagaaaaggtaataattcttatgtgaggaatccaactctccttactccaggttggtaaatggcatagagaccaaattccaaaatgtcggtatgctgagaggcagagaagatgagatcttgcagaagctcttagggtcaaaccaactggtgaatacttgcatttaattctcaggtttgtctgatttcctaaacagaatcctaaaatctttttttttccctctcgtgtgagttggggagtaaggaaggaacaaaatcatatttacctttatggctattattgataatatatacctcatatagggcttcttttttttttttgagacagagtctcgctctgttgcccaggctggagtgcagtggtgtgatctcagcttactgcaacctccgcctcccaggctcaagtgattctcatgcctcagcctctcagtagctgggactacaggtgtgcaccatcatgcccagctaattttagtatttttagtagagacagggtttcactgtgttggccagctggtctcaaactcccgacctcaagtgatccacctgccttggcctccctaagtgctaggattacaggcatgagccactgcacctggccctagagcttcttaagtttattgtttgacaagacaggaaccccaacagtgagagtgagatgttgaacatggtcagaccaacaagctataaaataatccacaggttttgatttatagtcaggcaaacactgagaaaagaatagtgtacctaagccccattttcactgccatattatccctccaaactggagtccatgatgagatgaaatgtttctgctagaggggaaagggtcacacattaagtttacaatggagtctgtgttttcctctgaactctgccatggctggcctacctataatgaagatatttaacttactctgttgtctggccaccagctcctgatgaggtctggctttgctgatatgatttctctccatgatgggagaatactacccttcttcatgtctcagtctctgaggctcactgaatgtcagtcaccaaaaggaagttagagaaccatcagttctatagagaagaaaggcaccagctaagtttacagtataggagatgaccttttattcattgagacttgaacttctattattaatcatgcacagtatgctccggaaatggtattgtagtacctgtcagaatttataaatgttcatctttttgatatttgattatttattgagtacttacatgttctaggcttcaaatatttgcaacaagtatctgaacttgctctattctagatcacttttgttagttgccaaggtatgagaaaaattggagggatctgcctgaactatggtcattgctttgtgatttgtacccttgcgtcagatctcttgttctctgtagccaggtcttcacattgctattggcataaacacccacagtacccttttgattatgctacacctctgtttaaacctatgaccacctccctcactctatctttgcctacagagtaaataaaccccaagctccatagtctggccttcaggacttttcataatctagctctagctgacctttccaatgctgtacatagataaggacatattttggccaaactggactgcttaatttcctcaaacctgccctgagctttcctgcttctgaacatttgtaccatttaagccgaaattcatttcaggccatcaatgctcattgagtgatttctgtagaaaactataggatctagcaggttgaaaaagtctttctttaggtttttctaatataggaagctgaaaggaaatgggccacctcactgttcttctaccccacgactgttctctgtttatgtccctctagcactgcctacttaactctgctgtagcactcatcattttggctgggaactctgggtttattattgaactcccaggtctcagctcaatgcctggtacataacaggcattcacattcattaaatgttttttgttgaatatatccagtcagggaatagaaaggtgtatacatgaataaactacatgtcacatgagagatataagtgtagtcaataggattcactagtaagacacactgtatctagttcagggaattacaataaaactttacatttgtatagtgctttttactttgcaccacacttaaacatttttctttaatcctcacaaccatactctgaggtatgtattattatcactactttttagaatgggaaattgacactgtaggaggttaggtgaattaggtttcatagctggcaagtggtgtgcctaagatctggactttgatctgggactccccagagtagtagtagggacccagtggaaattatctgcataagaagtgaaaggtaaaactgtagaaaaggatgagatccccaaaggacagattatagatggattttatatatgatataataatgtggagatagttttcagtttttatctgaaagttggagttggagcctaccaagatgggaataacattgagtttatttttttctgccaacagttgcaagagtttacaagttgttagtttatatccaagcattacagggccttaataatctgttttgataatgggcaaatcttttctattagcagaaaaggacatagacacaaagataagatttttatactagtacttgttaattctcttgtcttaaataacagataaaaagccagaagcctttgtcaatcattccaactctgaaagcaagagtagtatcacagagcagataccagcaccagctcaaaataccttctctgcctcttctgctaggagggtgagtactttttacttaatttgggaattagatttcaccctactgcagtagcacacatctagaaaggccttaaaggtacattcttgcaaaataataaaaatacatttttcctgtcataatctgctcccataacaaaaaacacaggctgggtggcttaaacaacagacatttatttctcacagttctggaggctgggaagtctcagatcaaggtaccagccagttcagttcctggtgagggccctctttcttgacgtgaatataaccaccttctcgccatgtcctaacatggcagagagaaggagctctggtgtctctttctcttcttataaggtaaccagccctatcagattagggccccaccctattaacctcatttaagcttcatcactcctcacagacccttatctccaaatatagtcacattgggaattagtgcttcaatatatgaatttttggaggacacaaacattcaacccataacattgccccccaaaatctataagattattaccaaacaaatttggctaccatgtgttaagataacataagatagagtagtctgagaccaaagagattttgtcatttgcctattttctttgtatctgaagttaagatgcctacatgtaaagtgtggactgggctagaagatatctagcatccagcattcattgttttggtgattattctcctttttctatttctcctttaagactttcatgagtaaagtctttatatcttatgatgagtaaagggcagaggtagaaataacttgttgaaataccagaggcccctccttctgtaactttgtgcaggcctctgagaatctgtaggcttctagtcagtgagagtgagttgaatgatgaccctgctctacaaagtataaaagtcattttgaggttaagaattgatttgagttctttggaatgaagctgttgaaaaagctctgtggttatataggtatgaacttaatgatcttcttagcacttcatgaattggaaagatgggcttgtggtattcttgtggaaatgagagaacaaaggcctggctacttatttatccctagaagcatcatcgtgaataattaaagaggctttgaataaatgtaattctcactcatattcagtcatttaggtgtacctcatatactgccactgcttctaaggatgcctagacttcctacttttttcaatagaaaaatactaaattagacagggtgcagtggctcacacctataatctcagcactttgggaggccaaggtgggcaaatcacttgagcccaggagtttgagactagcttgggcaacatcggaaaaccccatctttacaaacaataaaaacattagccaggcatggtggcacacacctgtagtcccagtgacttgggactgggaggccgaggtgggaggatcacttgagcccaggaggtcaaggctgtagtgagctgtgattgcaccattgcactccagcctgggcaacagagtgagaccgtgtctcaaaaacaacaacaacaacaacaacaacaacacacacacattctactttgctaaaatgatgctggggaaggcattttcccccttagaatcagagtagcttgtaaaaagctgacattattgaacccctaaagctggaaggggtacgtaaatgtgtacattcagatgactgatgaaaagagaaaatctatatgtgagttggagatgagtgatttaatatttttatttattttcgctgtatcaggcagtaaaggtagcctgatattggaagaaaggcttaaatcttcttgaaaaggtcctggacctcaggaagggtctgttggcttgtgttccagagactagctgtaccccaaactggtccttggcctaatgctggtctatgatgtttccctagtttatggcaaaatgagataattaaggacaatgtaagctttccataaagctttcttttctgatattaaaatttcatttttaacaaaattgtggtaatgatgagttgttcaaaaagaaaacatctttcagaatgttgttttcttttgtcaaaattatatttaaaagataaaaagatagcaaccctttgacctctagttttttttttgtttttttttgttgttgttgtttttgctggtcagtgaaatctaaagctctctaaactgctactctagatcaaataaattttcttgaaattagcagttagaatttgagtggagtggcgtctagaatttttatcagtgttaaatcactgtatcatagtaccttaaaatgtgtttataaattagctcattcctggcagggcatgggttcatgcctgtaatcacagcactttgggaggctgagatgcgaggattgctcgagtttaggactttgagaccagcctgggcaacatagggagaccttgtctctactaaaatttagagaaaattaactgggcatggtggtacatgctgatagtcccagctactcggtgggctgagggggaggattgcttgggcgcaggaggtcaaggatgcagtgaactctgattaggccactgcactccagcctcggtgataagagtgagaccctacttcaaaaaaataaaaataaaagataaattagctggtctcattttttccagtctccacatattataaggagggattaagctcattaccgtcattttacaggtgagcatgttgagacctagagaagtaaagtatcttatattcagttccacggtgagttagaagaaggtatattactagaatacaatctcctggtgttccaggtcattattaattgcacagagatagcaaatttctcagaacaaccctgtcaggtaggagcactgtgtgaagaatccgaggctatttttggcttaggaagaaagagcctggagaggttattagcttttgctgggtgagggagggaacatgggcagaaagactgccatgtatttgttcttcttagctaccttatgttgcctcgctgaacttagttaagtgtggaaaaggcaaataggctgagaaagaatcatcagagcctttatttttcatttcttttatttgcttctctcatagttctcttctggcctttttaacaagccagaagagcccaaagatgaatctccttcttcatggagattgggactgagaaaaactggcagccacaacatgctgagtgaggtggccaattccagggaacctataagggaccgaggctcttccatctatcgctcctcttcaagccctcggatttctgctctactggacaacaaagataaggtgcagtttgggagggtatgggggaattccaaggcagttttttttttccatgaaaattcaatcttaggaacaaatgaaaatattttctagtccttaagttgattttggaaatgcaaagtctttaaagagagagaggcacactgatagtttattcaagtagctatttgcttgctattgtttgcttgaccaaaaaagaaaataaaaaagctttaaaaatagcttttccttttggtttgttcaatcttccttgcccccttacctaaagcaaaaaatggatcagcaacataaaaatttcagtatggcggaggggggcacaggaccccaggtaggggtcctggatccagagggccaattcccgtccccccagcggcatggcttcgtgtgctgaaccctctaagccctctgcccccgcctcctgccagggtcccaccgcttgaggacttcaaggtgctggatggggtggaggatgcagagggcgaggaggaagatgacctgaaagagctgcccccgctgggcatgggacagcccccggtggaagaggctgaacagcctgggacattggccctagagttcctcgctgccatggagcctgagcccgccccgtccctggccccggaagcagctgttgaggaagaagacgcttgtcccagggccgccgggttcaagccgcccagtcaagggccaggtggttaccgtgcattttgcagacgtcgtgagagaacagcatgtgggagctggtgttcaccttgaacaactgtgacgtcatccaggccctggatcttagtgtctaactcacggacgtgggggagacggccatggtcactgctgactccatctactgctatagcccccagggcaggagcccatacatccaccgcacgcggccctgtgcctggaggtgaccccgaagacggccgtggactggcctgacctggagatgctcacagggcaggagcgcatggccctggccaaccggaagcaggagtgcggcagtgcccactaccagtgggcggacttcatcctggccgccaactcctatgaccttgccatcaagaccatcacctccagcgccaaagtggacatgacgttcgaggaggaggagcagctcctgtagttgaaggtgaagtgtctgaacaacctggcggcctcgcagctgaagctcgaccactactgcgcagccctgtgctcctgcagcctcgttggagcaccatccagacaatatcaaggctgtcctccacagaggcaagatactggcccagcagggtgagtacagtgaggccatctccatcctgagggcagccctgaagctggaaccttccaacaagacgatccacgcagaactcttgaagctggtgaagaagcacgcggcacagcggagcacggagaccgccctgtactggaaaatgctgggcgaccccagctggctgcccgccaagtgccccggcaagggtgcctggtccagcccatggaagtggctgtttggggcgactgctgttgccttggggggtgtggcgctctctgtggtcactcctgccaggaactgaccacccaggtggccgccaccccctctgtacaccatggaccctgccctgtgctccataactcccccaggctccctgtccactgcccttcctggtccggcccccttctccaagttggaggcagcaaggactgggggttgtgcagcccagccagcaggagggactgaggccctctaggaggaatgcgcagagtgagggggacctcattccttcagacccactttcctccccactccccttctcctgctgggctaggtctccactggggccagcctcagtttctcctcaacaggtttggggacagcccctcctgccctgcttgccccacactgtctaggctcacttcctgccacagtgtaataaagcctcctaccctgcaaaaaaaaaaaaaaattcagtatggcctaagaggttctctgggctttgagtccaaattaagctcaggcaaattagtacttagaaaaaaaaaatttttaacttgtcattctttcattaatatggaaaatgtggttaggctaacttcacacatagtttgtgtattcattcaagattagtaaatttttattttcttcactttttagttccagattttataggactctctttgtgcttttctctggggtcacatcttccttgtaatcacagtcctcttgctttatatctctggagactactgaaagagatgaggcatattggttgaattaactctgcagcatactattgtacatattcctaaggaagctgtatttcaaggaaaagatgtactggggactattggggactacataaatcttatttcatcaagaatattagagtggagctttctgtttgtgtcttcaaaggctttcctcctctcttgacagaggtgctgctttgcataatttgtgctgctgttttctttatttactcatcctgactttcccatgagaattatttcccttcatactgttttttaatggaagaaagttaggaataagcttttgaaagctaaccttttgtaaataccactcaaaatagaattagtgttggatccagaaataagatgatataggtatattaagttctgcttttttactcaaaatgttttatgctgtgccagtattgtacctttcttgtgctttacttgtttttattttacaggagagagaaaacaaaagctatattagttcactagcaccccggaagctcaacagcacaagtgatattgaagaaaaggagaacaggtaatcctaaaaccagccaaaagatggtcctcatcctcttaggtctactggacatagtcatctcctgggcattactcttctgcatttttccctcaggtgtccttaccacattatgaattgtttattccttctgcttagaacacctctcaactcttatatccttgctttgctggttctttatttttcaaattctaactccaggttagacattaccttctttaggaagtcttccctgatttttccacacatgcattagttttattctaccagcaggctctgtaaaggtagggtctgagtctgtctggtttcttaaggacccctagttcctagcacagtgcctaacacatagtaaacactaaaataatgttatttaattaaattgaccaacttctaatttgtcagaaggtaaaattaaagtcttcctaattagttaaaataaatatagggattttgaagtattgctgcatctcagggcaaatgtgatctcaaaccttagccagcggtattggcatcacccgggtacattttatttttattaaaaataattttctttaatagaagcagggttttgctatgtttcccaggatggtctcaaactccagacctcgagtggtcctcctgacttgccctcccaaagtgctgggattgtaggtgtgagccactgctcctggcctgggtgcatgttaggactccagaatctcaggccctactccagatctactgaattagaatctgcattctaacgaaattccctaggtgattcaaatattaatacacattaaagtttgagaaggattgttctagagaaccttgtgaagcatggaaacccataggttttgcaacaaagaccctgagttatcaattgtggatcaaaaatcctagtacagcactttcctggataccttttcatttataatgctaaagaggcttccagcaagacttctttccctttccccttctgtagtaactttttttctcggtaacagacttcttcatcttcccccatcatttccttatctgcttaacttaaaagccacgtgctactaagactgattgcaacacacttttttctttatttttttttttgagacaaagtctcactctgtcgcccaggctggagtgcagtggcatgatcttggctcattgcagcctctgcctcctgggttcaagcgattctcgtgcctcagcctcccgagtacaggcatgtgccaccatgcctggctaatttttttgtatttttagtagagatggggtttcaccatgttggccaggctggtcttgaactcctgacctcaagtggtctgcctgcctcagcctcccaaagtgctggaattatagatgtgagtcactatgcccagctgcaaagcactttttaagtgaggatcaaaagtgacttcttattacaaaagggttagagacctttgacatgaggaatttggtacctgttgaaattaattggttcaaagttgataaaagaaagcaggcagtaatacttctcttctgtacagaaaactggtatataaaacagaataacctgaagaatgtgtctattagccatgttatagtttgcctgtctggctcttctctctctgcattgtatcatggacaaaaactggtggtaggaatcagtgttttgttttcctttcatgcttctacagagaatcagctgttaatctagtgaggagtggctcctatacccggcagctatggagggatgaagcaaaaggaaatgaaatcccacagacaattgctccctccacctatgtatcaacttacttgaaaaggtaccaggctcaaagggggtgggagatgtttctttcactctagccatgggaaatgggtaatgattgtatgcctttttatgtccaattaacaccgcagaaatgaatcaaaatgaattactttcaggtttcttagaattaacatcttgaataatttaaaatttattatcttaataattgaattaaagtaagctaatttcagattctcactacagatctggctttatactttatcctctccatcctattaaaactttcaatcagaagtggctttcagtaatctctgggcaagactgaatttaagttatccttgtccagtagctggttctccttatctgaaacagagtagttctcatcccatgtgctatttttggggggaggaagggagggacactataaagtggtggggggtgggaaatggggacagttttctattgcattaaagaagtttcatactgaagcctgttaatttagggacttgagttgttttttttcttatgactttaatggccctcagatccatcaagatgtgaaactcgcaagtttggtgcagagaaggtacatgggtttccttcttttctcatctgtattcccttttctgcaattattttctttgccacatactagccagcaaaccaggcacctttgccagagccattaagctacaaaaatacttaatattttaatttgaactctgctgctaatgtggaagaatctgttttttattgcttactttgaattctttcttcacttccactgtcttctcacaccatagccttcatcattaggttttttagatgattggttggctaccttagaaacaggccctggcctagactagatgaacacattaactctttggaatcaacacttatttccacttgacagaaagacttgtcaactagttattgttgaaacatgggaaatagctagaaaacaaacagtcactgttgccttttaatgttcttcagttctgtagatacattctataagaaagggctcaactttggaagtatgaaagtttgatgatctcactgatgctttattacacaaaagaggtgtttcttgctttatgaggctatcacctatttgtcttaatggctaaggccttggtcttcctggatgcattattattcattatagttgaatccaagatcaagaaaacttttctaagaaaacaatgttctagatcaagggaagggagaaagctgccatttaatttccaggcatggagttattctgtggcgaggttgttgatttttgtgatccaaataatcagcaaatgggttgagaggcatttggtttgatagatgtagtttggcaaagttacggtgaacagtgaagggacaggctgcctctatttaggatcaaaagcatgcttaatgatatgagcactttttgaggaaaagatgtacaacttgcttcatatcttggatttccaaagcttttctcctgtaaccctaaagcattttttgattttataaaaacctcttatggtctttttaaaaggaaagaatcatatgccatcaccatttaaaagagcaagtgtaaggagaaatttgtcatttcccagctatgccaaaccttcatatacattccattttcatctttgaaaatgagaatgagagttcatctcttgtgtataggcagaaattcctttcatatggcccatattaaaatacctcttttccaaggaaggctttatagctttttttggttatctgctcaagtgtctcatttctattatagtcaagaagtatttttgaaatttgaacccaaataattttttcctgcaattgagatggttcttacctgtcttcaatcaaaacaaatacaagttgccctttattgctcatacagtattactttctagacttaaaactaaatcctcccagagacaattttgctttaggctgaataactgcagttctcaaagtcattttttttcacagagcttctttactctttccacttttaaattttaaatctctgctccacaacctctccaaattctctggtcttacttttgcttttgcagtgctaattctgtatcaggtagacatttggggttgcatgattatttgccttgggtttgttgggaattacttttttctaataaaattatcctttttcctattattccctttcttagcctctcctcttatcatatattctactttcctgctttccctcattcagtatcatctctcttcctccacgttccttcactcttttggatgattgaccaaaaagaccatccttcaaagagtgatgattccttcattcttttggatgattgcctgcttgctgccagtgactcagctctagctggagttgatcacttcacttcccagttgtcataccctttctttggtctatattcatttcaagtgcacaatctgggtgggaaggtggtgctgggaaatggtgggtgagcagcatgtcctgaagaaagtgactgtgtgctgttttgcagtgcttcatttggtagaagtagtgaccccacaagtccctacatttcagccaatcgcaattcatctcctgctacctcacccattaccattggttcatctacctctcggggcagccagtggcaacctgcctcttcttgccctgcaccaatcagtgcaaacactactgcatctgtacatcatggcaggtaaggcttcttgaagccatttgagttgcattcatcaaagttaatggctctgaaaacacatatgaaatttgaaccaaagagactttatcactataaaaacaagttagaactcctgagaaaatgtctgaatttaatgaagatgcttttgctttgacttgtattaaccagtcaacagttgcatattgaataatcaaagggtatgtataattgtacttggtgtttggacatcagcttaatgtgactgatttcatccctcaacaacctaaccagttgtgattacaatttaaggatcatactattgtggtaaattaaatattgaaaacattttcatattttacttctattaattttccagtaattataataggaatctcttgtatttagtcttttaaatgacatgcaaacccaaatcagaaagaaagctaactcattttccaaaagcctatgataaccttctgaaaactcccagccaatgagagtattttgctggaaacattgtgagaagggacagatttgtgtttgtctaaactgtgttgtgggggcagtatcttcttggtttctagttcatctaagggatagcatggtagaatgttactgtgaaagtacattaggactttagctgtagttttaactgtggcttttaatcctttatgtgtgctggcaaagggtctcttttttttgggtctgtgtctacaactgataaagaaaatgaaaaaaatcttaatgatagtgttgttgcaggaacaccagtgatggtgcttgattgatatttgtcagtttactagatttctttccctaaaataagcggtaatcattaattcagccaggagggaagggtttatgatggattattaataataatactgtataattataggtaaatttattaggtccttataataatccagttgcatagacatgttaactattatcaccatagctgaagaaacaaacatagagaggttattattactatattatattactctctctctctctctctctctctatatatatatatatatatatttttttttttttttgagatggaatatcgctctgtcacccaggctggagtgcagtggtgcagtcttggctgactgcaaccttcacctcccgggctcgagcaattcttctgcctcagcctcccgagtagctgggactacaggcgcatgccaccatacccggctaattttttgtatttttagtagagacggggtttcaccgtgttatccaggatgaggatgatctctatctcctgacctcatgatccgcccacttcggcctcccaaagtgctaagattacaggcgagagccactgcacccggccgtattactatattttacatatataatattatatattatataataatactatattgctattactataactattaagagctgcaactgagagaaaataattacagctgccatttgttggaccccattatgtgacaggcatttggttggctattatactgggatttagtttgctcatatgtaacgataaatctaaatagtagtggcttaaataaggtaaaggtttttttttttttcttgcacttaagaaagtccagaaatatgcagagctggcttagtagctccacagtcattaaaggatccaggttctttcgctccacagttcttgcatcatggctgccatttccatgggttgcctgatggtccagaataactgctgaagctatagctatcatggctgtactctagggaagaaggaagaggaaagaaggaagcagacaaagaaaaaatgcttctgaactgagaattttcccagaagtactagttgtctgcatatgtctcattggatacctctagtggccaggagactttgagaagtgtggacttttaactaggtatattgctgccctcaatgatatagggattcagttcataaagaagaaagggacaatggatatgggttagacaactagctgtctcatgcatacatatatcatctattctcttataatgagccccctattatatgaagtattattttatagacgaggaaactcagaccaaatggttaatcatctgcccaaggtcacacagctagtgagggcctgagataggatttgaactcagatttgtacatttcaaagctcttacctattttgtcactgtttgtatctgctgagtttatattttattctgggtactattttaggtgtcctgcagacattattttatttaatcattagaagaaccctgtattttaaggtgccactatctctattttatcaatgaagaagagatcagagagtctacatttaagcaaatgttgtgtttccaaagcccatatttatcctactccattgcatatcctctgatctctgctctagggctgttcttattctaacaatctacttgtaaaattacactgcatttcaaaataatagtaaaagtcctattatgtaatttaataaaataaaatccttggcatttcaaaagcataagaaattacagtgagaccaaaacatgttagtaacctaaaaagaacttcaggtaaggtttggttaagtgtaattttttatagctgtgtgtctagctaattttattagtacttcctatagattcgtatcttgtaagtctgaggaattttttgccttttctttttttgttaaaaaagactataaaatttcaccttttttcttagtcattaattgcttctggagaagtagcatgtgtttttttagatattacatgtatcttttaaaatattctgcctttatgtttgtatctaggtaccatatttatatttttatgtttttattattttttttcaagcttgtaatttgattatttggaagtaagcttagagctacccgtgaacatttctgctaataattgtgagtaggtgaaaaaaatagatttttaatatttgtgcttttcattgctttctccatctctgtatcagttttggacctctgttaccccagcaacagctgtgacatcacaaatgatagctttttgggtggagagccaatggttgctcccaactcttcgataagaaacaaaggtcttgttttcatgtaaatgagtttaattatacagcttgctgttgaaaagtctgtggttaaggatacttatagaatccggtttggtttttgtttcaatttctcacttttgcagttatgaatatagacaattaggcatttggttaaatgggaagagagagcagttgctgaattaggtgagggagaactaagcatactgagactgtagagtatcagttgtctctggataatccaagaagatggtcatcaaatctaggctgaggactaccacaaagactcccactgccaagaattaaggaacaggtggagactaatattgtaagtgactttaatgtctttttcttgtgtagagaggccatgtctccgtgtgcatgtgcagagaccaggtgctactggggtgtcatttaaaacactcttgcatatgtcactatcttgccttgtgccatagctaatgatttttgttaaaacaaaatctcaggcacacacatacacatacaagtctcataaaatgtgactcctcaggcaaaggatgtcagactaaacatgtaattatactattccaagctgtaagagctcaaaattaagaaaccaacaaacaaaatcagagcgagatttcctagatgaaccactctttaatccttctgtctctgtgccagtgctttgttgtatagcatgcctaaccatttcctttctgcttgtatctttttaaatttcaggactcctcacaaatcccaggccgacacaacagcagagaaaacagcagacaatgtctcttctagcaccccgctctgtgtgatcaccaatcgccctcttcctagcactgccaatggggttacagctactcctgtgctctccattactggaacagattcctctgtggaagccagggagaagaggaggtatgttgagttactgatttcatttgtggggctctgctttgaggtagacgataaaggaatgggcataaagtgtttttcccaatttcaaatacgtttatgaaaatatgtctttttttttttttgagacagagcctcactctgtcgcccaggctggagtgcagtggcgccatcttggctcactgcaacctcctcctcccgggttcaaacgattctcctgcctcagcctcccaagtagctgggactgcaggcgtgtgtcaccccacccggctaatttttttgtatttttagtagagacggggtttcaccatgttagccaggatggtctcgatctcctgacctcatgatctatccacctcggcctctcaaagtgctgggattacaggcctgagccactgcgcccagcctgaaaatatatctttatattattgttctgtattttgtctctgagcagtcagtttttggtgactcaattatttatgattatttagcatagacacttaacgccgttatggatttattttttttatttttttgagacggagtcttgctctgtcgcccaggctggagtgcagtggcgcgatctcagctcactgcaggctctgcctcccgggttcatgccattctccttcctcagcctcctgagtagctgggactacagctacctgccaccatgcccggctaatcttttatatttttagtagagacggggtttcaccatgttagccaggatggtctcgatgtcctgacctcgtgatccgcccgcctcggcctcccaaagtgctgggattacaggcgtgagccaccgctcccggctgtcgttatggatttaagcatatcttttttctgtttgtcttgtgatagagacaattgttaggcattatttcaccattttgtaatggagaacctgtgaagcacagagaaggatcttttgttttgttatggatagtctacgttgacttctctggcagcaaagaaaggaaacagtatgacacaaggctcaaagaaatagaactaggatataaacttttgattaatttgagaagaataccagaaaaagaaatgaataatatgtgatgatatggtagaagaatagtgactagatattctgtaatttctttagagagaagttatgagagaatattgtgaattgacatagaagagatttaaggtagaagctaagaaaaactttttgattgccagcattaagagaaacattagaaaatgtgaccgagcaagaatgggtcattttctcctacttgaggaagtattaaaaatagaatgtactgcatttgggagtttcaaatgtacttaaagactaaggctataattatcccttgttaagattagaccaggtgaaatcttatcaaaatttagatttcagtttgacttcatattattttgaatatccaaaggaaggagcttttatatttgtgtgtattaagagattgtcttttctccaatgtatgttcttggcacctttgtcaaaaatgagttcactgtagatgtatggatttatttctgagttctctactctgttccactggtctatatgtctgtttttatgtcagcactatgctattttggttataatagctttgtggtatcatctgaagtcaggtaatgttattccagttttgttctttttgcttagggtggctttgctattctgggtcttttgtagttccatatgaattttaggattattttttctatttctgtcaagaatagcattggtattttgatagggattgtattgaatctgtagattgctttgggtagtatggacgttttaacaatattgattcttccagtccatgaatatggaatatctttcctttatttgtgtgctgtttaatttcttacaccagtgttttatagttttcattgtaaagatcttttagttatttgattaattcctaggtattttattttatttgtaactactgtaaatgggtttacttttttttttaatagtagtatgatttatttattttttattttttatttatttattttttattgatcattcttgggtgttcctcgcagagggggatttggcagggtcataggacaatagtggagggaaggtcagcagataaacaagtgaacaaaggtctctggttttcctaggcagaggaccctgcagccttccacagtgtttgtgtccctgcgtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacggcaaccatccgatttctcaatcttttccccacctttcccccttttctattccacaaaaccgccattgtcatcatggcccgttctcagtgagctgttgggtacacctcccagacggggtggtggccgggcagaggggctcctcacttcccagtaggggcggccgggcagaggtgcccccgacctcccggacggggcggctggcagggtgggggctgaccccccacctccctcccggacggggcagctggcctggtgggggctgacccccacctcccttccggacggggtggctgctgggtggagacgctcctcacttcccagacggggtggctgccgggtggaggggctcctcacttctcagacggggcggctgctgggcggaggggctcctcacttctcagacagggcggccgggcagagacgctcctcacctaccagatggggtcgcggccgggcagaggcgctcctcacatcccagacggggcggcggggcagaggcgctccccacatctcagacgatgggcagctgggcagagacgctcctcactttccagacggggtggcggccgggcagaggctgcaatctcggcactttgggaggccaaggcaggcagctgggaggtggaggttgtagcgagccgagatcacgccactgcactccagcctgggcaccattgagcactgagtgaacgagactccatctgcaatcccggcacctcgggaggccaaggctggcggatcactcgcggttaggagctggagaccagcctggccaacacagcgaaaccccgtctccaccaaaaaaatacgaaaaccagtcaggcgtggcggcgtgcgcctgcaatcacaggcacttggcaggctgaggcaggagaatcaggcagggaggttgcagtgagccgagatggcagcagtacagtccagcttcggcttggcatcagagggagaccgtttaaagagggagagggagaccgtggggagacgggagaggaggagggggagggggagagggagagggagaagggggtttactttcttgatttctttttcagattgttcactgttggcaaataaaagtgctagtgacttttgtatgttgattttgaattctgcaactttattgaatttttcagttctaatagtttttttggtggagtctttaggtttttccaaatataagattatctatctgcaaacttcttcctttccaatttgtatgtcatgtattactttctctctctctctctttttttttttttaaatagagatggggtctcactgtgttgtccaagctggtctcaaactcctggggtcaagccattttcccacctctgccttccgaaatgctaagattacaggcgtgagccactgtgcctggcctattgctttctcttgtccgattgctctaggtaggacttccagcactatattgaataacagtggttgaaagtggacatccttgtcttgtttcagatcttagaggaaaggctttcagtttttcgccattcagtatgataatagctgtgggtttgtcatatatggcttttagtgtgttgaagtatgttccttctgtacccagttttttgagggtttttatcatgaaaggatgttgaattttatcaaatgctatttcagcatcaattgaaatgatcatagtgtttttatctttcattctgtcaatatgatatatcacattgattgacttgtgtatctttgaaccatccttgcatccctgggataaatcccacttggtcatgatgaattatctttttaatgtgttgttgaacttggtttgctagtattggcctgtagttttctttttttgatgtgtctttgtctgatttggtatcaaggtaatgttggcctcatcagataagtttggaagtattccttccttttctgtttttcagaatagtttgagtaagattggtattaattcttctttaggtgtttggtaaaattcagcagtgaagccatcaggtcccacgtgagtatgtatgtatgtgtagtaagtataaaagatacaatacaaattaaacaagatgcaagatacaatacaaatcgaactttttatgtttgcttattgtaaggacaggtctaatatgtctattataaagacacttttttttttttttataaagacacattttgagaaggaagggagatgttgagttggaaaatagtgtttttcttcttcttttctttcctgtcctttcttttttctttttttcatttctttacataaaatggaaggaaactaatttctgggctaacaggtttcagagccaataactgtcttttcaaaattggtctccagccaaggaaatagtaataaatcaatgttgaatagtaaatgcttctatacttaatagctcaaatgtaatttagatactattagtttcacctagaaactaaatgcaaaagtaatctctagctgacaaaaactctctttaaaaaatctttctgagctgaaagaagtaaaatgagttaaattcatcattaagagcatgatcccagaaaggatgggggaaatcaggtagtttataaaactgcattattaaataccttgttgcatgaactgttatttggagaaacttagttttactgccttctggaaatgttgtaacctacaatcaataagatagtacctgtaacagagaccagatatatgaatcaaagggttaaatcaaaatattagtgaattatgagttgaatgtggtacatcaagtacaggtcaaaataagtgcattttaggaatggcacaagataagtaagtagggagatgttagatgtagactggttggactcattcactggatatgttctagcattcattcatcttcaaaatacttactgaatattttaaagtacctgttgccaggtgctatgagaagcccaggtgatacatcagtgaaccagacaaatatgatgtgagcccttgtgaaacaaatatgctagtgaaaaagaaaaatgtaaataattatatttgtgtaatataaagaagtagtatgagttgttataacagtgtcataccgaaaatctgctgacagaagacttcccttcttggccaggtatggtagctcacacctgtaatcttggcactttgggaggccaagttgggaggatcacttgagaccaggagctcaagaccagcctgggcaacacagcaagaccccatgtctacaaaaataaaattaactgggtggtggcacatgcttccagctgcttgagagcctgagatgggaagagctcttgagccccggagtttgaggctaccatgaactattataacaccactgtactctatcctcgaccacagagcacaaccctgtctctaaaaaaaaaaaagatttcccttctcctggaggatgaaagaaggctctcatgagggtgtgatactgctcaacctgagatctgctggttaagtaacagctaagtgaagagaagggagtgggcattgcaaacaaaagatctggcaattgaaaagatactgaggtggaaaggtacttgatcttttggagaaacagagaaggcattgtgactaagagtaaagaatgagggagagaggtctaggatgaagcttgaggagtaggtaggagctatatacatatatatatatagagagagagagagagaattcacataccatacaattcactcatttaaggtgtacaatgcagtggtttttagtatattcacagatatgtggagccatcatcacagtaaattacagaacattttcatcatcttagagagaaatcctgtaccctgtagctatcccccacaatctccttattccccctaggcctaagcaaccactgatctactttttgtctatagatttgcttattttggacattttatataaatggaataaaaatacaatcttttgtgcctgacttcttttacttaatataatgttttcaaggttcatccatatgatagcatgtatcagtactttattcctttacatgggtgaataatattccatcatatagataatgccacattttgtttgtccattcataagtcaatggacacttgagttgtttccaccttttagttattatgaataatgttaccacaagcatttgtgtagaagttttcgtgtggacatctggtttgatttctcttgattatatacctaggagtagaatttctgggtcatatgccactagaagattttaagcaaaaagtaccatgacgtgacctatagtttttaaagttctgacttttaaactctggctgcagttttacatatgaattggatgaggaaaaatacacaagaatgggtgtgagatgaccagtaaggaaaccactgcagaagaaaggctcatgagagagaacagtggcttgcactgagataatggtagaagagatagagaaaagtgaatgatcttggccaggcacggtgactcatgtctgtaatcccagcactttgggaggctgagggggttggatcacttgatgtcaggagttctagaccagcctggccaacacagtgaaatcccgtctctaataaaaatacaaaaattagccaggagtggtgatgcacgcctgtaatcccagctactcaggaggctgaggcagtagaatcgcttgagcctgggaaatggaggttgcagtgagccgagattgtaccagtgcactccagcctgggcgacagagcaagaatccgtctcaaaaaaaaaaaagaaagaaagaaagaaagaaagaaatgtgaatggtttgaaaatacgtttaggaggataattccgacatggtagatggaacttataaggctcccttgcccattataaacagaaattcatagttgaattcagaagaataatagggaactctcagatgacaaaagtgaagagtactcaaaagccagagtagtttgagtgacccagggttggtgtcagacctatatgtagaccataaggtctggacactcagattttaatgccgtgtgtgtagaacgcatggctgtggacctactaaggctgcaagttgtaactaagaaactatatcaagctagaaatctcaaagggttcatgaaaagggtactttgcccatagctcaaaggagtggcaaggaaggaaatctatacaagcgtcagggtagggcagatgactcacttgtgagaaattttcactattcgtatagtttagaaatcccaaaagtcaaggatttaatacagaaactgtgtctgtactcttgaaactctggggccctggcacaagtaaattcaaaaccaccttgaaggaacacatctgcaatccagagtaaaagactgtaaactgtaaaaacagtttcaaccaaagatgaattcacataaaacataaacactgaaggtcaccatgagggaagagttctatgacaaactcatagatgcagactaacatgtaataaaagttttaaatgcagaaagaaacctcaaactattattggaataggtaacaagaattacagttgaccagctgtattgaagatagacacacgtataggaacagtttggtaaatgaatcaggaatggtttttaaagtataagattttgcaaaatagtattatctatatagaatcttgtttaaatgggaacccacatatataaagcacctaacaaccatttattgagagactgccatgtgccaggcacagagacattaaggatacgagaccaaagaaaacatttttttggctgggtccagtagctcacacctgtaatcccagcactttgggaggccgaggcgggtggactgcttgaggtctggagttcaagaccagcctgaccaacatggcgacacgccatctctactaaaaaaatacaaaaaattagctgggcatggtggcacgtgcctgtaatcccagctactaaggaggccgaggcaggagaatcacttgaacctgggacgcagaggttgcagtgagctgagattgcgccattgctctccagcctgggagacagagcgagactccatctcaaaaaaaaaaaaaaagaaagaaagaaaacattttttctacccttgaggatataactattatgggaagtcaaataagtacatcaaatattattgtataattgttaagtgctgtggtaaagatatgtatagattgctatgagagcatagaggaggggaatctaaattagattgaatagggtgacaaggaaggcctaccagaggaggtaactggagttgaattttgaaaggcaactttaagttaactataagtagtaataggaggatggtatttgagaggaaacatgagaaattcaagaaacaaacaagttcagaatgcctgaagctgggagaaggtgaggccaggctagcatatctgaaagtgtcttttgtggaaacagatttagatgaaggaaaaaaaaaaaagtattctgtggctaaatgaatttgggaacaatggattaaacaaaattaaataggatcactcaaaagccttcttagggtcattcctctctggggaatggggagagtgggacatgggagtggttagggaatttgcagcattttccaaatttctgagtccatctagtagttttgtttttcaaagaaacccaagactggtattccactggagaaactttggaaattgtcaagctagagaggtaggcaggaaccaaatcatgtagatttttgtctgtactatgctaagaaatttgaatttctagtctcaaagctatggaatacaattgagggaataaataggatcactcaaaagctttcttagggtcattcctctctggggaatggggagagtgggacgtgggagtggttagggaatttgcagcattttccaaatttctgagtccatctagtagttttgttttgtttttcaaagaaacccaagactggtattccactggagaaactttggaaattgtcaagctagagaggtaggcaggaaccaaatcatgtagatttttgtctgtactatgctaagaaatttgaatttctagtctcaaagctatggaatacaattgagggatttccagcaggggaatgacttgatcaaataaaacatatcatttaagcctttacagaattaaagccatttagtttctctggctagacaagcataaactgaaagaaaaaaaaatcagatgttttgaaaacagctaaattttccttctgaaagagcatgctggatgctaattctactcttgaagctgcagctttctctgtaatcagctcattgtggaagcattttgactcctactgggaaaccttgataaaagcctgaagcctgtgttcacaggtccaatttcaaacaattagtgagcattgggataaatggggctttaaaactggccacagcaagaccaaagtagtagaaggttctctctcagaaataatctccatttgcagtgtaattaaagcacttcagttggggagtgggttttaccattaaattgcacagctggctctccttttctgagaatgttttatcttaagaggggataagtgggtatgtgcataccaattggccaatgatcagtctcagctttacacccttgtgctaacagttctttactcagtttaactacagatatgttgctaaatgagcaaagctagatataaaagaatacattatgatgccaaatagtaataaacatggaaatgttaatattggatttttgggtgtattatggatactttttatttttattttttctgtattttccaaagttccagaatgataaaggattactgttattatggggcagagggagcaggagggcatgaaggaatattaattatagggacaacagtctttcttataatgtaagtctgtgaagaaggctgtgatcgttgaagagtaaatataatagagattcaaggtttgcaggattctagataatttatggttttgcatacacagtacagaacttgtaaaacagtttattcctttttgagaagggcataatcttggatttgtgaagttcctttttttcccccctgaaaagctcaagtgtgcttgaatgtattctctttataagatggaaaggaatagaacaatatgctccctattttacaaatgggaatgctgaggccctaagagcatagagtcatttgcttaatatgacactctgagtcagaggcacagtagagaccatcacctaggccttcttttcctcctcattgaatttactgaccatttcttctattgaatttaagtattatccattcagaataaaggttttgactcaggggccagtccacagctcagaatgcaacagtctctatctttagggctttctgataactgccattcagtctttggattgcttgtgagaactatagaaaccaacaaggtcatctgattataaagggactgatttgacaggacagaaatggcaagtggcaagctgttggcagatagctctgcagaaataccagggccaggcagcagctgtcacaatagggtagtggttgggttcattttccaaagctccaagttttccttagcaacaaaatgtaaacaattcccattgctaatattagagtctaatagtgtctgactttgattcttttgtttttcctttagctttttctctctcacccaaccctgaattttacctcttttttaattgtgctctttcttttctttgtagaaatggttaaaaatagtttttctccacaataagctaaaattgtctttcccaaatagctcacattacatatgactctgctttgcttggtcaagatacagtgagtactggctgagtcatatataccacacttatggaccttcttcagtcccttggggtctttataagctaggtagttatacctactaatgtgaagctgtcagcagattaatttggcatcatctttggaatgttcaaaatttaaaccaagaatttaaactctgagttatggtttttaaaagtcatttgatttgttcccctgtgtccaagctaaagactggcagttgtcaattcaaaaaggtactcaaagaggttccacaaacgactccaatctttctccagttttgttctaaagtgattagttatctaaaagtctgcggccatgctgccattaccaagttttttctctactgatagaaataagctctctcttcctaagtatgaatattgaacaagaagagagtgaaacatatgtagcagtgggtacattttctactatattacaattctggaggtctctggattgcttatagaattaggattatgctgtgggactctgaacaattctggaatagaaagaaaaaaggtgattcttttagtgctttggccctaatccttaggtagcaaaatgacaagaggcttcaccaggctgaatatgccttacaaacaaactgctttcagtgtcatatggcacctctatgtaattttttttcagaatatgtctctttgaaataatagtgatgatatgttgctgcctgagagatgaggctacccctagataactgtgaatggctagacttagtgggaaatgcacaggattgatttaagagttccagttcaaatggggcatggtggctgacacctgtaatcccagctacttgagaggctgaggcagaaggatcacttgatgccaggagctcaagaccagcctgggcaatatagtgagatccccatctctttaaaaaaaaaaaaaaaagaatagtccagttcggccttttatatgtgtgattttggttaaataaatcaagttccgtttctgactctttcctcatatgtaaaaaagggataatgcttaccttgtttgcatgtatttgaggattagaaataatttacgagtaacctagattttcccaaatctatctcatggagctattgtgaggatcaaatgagacagactatgtgaaagtgttttgcaaactacaaaacaatttagagatatatatgacaattatttatgtcattaccagtgaaatgcttttttgactttcattaagatccattcctagcttttccagagctaatacatttggaaataagatccaccctaaaatgctaaatattaataccattttagattttagggatgtttaatttttaaaccctacatgctatagggattccatatctcaagtttaggagacttaatttttaaatttaagctcacttgtcctgcctctgatgtccttaccaattatttataatgttatacattattttctgcagccctaagggaaaatctccattgtggtgacaaagtaagtggcagccatacacaggtaccttcttatgccttttctcccctcaccaagcagtgtccaggaatctaagcatttgaacatttatatgaggcaagagctagtgagctgaatgtgataatggtagcagttgacccttgcaggaaagtttgagcctgggcctcctatcccagtgatattctttatgctaaaaatattagtaattccctcccacagattcctttcctgcctaagtgaggtcaatttctgttgttttgcaaacaagtacactcaatactatgcagtagtggatatttttgatactaaggtgagcatgttttaaaatcggttatagtgacgattgcataaatctgaatatactaaaaatctttaaatggtacacctaatgggcatgtgaattatgtctcaataaagctgtttaaaaataacattagtactgttaatctccaccaaacagttctgggaagggaggcctagatggtgtctactaagagttaaagcaatgagatttagagccttgaataaaagagtctattttcttttttccgtatttctgttgctaaacacggctgttgccaacaccatctcacttcattttccagagataagggcatttgtcatgcgtttctcagcccaccacttaacagttcaggagtggaagcttaaagtgtttccccctccccctcaggacacgtgcatttagaagaaaggacaagaatccatttccttatgtagcagaacctctgatagttctatcccagttcccagccacttcagagtgaagacagtcacccaacacctgctactaaaagcccttatcagccatgtttttgcggttaatctccttctgataaagtggttcatttttcagagctgtgaatattggtgacatgtaggagggaccaaaattttcagccctcattcaaccctcccttgttttttatcagttgattttcccatgttagaaaaggacagttgctggtacaatctcataaaatgggctccagtgtttagagaaggacagtcagaggagtggccacctgtttgttgaaaattgggcttctgggaaagttgctgcacaagtgtgtggcaaggtgtgtctgagatagcttgacctgctttcacctggaatgatttgatctggcaatagagttccttgccattcctggttttatggaaatcagaggcacaggaagttgatctgggtgttctggggaattgagacaagcctctgccatagtttgttagtactctgtgtttggatgctaactccagtgtgctgagttgagacatcagcaagtgctgggcctggaatgtcagaagcagcaggtaaaatttctttgtttgatagctttaatgtcctagatgcatgtttctttgggaaactggcttggttgcatactttgatttggtggtatggttggggaagtgggagaaggcaagtggtaagaataagatataaccagtttggaacttctctagtgtttcttcacattactaatgaatttaaacatgtgcactgacttataaacatcagacccaaaagattagggtagcagaggacaattaagagtttcaagaagtagaaacatgcttctcttttaaagaagaaactggaattggcactgttattcttaagttggatagtaagacacaggtgatggtttattattctttatatcttttttgtttgccttaaatattatatatgttttaaataagtaaaacagaaaaaagtattgttggatatttagggcaattacagaaagaagctcatttacataggtgaaggggcagattgcaacttgagttggcctttgaaattataaaatgaagagactagttcaatcaggtatgggtaaaagttatttacttactacacactctacaatcagattgaatattaatggaagttaatgtttttccatgtgtataagatgagaagtttcctagttgatcttgttcagaggaccaatttctggacagaatacaaacacatgctgaatcaggcaatatagaaaatcctgctgatcgttagtcattttagttctgtagagagagcactcaccaaactctgaattcagcctacccaggactatacttttctctctatttttcttatccctttctctcaactcttcttcctggtaattgcgtcactttactcaggtagaaagattaggcctatttcctgtacattttactttcatgaccctcttcctttgtccatgcgtgaccttctttctagaatagttttttctcaccttctttgcttaacaaaattgtattcatactgtaagaactcctgcaaattaaaacccactactgactaccctgctacacctgagccccaggctaaaactagtattctgtcttcagtgttctttttttgtaacactgtcttaggattggtttactaattaattaaatggtatgttgttgcttttcattactacattctgagcttctttagggtgcttttaattgggttttcttcacagagcctaatacatagtagatgatgggtaaatgtttattgaataaaattatttctcaaatgaaaataagcccatgtgtagtgatcttctatgcccataagatggcagcagaagaacgtctattgatctacttgagtgtgaagctagcaaagaccgttttgtgtttggatgagttcgcagatgagcctttctatcccattccatttaagtgttttaatatagggaatgcagattttttttggcacatgaaggccctttgtgcactttcaccctggcacttcttcacacaagagcgacaggtacaaggtataaagctccctggattgcaagagaggatacctagtttactctccagctaagcccacaatttatgccttctcaggcaagccatttaacttctcttgttcagtttcttactcagctaattggtggagttaggagatctatagggaatattagattataaaataatagcattctaagtcatcagtgactgccttagttgtgtgctcaatattgtgttaaaaactgtatgataaaaaagggacatgcccaagtgctctcatgatccaagacatcaaatgtacacatagtaaggcatgagtgtatattaaggaataatatgtccttgagagcaaaattgtgtttaggtaggtatattaagagttcagagaagatgaatggtataggatggagtagtcagaaggggcttcgtggagccagaggagattgagttggcctttaagtatatgaaaggtttaaatgctgtaagagaattaatgtttttgaaaacttactataagccaagtaccctgctagatgcatttaatctttgtaactttgtcagataagtaatattcttttcttaattcacgtaagagaatgcattgaggctcagctaggttaaggaatctgtccacagtcacagaatttgtaatgaaaagccagaattcaaaacgaggtattttggactttgaggcccatgcttgctcttctacacctccaagaaaatgtgtccaaggggtcagtcttcactggatatttgtataccatgagcttggcaatataagcacaatggttagaatctcttgatatttatttgaagggaaagtagaacttctaggaaatgagtctttgtatagggaaatatcacttctgaaagtgaagcaaattgaaaacttgctagcctctctgaaatctagatgggaaatagggtttttttgtttttatttttgatttgagaaccaaatgagaggttgtcttatgggtcatctggctgtccagggttggctgaggttgctgaatataagaagcttatctttgggagagttccagagccttgggcaggcatatttctattttaagaagtatttttaaaaatggaattggctgacagcaattacctgaaggcttgtttctgattcttctttaaacagtgatttttcttcctcttcctcagagtctcttaaataatactggatagtatactgacctagcttttaaacttattttttctaaggaaatctagtcttctaacctgataaagggaactagagtatgattcacagtccttgcgcacttgtgctgaaaatggctcattaatcattgacgtgtaaataaaatatagtaatagctcaagaatcctttgagaactaaatttctttataatgaaactgacagtgtttaatagaacacttagcatacaaaattcataaacattgggaagcaaaactgcaagtttagctctatctattacaaaaatacacctgcacaatgattttatttgtccttgacagttgtttatttttcctgtcgtaataggattcacctttgaccctgcactgctctctagggttaccatgtctcactcttcccttcactgttagtcttgaaacagtcttccaatttcactttatccatttcctggccttctattcattgttcaacatattgaaatagaaattctgccccaccccccaatccagtgaattttttctggcaaagggccctgtaaacttcctaattactaaattccttagtcacttcatcttttaccttgaatcctggcagtaatttataatgttgactattgccttcctaaatttttattctaccataacctctctgatattattctttcctggctcacttctaccttttctgattgctccttctttgtgttctttttagcccttttttttttctgtaaacaccttaggcattgttccttaggcttccttcttttctctccttaggactctccctagctgacctcatccattctgattgctgcagctagcactcagatctctctctccagctcaaacttctttgcagaagttcattgtactacatgtaaaggacttacttaggacagtgcctaacttcatgtaggcactccataacaatagccatttctggctgttactttatctccttatttcttatttcctttatttatctatttaaagtattgttataggcatgtatttctgtaagaattctcaagtcctctttagaaagagggaataagccaacaggtaaaccaaatctttctttcctctagccttaaaaaggcaagagaaagtctttgttctcacttttttttttagaaatctctgctaattgtcttacatgtcacccaactgagaacttggaaatcaaactagaaggcttttcattctttacttctcatatttagtctgtcaccaagtcttgtctgtcattctccttaagaatccttcaattccatcttctcctctctttctgttaactcaggccctcctaactgggccttcctctcccctgccccacccaccattccaccatctacagtgcagcattagtgatctttcttatatgcaaatctcatccaatcactgactcctgcttaaaatctgagaatggtcctgcaagcaatgctgtcctcccttgttttgtaggatgtctctctctttttttttttttttaattatactttaagttttagggtacatgtgcagaacgtacaggttagttacatatgtatacatgtgccatgttggtgtgctgcacccattaattcgtcatttagcattaggtatatctcctaatgctatccctccccgctccccccaccccacaacaggccccagtgtgtgatgttccccttcctgtgtccatgtgttctcattgttcaattcccacctatgagtgagaacatgcggtgtttggttttttgtccttgtgatagtttgctgagaatgatgatttccagcttcatccacgtccctacaaaggacatgaactcatcctttttatggctgcatagtattccatggtgtatatgcgccacattttcttaatccagtctatcattgttggacatttgggttggttccaagtctttgctattgtgaatagtgcttcaataaacatatgtgtgcatgtgtctttatagcagcatgatttataatcctttgggtatatacccagtaatgggatggctgggtcaaatggtatttctagttctagatccctgaggaatcaccacaccgacttccacaatggctgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataagtgtcttcttttgagaagtgtctgttcatatcctttgcccactttttgatggggttgtttgtttttttcttgtaaatttgtttgagttcgttgtagattctggatattagccctttgtcagatgagtaggttgcaaaacttttctcccattttgtaggttgcctgttcactctgatggtagtttcttttgctgtgcagaagctctttagtttaattagatcccatttgtcaattttggcttttgttgccattgcttttggtgttttagtcataaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttgttttctaggaagtctcttattctctttagattctgcccagatcatccccttgcaacattttattcctgatactcctcagatttcctctccagagctatctctttgtggcaatttttgtcttaaattttaattatcagtacttaatatgtccagctcccttacaagatcttgcttcagaacagagcatttggaataggtaaagaagggtaaagtggtggctgggcacggtggctcatgcctgtaatcccagcactttgggaggctgaggcgggcggatcacctgaggtcaggagttcaagaccagcctggccaacatggtgaaatcctgtctctactaaaatacaaaaaattagccaggcatggtggcgcttgcctgtagtcctagctacttgagaggctgagtcatttgaaaccaggaagcagaggttgcagtgaccactgcactccagcctgggtgacagagcaagattctgtctcaaaaaaaagaaagggaaggtaaaatgggaaactggttgaatagaatgaacaaaatgagcacatgaaccagtacactattgaccaaactttaaaaatggtaaataaatatgtagggaattagggtcaactctaaaacaaaactgaatagctcagattctgaatttcatccataaccttaattcagttcaataattgttttagagtacctaataaagggtaggcacaatgctaaattttaatgatgtaatgataaagtgtagtccctaccttcctagaacttcgagaatggtggttagttgtgggtagaatagcacttttttttgttataatctacagtttagtatagtggccaacatctgacttaatgagctaaggcagttgttggtttacatattactttctagtgtgagaaaatgtcaatgtgtttcttcaacagtgagttttaaaaataactattgggtactaggcttagtacctgggtgatgaaataatctgtacaacaaactctgtgacatgagtttacctatataaataaataaaaaatagaagttaaaaaaaattttccttatgctaggactggggtgactaccaagtagcatgagtgagttttggagggtgacagaattgttctgtatcttgattacagtgacggttatgagactttatgcatttgtcaaaattcgaactcacagacctatttgctaaaaagggcaaattttaccatatgtaaacttacctcaggaaacctgactcaaaaaagaaaaaaaaatatgccaccgagtcttagaggaatttgattcatctgcaaagtagggtaattggaaattgaaaataatggacttattttagaggctttctctgaagataaatctaatttaggtcttttagggagttctttctttctagatcctttccttcataatctgagctaatggaaagttcagaaatccctgaaattgctagccaaattttgtgtatacgtaagtgcttttttaggggtaggagattacatttcttatctgattgttaaagatgggttagatttcaataaaggttaagaaccgcaggtttaagagcttttctgcttccccagataccccctttttccccattggaggccatcctagtgattacaggagctggagaccgatttctaggagttggtgagagtagacgagtctgtgaatctactggtcgtaatacagagagtccacctatgctaacacggttcttttcctgattgcctacttacgcaagctagaactcctttttctaccacttctgacctctattctctctctgccccctatggcggaccaatttttttctggcatatttagcttcctttagtatttagcatatactgaggagtacctgtgctttctatatcactatgaactatggtaataaaaaaaagtgtgaaatacaaatacatctcttttatgtatatcttactgtttggaacagtcctttaaatatgaatgatcatttttcaaagttaaaagtttctaaccttaacttttaaaaagtttacaaaatttcccacagtaactgtattttaaatagaaaataaaaattgcccgtattctcaccatcagcagtatcactgctaacatctttatatattttatttattttgagatcatgctatatatggttttttcttttaaaagattattggccaggtgcagtggcttatgcctataatactagcactttgggaggcagaggtgggacgatcacttgcactcaggagttcaagacaagcctaggcaacatagtgagacctcatctctacagagaattataaagaaaaaaaaattttagccaggcctgggagcctgtgcctgtaatcccagctactcaagtggctgatgtgggaggatcacttgagcccaggaggtcgaggctgtagtgagctatgatcatgccagctgtactccagcctgggtggcagagcaagacctcatctcaaaaaaaaaaaaaaaatgaacaaaaagttaccaaatatcacaaacacccaatctctccatcttctggtctgatcaaatcccaatattttgccatatttgcttcagttattaagaataaaatatagctaagctcctgtgtatctctcctcagtctcatctcttgactctctgcctaaaattaatcactatcctgaatttgctatttatcattctcaaatttttatcactattatttttcatttgcatacttatataattctttcacatgttttaatactttatataaatggtataacctgcacacatcattctgaaacttgctcttgtcacttagcattctgtttgttcattctaaatgtttattttagtccattgtacaattataccacagtttgtttttgtttttttcctgtgctgatggacatttaggtatttaggtcttttttttttttcttcccctaatactaatgatgctgctgtttacattcttgttcatgtttcttacacaaacgtgcaagagtttctcaacagtatttatttccaaatggaatttccgggtctatagggtaagtgcatcttcactggacactgcctgattgctctcctctttactctcaccagcaatgtacgtgagtttctcattcttttcaactaggttagacttaaaatgttttttttttttttttttgctgctactgcttttttggtaatctaaggaagatgaaatcatttctcattttaatttgcattttttttattactagtgaaacaacattttctcttatgtttatatgcttttctggtttccttttttgtgaattcctgattatgtattttgttgattttgttgttgtcattaggttggttcttttttaaaaaatgggtaaaagtttttttttttttatccaaaatgtgtttattgagatggtttcccactcatcttgactcagagtgcttttagtgctgcttcctcctgaaggaacatccttctgtaagccttgcttttcctcccgtaggctggcagaggacagtggagcagccaacacacaaaactaccgtttgtgcatggctaaagaccgtggtgattttatagcatcctgggcatttcacatccatgaagtaggaattggggctctgcaccaggcgtttcttcttgtgtttcctcttctcctcttctggagagggatgaaggagatcctttgtgagaggcatgttctcatgtgcgtaggtcatcaccgccggaaaacaaaagttttttatatattccagatatgaatattttggaacttacatatatatagtactttttagtttgtcttttaatgtctatattttatcatatgaacgttctttatttaaccattccccttattgtttgatatataggttatttccatatacattttgtgtgtttagtttcttgagctgtcttgttaaaaaaaatgagtggtggtgctgaatttgtcttggtctagtctactttgttgtaaatgataaatatttgagacagttggccaggtccagctggtatagctgatgtatgtgaaataaagcagcactcactggccttgttggtgcttgaatctgccattcttaccatcggtaacacttgttctgaccagtgaactaactgtagagtgacctatgtaagtaaaaacattgtcattgtgaaagtggctttggcacttgaggctggcatgtttttaatggaacaaatgttcagatggaaaagaattcaagatgatatagtagttatctaagataggtcacagaaacaccagactcacactttctctaaagcaaaaggacttctctgagccatagcttggtgataaataacttagtgtctagagcagggatcagcaaatgttttctgcaaaggaccaggtagtaaatattttagacttttcaagccacatggtttctgttgcaactgctcccttctgctggtgtagcacagcaagcagtagtcacacagccttgcctattcatttatgtgttgtctgtgactgctttggtctcacaacagagctgttgagtaggcctgcgaaacctgaaagatttactgtttggccctttacagacaaaatttgctgacttcagcccctgcaaactcagcactcttgacatttggggccagttaattataggtctagatttaagaaatgcttagtttggctgagggaaattctttcttaaaaaattcttaatggaattgtagctttgattcgttgcttaaacatcagctctgatctcagtgtcaaattagagaggccaaaaatgacacatgagcatttgaatgcagttgtcctaaactatgaaatcagatcatattttgatatgtgacacatattagatctagaaatcttcctgatctgtagctagcttatcaaattgagtggtatgtacactctttctctatctaggtttaacccatttatagcagatatgaaatttgttcctgcatttctgtgtgtcaggtgttccttttttatctgtctcttcacagctgttggcatttgctagctggctatgcctgagcctcaagtgaggcagtatttacagctcagttggatggatgcagcagctagggtagctcaagggcagatgaaataggatccagaatgagaatgctgcatctctctttgctctgtcttctttcacatgaggaagaatttctctctttcacctccctgtcaaatgagaagtagtattgattggtttggtacagtgtataaaacatgcatctaatggaatgttattttgggaactattagcagcattggctctgccgaggcccaagattttgccttctttcccttttctcctccccttccttctcctcctccttagtagcagctccttagcaaattgcaagctttgcctctggcttgctgtatagcagtggcagtgcaagccttttccagtttccaagggagaccgggtgctgagactgcagtctttcccagcagccacttacctttcttgctattcatttccacgcatctcttgaccttcgttctgctatgcaggcctgctcgaggaggtaacagcctgttttcttggagcgctctttgtcaaagggggcagagggaaagtagggtggtacagggaaaggtgtacagagacagcagagtataaatgctgcagttgggaaaaagtagctctaaagtgtgctgtatctgtgggcttgttcctatttgctatatctatagaactgttttaaaggtgggaaccccagcattatatcgtactacttaaagtaccacatataaaaatgtaagattactgtaatactgcctccaggaagcataggagaaaaatgagaactttgagaagaaaatggaatcaattgcttttaaacttagctgactaacaaattgcattttttttttttttgagacagagtcccactcttgtcgcccaggttggagtgcagtggtgcgatctcactgcaacctctgccttccaggttcaagtgattctcgtgcctcagcctccccggtagctaggattacaggtgtaggccactatgcaattttttctgtttttagtagagacatggtttcactgtgttggccagaatgatctcaaactcctggcctcgggtaatctgcccgcctcggcctcctaaaatgctggaattataggcatgagccaccgcgcccagccacaaattgcattcttgatgaaattttgttaagtttatgttttatgagttggatctggttttcaggtttgaggagagggcttgataatattgtcttttaattggattctcgggacttctagagctgtggtgtgcagtatggtaatcagtagccatgtgtggctactcaaatttaaataattaaaattaaatttaaaatttagttcctcttttaactgctcagtgaccacatgtgactagtggcaaccatattgggctgtgcaggtatacaacatttccattattacacaaagttctgttggtcagtactaaagaaagtaacctatgaaatataagaaatgtagtatttggccagactgagaatagacatttagtgaggagacttagaggccgtttgttcagaatcagtataaatttggattcaccatggtttaaagctaaatgggatctttaaaattttagatttacccctttgttttacagatgaagaaaactagagttccaagagattaagtgattctcttaagaccaaacaagtaattaatggcagagctaaaattagaacccaggtgcctgttctttctattgtaccatagtattagcctcccgttcccaattaggaacagcaaggaaaatttgaactaaaatttacctcatagggtcctagcaactgtagagtcaaatgcatcctccaaagaagaatttatccctaatatttttaatgtttatagtttgttcatggcagtcttatagcatgttgacggaaatttctagaaatgtaaaaatcatactttcccaagaatggagtgttgattatgacagacttttgggaaatgtcaggggatgctaggagaagtttaatgcaggacattgttatccattagttcccgatattgcaggatttgctagaagaaatgtcttgctacataaatctacatagctagaaataccatggtactgagtggaggaaacagtgttcattgtggtgcaatataagaaaagctgtacctgaagcaggagaacatggttaaaatccctttaggtatataacgttgttacttgggtgttttagcatctccttaggcctttattgactcatccgtaaaataggaatacattttttgtgtctacctgaagtcttagaattagatcaaatgacatcttgaattcataaagtctgtaggcataggtctgtgattcccgtgatccccctaagtctgtccccctgccccggcccccagtagctatccatatgtacttccaggttgatattaaagaaggtttttttgggatctctgaagaacttttgtcgatgtaatcttatgttaatacacaggacattgactgggcatcgtggctcatgcctgtaatcctagcactttgagaggctgagccgggcagatcacctgaggttaggagttcgagaccagtctcgccaacatggtgaaactccatcttctctattaaaaaatgcaaaaactagctgagtgtggtggcatgcgcctgtagtcccagctactagggaggctgaggcgggaggattgcttgaacccaggaggcagaggttgcattgagcctgagattgtgccactgcactccagcttgggcaacagagtgagactctgtctcaaaaaaaaaaaaaaaaagatatagttcaatgaataataaactatcttataagaccattagatattctgtaattaatgaccacagcatcctcagtggtcagtattagatatatactataagatatttatatagtgtgtctttaattatgtttttatatattataagctatataatatataaatatagtaaatttctatggccaggctgtggtggcttaccctgtaatcccatcactttgggaggctgaggcaggggatcacttgaggtcaggagtttgataccagcctggccaatgtggtggaaacaccgctctactaaaaataccaaaattagctgggcctggtggcacatgcctgtagttccagcaactcgggaggctgagggaggagaactgcttgaacctggaaggcagaggttacagtgagccgagatcacgccactgcactccagcctgggagacggagcaagactctgtctcaaaaaaaaaaaaaaatttttttttagtaagacatatactacaagatacatctataaaagctatatactcaacttagttcctttcctgtttggagtgaacatgtttaaataccattctctcctcaacagatttgaggtataggactctaaagctacttcaaaacccaatttcccattggattccggacaaaatttattttgttatcattctagagaaagcagcgttgttctctccttggaaattatgattatttcttttttcattcttctacttggagtagttttattttacttaggtaaccctatgaaccttcatggagaatatttcaagggaattaagtcctcttccaaatgagttagccatacctggtaaaaataattaaggggaactctttgattaagatgtgatgaatattgtagcacacctatcctttctttattttccaaattattactgatgagcttttaatatgacaatgaaaataatgtagtagtaagagtgttggtcgtgatgatagtagttctggtcatggtagtagcagcaaacgtgtgccaggttctattctaagtgccttacatgggtttgcatttaatcttcacaactctattaatatatctgtatatatctgttacaactgctcatatcttcattgtataagaaactcgggtatagagtgcttaaataatttatccacaatcacctaccaagtaagctgagaagccatggtacaaacccaggcagtatgatttttatgccagggtactttatcactacactatacctgtcaaaagacagtttaggtcttttattattatttattgtgacttttaaaatattcactggtgatttgctggatgttttgcacaacttcctttttatttttcttttcttttcttttttatttgaaacaggctctcactctgtcaccctgggctagagtgcagtggtgcaatcatggctcactgcagccttgacttcctgggctcaagcaattctcccaaaacaacttcttgaggcagaatttgtccatttatagtgtgtgaaggggcagtataaactttagtgacaaagtacaaagtgtatctttgaagtcatgcttaattctctgtaatcaattatttgaatgccactgatggtgtaatctcaatatcataccaaatacaaagaaaaattcttcctgccctctaggaaacatagtagatagagatggtaataagaggactttggcatctgaattccttctcatgctactaaactgtgagtgttagcctggttttttccggatgccagaaggcgaggggatagatgagaagccatggcttccattatttttatttctgttttgtgagactgtatctgtcttctttgcatagcaatgaagaatcctgtagcattcagattcatggatggctgcaatgcttctcagaaaaatcaaggagtgtggagtgagggcttgctctacataggggtcagcaatatttttctataaaggttcagatagtgattattttggcctttgcaggccatgttgtctctgttgcagttactaaactctgctctgtgattccaataaaactttatttacaaaaatgttgcaggccagatttggcccaagatcatagtttgctgaccagctggtctagattttagaaagtgttacagaaggacttagtctctactgaaaacgtagtatgttctcaacgcagctataagttaggcacattacttctgtaatctttggaatgcccatctgagataaagaaaaatgaatgaaaatgttccttcaaaaacatttacagttcaagtactagaatttatgggttttgtttttatatattttttcttaaatagtaaaactctcatatattgacacaggttacagaataatatgtgtgatattcatagtatatagtttttatagttttatagtttataaaaaactatatatagtttgtatagtatatatttacatacaatctggacttatatgcagtaaaataaaaatgagattatctccatgtggtggaattttagttgatttttgttttcatatttttgtctgttttttcccctggggaaaaaaagcagtgtgatttcacatgtgtgatttcagatatttaagattccaagtcaggtaaaatattcctgatcttacctaccaggtttttatgagctctgtttctctcattcaaaaaaactctctagagtaggcagtaggataagggagccctttttctttcactgtgccttctgtcctgtatgcaaagaagagataaagatcaagaattcagtataatagtgatactgtatgttttgcaggtagaaataacacgtgagtaggtttgctggtaatctagacagaaattcatgggaagttagttctcaccaattccagtatctggactacagctttagttttgggacttaatttttttagttcactcagaggcgaggaatatattaaggaaatatgcaaacctaccaaactatagcatattgacacacgtattggaattccaatttactaatttaccttgagggaaaaaatatgagtattaaaaacattgcctggttggggacttctgcttcagtctgtggcatattttgtttatgtaaaatcttccactgagaataactagaaaaaactggataaatataagaaaaaagtttttgaaggtacttgagagttacaaagcaagtgagaacttgagggatcaagatcctggagagaaggaaaccttaaaagggtaaacccaacatttggctctacttttccccttgaggtatttgctgattagtaaagcagtggctatgagcctgagaaactgaacaagattttcgtagtctcatgggactcagggaatgattggagttcagaaagagagcctagcggataccccagactttgatttagaaccactgaagggctacattctaagggcttaccagaaatagaccagcccttgaaaagactgaagcctagcttccaatcagctcagtctcaaagtggattaaggtactttgccttagtctcctggttcttaaaatgtggtccccagaccagcagtgtcatctgaactaattagaaatgcagattatcaaacccctacaccagacctgctgaatcaggacctctggtggtgtggtactcagaaatttgtattgcataagccctcaaagtggttctgatacaagtgaaagtttaagaaccacttccttagcctaactgccagggggaaaaaatatcctctctgaagggtagcaacaacaatcatgagttatcactcactacatttttttattaaatatgcctgatgttattttaaaaattagcatacataccaagaaataagagttaccaaaagaccaaaagaaaaaatagacaataggaacaagtccagatactgatattatcagacatggactttaaaataattgtgattaatatgttccaggaagtagataagaagtagagattttcaccagagaactgcagtctgttaaaaacaatcaagtggaaattctagaaacaaaaaatcactgaaatcaagaaactcagttggtgagtttgcagtagtagaccagctaaagaaatgattagtgaactgaaagattggacagtagaaaatatccagaatgaagcacagagagataaaaggctggaaaatgcagaaaaagcatgataaatcagtagaacatggccagtaaggtctaacataaatgattggagtcccaagagaagacagaagctagcttcatttttcacagaacaccgtttttacttcaaagcattactgatggtcaaacaatgggtattcacacctgagtaatttggcagacattttcttgaaaataaagtcaacccattgagtatttgttgccaattaaaaatttaaactttcaagcagaaattagaattttagaaaacttatatgctaccgtgagtaatattattgacagcttcccaatacttaaagactgttctaagatcaaaggtgatattaaataatttatttttactattattatataatgtagtatgtcaatattgggaagatctgcttaatgcagcaatattttacaaatgcaccaatattttacaaatgactaatgaagatatgttacaaaatcatgcatgactaagaagattctttgaaagtacaagatagaccaaaggatttcaatgtaacagaatatgaaaaatctattaatatgttttagagcagtgttccccaacctttttggcaccagggactggtttcatggaagacaatttttccacagactggtgggggcatggggtgtggggggcagtgatggttttgggtaaaactgttctgcagatcatcaggcattagttagattctcataaggcatgcacaacctagattcctggcatgggcagctcacaatagggttcacgtccctatgagaatctaatgccgtggctgatctgacagagggcagagctcaggcatcaatgctcacttgctcacctcctgctgtacagcgtggttcctaacacgccacagatcagtactggtctgcagcccgggggttggggacccctgttttagagtacacattgtaactaaccaccacttgtgttggtgtagcatcaaagaaaaatatctcccgattatctgagaaagctatcacaatactcctcgcttttccaactatgtatttgtgcaagactagatagtctttatatattttaaccaaaacaatatattgactgcataaacagataagaggatcccactgtcttctattaagccaacattaaagaaatttatgaaaatgtaaaacaatgccactcttctaattttttgttttggaagatatagtttttttaataaaaaaaaattgatgttaaaatgtattagggctattattttctttttattttaaaatttatttgacacattacatatttatggaggtacagtttgatgttttgatgcatatctgtgttgtataatgatctaatcagagtagttagtatattcatcatccatgcatttatcatttccttgtggtaagaacattcaaaagcatctcttttacctattttgtaatatacaatattttgcttttaaccatagtcaccttactctgcaatagaacatcagaatttattccccctgtctaattataactttgaaccataaaccaacctctccccatccttctctcacctcttccctccccagtctctggtaaccactgttctactctctgattttatgatatcaactccccccacctttttttagattgcacatattagtgagatcatgcagtattttttttttctgtgtctggcttatttcacttaacctgatatcctccaggttcatctgtgttgttgcaaatgacaagattttattctttttttttaatggatggatactgttccattctggatatacacattttctttacccattcttccatttttgaggactcagtttcatatttttgttaacgtaaatagtgctgccataaacacggtaaggcagataactcttcaatatactaatttcctttcctttggatgtgtacacagtagtgggattgctgaatcatatggtagttctatttttacgttttaaaggaacctccatactgttttccacaatggctgtactagcttacagtcccaccaacttgtgtaagtgttccccttttcttcacatccctgccaaaactggttttcttttgtctttttgataatggtcattctaagtggtgtgaaatggtacctattgtggttttgattttcatttccctgatggtttgtgatgttgaccattttttcatatactcattagccatttgtatgacttcttttgagaagtaaatgtctgttaaggtcttttgcccatttttaaaatcaggtttttgtttttttgttttgtttgctgctaagttccttatatattctggatattaactccttgtcagatgtatagtttgcaaattttctttcccatcctttaggttgtctgtttactctgtttaatagtttcctttgctatgcaaaagctttttagtttgttgcaatctcatttgtccatttttgcttttgtttcctatgcttttgaagtcttatttaaaatatcctagcttagccccatgtcatgaagcatttctcctatgttatcttctaggtagttccatagttttgggtttccatgttaagtctctaatctactttgaattgattcttgtatgtggtgagaggtagggatttactctcattcttctgcatgtggatgtcccactttcccagcagcatttattgaagaaacagtttctcccctaatgtgtgttcttggcacctttgtcaaaaatcagttggctttaggtgtgtcaatttatttctgggctttctattctgttccattggtctacgtgtctgtttttatgccagtaccattctgtttttgttattatacatttgtagtatatttttaagttatgtagtgtgatgcttccagctttccactcagaattgctttggctattcattttttttttctggtttcctatgaattttaggattttgttttatttctatgaagaacacctttttttttttttttttttgacatggagtcttgctctgtcgcccaggccagaatgcagtaggcgcaatcttggctaagatattaacaagaaattacaaaagatagagaactggaaagataaacctatggaagagcttctaagagaagcccaaaaagtatatgtaaaaagagagaaagactgacagagggaacagaggaagtctgtgcccaaaatcccagtgagtagtttggtgggaacgacggttacagaacaggtgactcaggatgactcaggtcagagcaggtgatagaggctaggagggggttgtttactgaagctagaggcaagagggtgaagagaaccaggaagttaagctttaaaatggagaatagagaataagagagctgaatatactggcatactgattctttgaagagaaacttggagttcactacatttaacacctactgttatagtattgcagtctatctctccctttacctctaataatatttgctttatatatctgggcgctctggtcttggatggatggatgtatttatagtttttatatcctcttgcttaattgtaccctttatcaatgtctgatgaccttctttgtcttcttttacagtttttgacttaaagtctgttttatctgacatggttactcctgctcacttggtttccatttgcatggaatatctttttccctccctttacttttattctatgtttgtctttaatggttaggtgagtctgttttaggcagtatatagttgggtcttgtttttaatccgttcagccactctatatcttttaattggataatttaatccatttatatttaaggctattattgataaagaaggtcttactcctgctattttgtaaatttttttttctggtggttttatagatccttcgttcctttcttcctcttttatttacttctgtggtttggtggttttctgtagtgctgagctttgtttccttcctctttcttgtttgtgcctctgcagtaatttctttctttctttgtggctaccatggggctaacattaaaagtcttataatagaatgttttaagctgatagcaacttaactttggttgcattaaaatactctagacttctctcttttgtttctgtaatttacttttttacctgtgattgtattccttagctactaattgtaagtgtcacgggttttgaccattttgactttaaaccttcgtactagaggactgagagacttacatagcaccattaaatcactgggctagtctgaatttgatttatgaatttacctctattggtgagttttatacttttacatcttttcatgaaaataattataatcttttatttccagttataccattctcttaagtatttcttgtaaggctagtctagtggtgatgggtttttctcagcttttgcttgtctgggaaggtctttatttttccttcattggtggttgatagctctgctggatatagtattcttggctgacaggttcatttttttcccccaaacactctgaatatatcatctcattctctcctggcctacaggatttctcctgagaaatccaggggtacagggctgctgcttgaccaactatcaggccaagcatgggtacagcagggccacacaaccctgcagtggtctgtctttggggcagggctgctgctagactggctgtcaggcacagtggtgtgtggccacagcagggctgggtggttctgcagcggtctgagggatggaaccacggtagaactggttgttgggctggatgtgggtgtgcataggttcagctggccagctagctgtgcagtgcaggtatgtaccggtgaggggactggccagcagttaggcagtttcccccctgtgcagctttggctgttcctggggttgggagggtagtgtgccacatgggttcaagagcagaggtctcagttgttgcatctggctaggcttcaggcagctaggattgtagtgctacaggtgcctgtgtgaacatgatagagtgatggcagggctacaggaatggagaaagtccattcctgtactggactacagggaagggcacattctagtagtaggttcagtttcaagatggtgctgagtagcagcagcttaggatgtgagggtggggggcagggggtgctcaaggtgagctcctactctaggcaaagttaactgtatgaactctactctccaaactggattcagggcctgtgaggacagagggactctcctatagcaagaatttctggcatttgtggtagcaatggggatcactggtgatctccagcttacgtttttcccttaagaagccccctctggctccaggctgatcctggtagggaagacagtgtggcagaagcagaataccttgctcccctctctatggtgctgccctggacttttgtcttccacagggattttgctgttcccctagtgctctcccgagtacttctttggtcattttaattgaaatatcgttgtttattcattgttttggtccctttttgtggagaggatgggctttaggtaactcaatttggccatcctgctgacatcactccatcttatctagggctattttaatattattattattgttattattatttgagacaaggtctggctctgtcaaccaggctgaagtgcagtggtatattctcagctcactacaacctctgccacccaggctcaagccgtcctcccatctcagcctcacgagtaggtgggactacaggcatgtgccactgcacccggctaatttttgtattttttgaagagacgaggttttgccatgttgcccaggctagtctcaaactcctgggctcaagccagctacccgcctgggcctcccaaagtgttgggattacaggcatgagctactgctcctggctgctattatttttaaataaattaataaatacattttttaatttttaaattttaatttctagtaagataaatattaaaccccatataaacaaaagctctctggggttctcaataattttaaaaaatattaaaggatcttgagaccaaaacaatttgagaaccactgctctagatattaaaataacaaatatattctaagggtattgttaacaacttgatgccactaaatgtgataatatagacaaaatagaaaatttcttaaaaaacaattaccaaaacagaaaatttgaataagcctaactctattaaagaaatgaaccctttatttaaaactttcccataggggctgggcacagtggctcacgcctataaaccagcactctgggaagtcgaggtgggaggattgcttgagctcaggagttcaagatcagcctaggcaacatagcgagacctcatctctactaaaaataaaaaaaagttagcagggcgtagtggcgtgcacctgtagtcccagctacttgcaaaggctgaggcgggaaaatcgcctgagtccaggaaatcaaggctacagtcagctgtgatcacgccactgtactccagcatgggcaacgaagtaagactcaaaaataaaaaacaaaaccttcccacaaggaacactgtaaacccagatgacttgattggtgaactcttccaatcatttaaggaggaaataacccaaatcttacacaaattcttacagaaatagacatgtagagaacactcgcaattcatataaccttaattcacaaagctgaccagcatattacaagaagggaaaattataagccaatttctttcatgaatgtggtaggaattctaaactaaataatagtgaatatgtttaaaaatctatataaaaagatggtacatcttgaccaagttgagcttgtcccaagaattcagtgttgctttatcattcaaaaattattcagtgtaattcaccttcctgacagaaaaaaggagaaaagcaatcatctcaatatatggggaagaatagcatgtgataaagttcaacatacactaatgattaaaaaacaacaacgagaaactctcttagcctattttctataggaacagaagggaattgctttaatttgatgagtggtatctgcataaatcttacaacaaacattacacttaatgaaaaaatgctgaaagcattctctttgatggcaggattacagagaatgaaaacttactatcatcactgcttttcagcatgtcctagagattcctagccaaagcattaagtcaagaaaagaaataaaaattggaaggataggaaagaagaaataaaattctcattttacagatgacatgattctgtgtgaacagtaatacatttacaaacacaatagtcccgttatccatggaagatacatttcttttttttttttcttttttttggagacctagtttcactcttgtcacccaggctggagtgcagtggtgcattctcagcttactgcaacctcggcctccaagttaaagtgattctcttgtctcagcctcctgagtagctgggattacaggtgcccaccagcacatctggctaatttttgtatttttagtagagacagggttccagcatgttggtcaggttggtctcctactcctgacctcaggtgatcctcccaccatggcctcccaaagtgctgggattataggcgtgacccaccacacaatacctttcaagacttccagtggatgactgaacctacagatagtacagaaccctatataaatactattttttcctataaatacatatctacactgaagtttaatttataattaggcacagtaagagattaacaataatactaataactaataataaaatagaacagttataacaaaatgccagcatcactactcttgcactttggggccattattaagtagaataaggattacttgaacataaacaccgtgatatcacaacagtgcatgatttgcatctcaggagggacagaatggaacagcatgaaatttcaccacgctattcagaacagtgcacaattgaaaatgtatgaattgtttattgatggaagttttcatttaatattttcagaccacagttcaccatgggtactgaaaccacagaaagcaaaaccacagataagggggaactactgtaatgacttggattctgtaatgtttgctgatggttgatagcatttctgtcattttgactttgcttaagttcattcctagaatgtagaaatctcttcaatatgtggaaacactttgtcattcctcaagtatatgcagcaaagatcttgcttttgctattacttttttttctctgcaggtcctatctgactcctgtacgggatgaggaagcagagtctttacggaaagcacgctccagacaagctcggcagacacgaaggtctactcaagtgagtgtggctttttttaaaatgtcattttgtgtatctacccttctgttggaggtacaatcaaaacacactgcaatatccatgttcaactgctgatttaaacacacacacacacacacgctcacggcttggcgtggtggctcacacctgtaatcccagcaatttgggaggccaaggagttgagaccaggagcattcctgacttgaggtcaggagttcaagaccagcctggccaacgtggtgaaacctgtctctactaaaaatatgaaaattagccaggcatggtggtgcatgcctgtaatttcagttactcgggaggatgaggtgggagaattgcttgaacctgggaggcagaagttccagtgagccaagattgcgccactgccctcctgggcgacagagcgagactccatctcaaaaaaacaagacaaagcaaaacacacacatgaaaatgactgccctattccagccagtcttaaaagctttcattgtgttgaatcttatactacatagaaccaaatgaatttacagctacatctacccattctcaccaatattcctccaggcttagaacaggtttatctcttttccttcacaagattaattattccacttgtgcttaaagaccttaagaatccctatacatccctatatccctactacattttaagaatccctaagggaaaagagtttggcaattcctcaaaattttaaacatagttaccatttgactcagcagttctactcaagagaaatgaaaacatatgttcatataaaaacttgtatataggtgtttgtaatagtattattcataatagccaaaaagtaaaaataagccaaatgtctattaactaatgaatgggtaaaccaaatgtgataaatccatgctatttggcaataaaaagaaatgaagtactgatacatgttacaacatggatgaaccttaagaaaacattatgctaagtgaaagaagccagacacaaaacactccatatattatatgattccatttatatgaaatgtcccaaataggcaaatccaaagagacagaaattagattagtgccagggctggggggaaggcagaatggtgagtatgtggtttctttttggggtgatgaaaattatgaaattagatgtggtgataattttataactctgtgaataaactaaaaaccaaggaattgtatactttcaaatggtgaggtttatgatatgaggattgtattttaataaagatgttacaaaaggaatccctgagggagtcattgaagcagtttaagggaatatggtatagtctacattatatgttagaaaaatcaccctgcagataattgatgggaatggtaggtagaggtatgtttaccaagcctggaagcaagaagacttgctaggaagctgtattgtagtccaagttgtattgtagtcccaggaaattacaagggtatgaaatcaagttgtaatggcaatgagaatggagagaaggctatgaatttgttattgaaagaagcaaagaaagatgagcccatgaaacagaacgaaaagaagcagcaggagcggtgaaaagaaaatcagaaaatagtagcagcatggaagtgaatgaaaagtccatttccagtgaaaaggagaagttccacagttttaaatactacagaggtcaagtagcaaatttcaccactggaaaagagacattatatatggcagcaaaaacacccttgttgtcttctttgactctcccaaagtaggtcatgtattcttcctttatttttacttgatgattatttgtctgtttcctccattagaatgtaacccccaagaggaccaagactgtttttttgttttgttttattgtggtgaaatatacgtaacataaaacttaccagttttaccatttttaagtttacagtttaatggcattaagtacatttacattgttgtataactatcaccaccattcatctctagaactttcttcctcttccaaaactgaaactctgtatccattaaataattactccccatttccctctggcaacgctgcttccactttctgtctatgaacttgactatgctaggaacctcaaataagtagaatcatatagtagttgtccttttgtgtcgtattttacttagcatagttatcaaggttcatccatattatagcatgtgtcagagttcctcccttttaaaggatgaatatttcagccttttatggatactgcattttgtatatccattcatctgtcagtggacattgggttgcttccaccttttggctgtttaatgctgctatgagaatggctatacaaatatctccctgaaaccctgctttcaattcttttgggtacatactgagaaatggaatttgctggatcatgtggtaattcaatttttaattttctgaggaactgccatactgttttccttagcggctgtaccattttatgttcccatcagcagtgcacaagggttctaatttttccatatcctcaccaatatttttgttgttgttgtttttatgagatggagttttgctcttgtcacgcaggccggggtgcaatggtgtgatcttggctcactgcaacttctgcctcagggttcaagcaattctcctgcctcagggttcaagcaattctcctgcctcagcttcccaggtagctgggattacaggcacccatcaccacacctggctaatttttgtatttttagtagagacagggtttcaccatgttagccaggctggtcttgaactcttgacctcaagtgatctacccaccttggcctttcaaggtgctgagattacaggtgtgagccaccatgcccagcctgttttttttggtaatagccaccctaatgggtgtgaaaaagaagacaggctatactttagctcatcttttccaccatcatacagtaaataaatcaatatatatttattgaataaaaaaatgagtgggaaataaatgatagggaaagataaattgctctggaatgatttcaagtttgtttatgaaggaatgggaaaagatagggaagttgctggagaggggcatagaattgaaggtgggagagacaggaacatagaaacgtcttagagggaaagattcagtagagagggagtgaaggtccatgtcaaaacttgaatagatctttgaactcgttgaaatgtgtacataatttttgaggagattttattagattctcagtagtcttcatgagattctcaaagggaccaccgactcccaaagaaagtaaaatctaagcttcttagcatagcttacaaaatctgttatgacctagcctctgcctgctttcctaaaatcacctatcctcattctctctctgtcctccaactttcctttttttgttgtgtgcttcatctttgctaagttacctacagattcctaaatcatccgtggcctctcttgtttctgtatctttgtacaagatccctctatctataatgccttttctccctccccctacccaagttctttttactctttaaaacccagtgttcggtattcatcctatatactcttgtgtttctgttttaatacttacattctctcattatactcgtctgtcttcttacatcttttctgctagactaaaaggttcttgacagtaaccattggatttgtctttgtagttctagtgcctaaagacacctaattctttattaacagaatgagtaagtaaatgaattaatagtaaaaaagctgggggtggggaggggaagcaagttgtggatacagtgcctgatcaactaactaccttccagctttggaacttccttcttctgaggactcatgcacataactacttgagttggaatcagctcatgctctttctaaactccttttctcccttctcctgtagttttgtcatcatttgcctgtcttctctcttgctgcccctgtgacactgtggggggaacattaattgttggaatatccctatatgattcctagagttacttgggaattgatattagagaaaagctagtctaggagttttaagaggttatgttgttgttattgtagcctagctctgaattttcatcttgttgagccaggtttttctttttttaagtgaatatttttccccagtatctgctgtttaggaaatctctgttggtaaccatttgatcttgggagggtagggacctttcaaataaagatactgagaactatttggtatggaaaaagtacatctataacaggcagacatcagtgttgacctattttctggagatcaaactagaaaaactaaagtattacatttaaaatgtacctagactcaggcccgggttctttgtacactgagatgcttattttaagcatatattgcttgaagtggcctcattatgcattttgaggggcttcattttgggatttgataactattaggtctttttgggaatattcctgatcaatcaagagttattccatggttagtgtgaaacagccctgatcttgtgatattttcccagggtgtcaccctaacagaccttcaagaagcagaaaggacattcagccggtcgagggcagagaggcaagctcaggagcagcctcgtgagaagcccacagacactgaagggcttgaggggagccctgagaagcatgagccctcagcagttccagcaacagaagctggggagggccagcagccctggggcaggagtctggatgaagaggtgagctcatttttgctggcatgtactgtgctaaaagcagggtaattagtttggggagtatcttcttcactggtagttcaaaggctgtgttctaccttgcaatggacaactcactcagtatggctgtctttagtttgcaaacctgtgtgacaaaaatttagaggatgttggtccttaaatgaccatttttttcttctgagagttcactgatgcttttgaataaatgtccttctagtctaaaaggagaggtcatagtataacaaaatgcaaataaaaatataagcatatattgagtgtttactttactcaatacatgcttactttatgccaggcactattttaagtacttcttgtgtattaatgcatttaatcctcataacaactctctgaggtaaatattactatttctattttatatatgaggaaattgaatcacagaggttaaggaatttgcccatttcacatagccaagaagtggttaagccagagtttgaacataggcagtctgactccacagcttgctctcttaactactagtgtattgtttttcaaactcttataaacctaaggggcttacaaagcactcttgagtgtcactgttgggagggacgttttgatttatgtttcatttctctagtggagttggtagtaaaaggtataagtttatatttagggtgaacataactcctggtttacctaagatggttccaattacaactgttgtctttgtgtaattatcattacccctcctttgcactctcaaaagtgtcccagtttggactgataaatgttatggtcactgtggttatagaagaaaggtatctccttcttgctttgactctgaatggctagattctataaactgaagttctattttgtattttgttttataagctactatttattgagtacctattaccaggtattcttctaagcacctaacacacattttcttaatttaatcctcataatcctctctgaagaaggtgttatctctgttttatagatgaggaatttatggcccagagaagctaagtaacttattcaaggtcacagctagtaatgctgaagctagaatttgaacaaagatctttctgactccaaatttactacattttattgtatatgtctttataaatcacaaaaatgtgtacaatctctatgtcataaatttaatgtgtagtaaggatttatctatctctgagtcttccataaaccaagttaaggcttattgttaggctctatctgtcctaattctcaggtttaaaaaaaaaaaaaaaaaagaccacaatagaccagaattgcttgaacccaggaggcagaggttgcagtgagccaagatcgcagcactgcactccagcctgggcaacagagcaagactccgtctcaaaaaaaaaaagaaaagaaaagaaaagaaaacaacaacaacaaaacaaaactacaaaaaggaaaatgggaactttagaaagtttcagtaagcctggttatggcaaggtggtagagtattcagaactcggtaggatactcacatttattctctgttctcaggtaatccctacattctgcttcttcatgctcctgatctttttgtttccctacataaaccttgcctttcagccctccatcttaaaaaggccatcattcttattttcattccaagatcaaaggaattttttttacatggttaatgctatctagtaccctttggttaattgatgaataatttgcttgaactgctctcaacatgatgggattctcagagtaggagtctagcagctgtgttttttttttttttgtctaattaactaactttagcttagttcatttattgagtgcctattaccaggtactcaatattgatcatcatctactcataagccccttaatatagaaaaaaacattttgtataaacctgctgtccttactctttagatggacttgatttctaatatctcatattgtggattatttccagcctatctgtcatcgcctgaggtgcccagctcagccagacaaacccaccacgccagcatctccttctacgtcaagaccctcactctacaccagttcccacctgctatggacaaatagattttcagtccctgattctgagagttcagagactaccacaaacactacaactgcaaaggaaatggacaaaaatggtatgtagaacttcaaaagacacaggcccctccacagtgcacatccccagattcttaaagttcatactttattttatctctggccagagaatgaagaagcagatttggatgagcagtcctctaagaggctgtccatccgagagaggaggcggcccaaggaacgacgaagaggcacaggcatcaatttctggacaaaggatgtaagtggattggtctgtgctgaggcatatcatattactcttggtcaccattctttcagttgagtttaaaagaaagagtcccgcatggtgccatgaatcttgcagtttctcaggaagtattactgaggaaaagagaagaaagacctaactagtgtgggactcatttggtatgttcctgctagattcccagtatctagtacagtgctaagcacatggtaggcactcagtaaataattggcaaagaattaaaaaactggaaatatacaacagccatataaacaaatataacaagtgaataagcttgtcgagttttagtagtccttcctaatattccctgaatgtcatgtagtgagtcaacaatatcttaatgccacatatgagcagagattctaactaaatattgtaggagtactacaggaagttcaaggaacttaaaacctctaagtaatacaagttcacttagttttactgttttagagaaaaagtggaacaaataacataaaatagatgaactttggctttaaaataaagacagatatgccaatgtttactaactacaaatacacaatcagtagttccattcatcctcttccatatcttgttctgtagccttctcattcaaccttgttattggcattttaaagaacaagtggccaataacttggacaagacgaccctgcctaccaatgactcctttgaaaattggacacactttattcagtgagacaagaaatgagacagtagtagtcattcattataaattattttttagataaaaatatttcattgttttagggctaaattgactgataagtattgacaaagatgaaattaagtctgtctgtcttgtctgtctgtcttaaagatatcccttttccaactgtggttgatttgactttttagactacaggtgacatttctaagttgcctgcctgtgatggctgtgaaaagtagcagtaacagagcatcacttggaagtcaattctcattgcccatgtttgaaatgccaagatgcataattgatgggatctgaccttgttgctttcaaggatgtctgtgacaatgagcctcttgattttcttcccttttcttttttaggaggatgaaactgatggctctgaagaggtcaaagaaacgtgggtaagtgacaagccagtgaagcatgtctcttgagagcacagtcttgctcttgtatgtaattttagtagaagaaagggcaagacttaatgcagattttagttgagaaggagtttggagatagacattcctctaagagatggggcaggtgttagtttgtggtactattttctcatgtggtgtaacagtgcctgtgctcttgaagcagtttcctacatttttctgtgcctactgccagtctttcacactgttataggatccatcattttctctcttgtatgttattggattatatgaagtactttgaaatctttgaatgaaaagtgaagagtgataccagttcctttttggatccgcactaatagagagggacataaatgtggagaatgtaaaacatcagacagtccccaagtcatttatatttgactttgagataagattaaacatctggcatcttacataactctgcccttttaaggcctgacatccaactcttccctgcagtgaaaggcctaagttcagcttttctgaagatactccaggctcctgtaagccactcagacatgattggtggtggttttctttttagtactgttttccaagaaggaaggaatttggttctgactaaattaattgaaatacatgtgcttttctattgaaattatgtaaaaagatgaccttttgtatcctacaacttattggaagtatgttttcagagtatatttaataacctgtactgaaaattaacatctaactcatctttagcagagaagatataaataatatattgtcattgatctgcctatatttttgtctagatccaaaacagacaatagtagccttctagaaagtagtgcctttaatgactaacggtgacataggtgagaattgcctgcccttggttgaagctggggctacttcataaaggcaagctatgtggtgtggaaatagtatatagaggttccttggggcacgagtgtgtgcctgtgtgtatgtgtatgaattatagcaactcttagtttcttcaaggggcttggaaaggcttttggagataggaagagtgaatataggaaagttcctttggggaattataactcaaagcatatataactcaggaaatataactcagaggatctgagttatagattatagagtactgaaatggaacattatccatacagaattacataggccatttaaatccagggaattgcaaaagggaaggctttgttgtcataagaatgtcttttgccagtgaaaattctattctctacttttctaaacttcttggcactggaaaatcctagcctagagggtaccaagtaaggaaaattaagatgatcttgatgcagtacttcctagggaattttactttaggactgttgacttgaaagtatgaagaaaagcagagactgttgcagtttgatgtgaaaggcatttgtcagactaaaaaatactccacacatccaattgcataaggcatctactagtgtttaccatgtgtcaggaaaacaacaatgtgaatcaaaaagaataaacagcccattatctgtggactggtacatttgaatttatgcagataagctaaggttgctataagaaatatattccaagtgccaatctccagcctcgctaatagtgcaggaagaaaggccgataatgaatcagcatagggtgaggcatcctttttgtaaaagtcttatatttgcttgtttcatttctttcagttaaattcttaactgtttttctcccttgagcactctctcctaatgctagcaggcatgatgccattatctatatgggcctacagagccacatgcctggtcatggcctagtgtaaattcctacatttctatttcaagacaatcagtagtatcttatgaccacctctctaccccagctccattttcatccttcaggcagtacagttgactcagctctgcaacaacaaatgagccagttaaagcggagggcattccattgaaatggtgctgttagctaatcagcatggatacagttgagaagcccagggcagctctttcctttcttggtttttagttcaataaaactatatctgctattgaggtcatgctggcttccttctcttacctagtccactccttgagaattataatatctattatttttaaagttatctcttcccaagactctaatatcttggcttttttttaactgaaatataatttacaattaatgcacagattttaaatatactgtttgctgggttttgacacttgtatgtaccagtataaccactacccaaatcaagatatagaacttttccatcaccttaaaacgtttcatcattaacgctcaagaataagtgatactaatctatggtgatagaaatcagaagagtggttgcctctcaggacagagaattgaatggaaaagatagaaatcaaccagcagtaatatttaattttttttttgagacagggtcttgctctttcgcccaggttggagtgcagtgatgtagtcatggctcactgcggcctcaacctcccaggctcaagtgatcctactacctcagtgtcccaagtagctgggagtacaggcacaagccaccacacccagctaatttttggagtttttctagagatggggtttcaccacgttgcccaggctggtctcgaactcctgggctcaaacagtcctcctgccttggcctcccaaaatgttgagattataggcatgagccacaatgcccagccaataatatttaattttaatggtagaaaggaagcttcaacggttattatctttatcttatgcctccagtcagagttagacctaaatgattcaaaatatctatggtttttccccccttcttaaagatttcaaaagaagattgtttaatacttcacttgtatagcagtgacaacaacgtggtttaagacctttctgttgtttaaactaaatctctattgaggtcattgaagttcatttccttttttatataccaagaaaaatgtaaccaacatttatatacaggtaagatttatggccaggaatggccataatgtttgctatcaatagaatatttggtcagagaaatgcaaatcaaaaccacaatgaaatagatcatctgacctgttagaatggctgttatcaaaaagacaaaaaataacaaaacctggtgaggatatagagaaaaagaaactcttaatacgctattggtgggaatataaattagtgtagccattatggaaaacagtatggaggttcctcaaaaactaaaaattgaactaccatatgattcagcagtcccaccacttggtatttatccagaggaaagaaaaacagtgtatcaaagagatgacgctccctggtggtctagtggttaggatttggtgctctcgctgtctctctctcttgctctctctctctctctctctctctctcactctcactgtctctctgtctttcaaagagatatctgcacccctatgtttattgcagcactattcacaatagctaggatatggaatcaacttaaatgtccattaacagatgaacagataaattaaatgtggtatatgtacatagtggaatactatttagccataaagaaaaatgaaattatgtcattcacagcaacatgaatgatcctggaagccattatgttaggtgaaataagtcagtcacagaaaaataaatacctcatgttctctctcatatgtaggatcttaaaaagttgagctcatagaagtagagagtaggactgtggttactggagtctggaaaagggagatagtcagaggttggttaacagatataaaattacaggtagggggaataagttctagtgttctatagcactaaagggtgaatatagttaatgataatttattgtatattttcaaatagctagaaaagaggattttgaatgttcctaacataaattatttttgatgctagatatgctgattaccttgatttgatcattacatattgcatatatgtattgaaatatcacttcataccacataaatacgtactattataatgcatcaatttaaaatttttaaaaagagagtatgtgatagactagtcatgcattgctatgctggggacagcaaggaacatgcttagaaggctggggaccctacttaagcccaacatagtgcatagttttagtctgaacccatctccactggtaaatccatgaaccagtgaaactaacaatgaatatgtaaaattgacatcttagcacctccttgacagatgtgtttaaaaacaattctgttttgtttatccacgttaggtatatgacagtctctgagaatcttaatagatcctttgtctttctgaatgaaaaataatctgcatcttaatttgaggaatagggttattctaattatatctgaaaatgcttttatattcagcagtgtgtttgctgttttctttactatagtagtaatcacatagaatgtttgccctggagggaacaagcataggtacgccacagaagataatgaccatttggatatttctatctttttttacctgcatctttggcctggattccattttctttacattgagttttatctattgctttcttactgttttccctgtttgctctggagctgttttccaagccaatcctgttgtataattgaatttatcactagagggcacaagtggtcaacagaaaagatattggtgagcaggcagaatggtgccctaaagctgagcagaagacaaattgcctttgtttttaaggaattgttgaaggaccgggttcaatgtagtaaaggtacttgcctcccaacttttggtatcataggattggaagagaatctagagatatcttggattaggaaccaattttatggttaagaagactgaggctcagagaaattaagaattatttgggcatgacatctctgctaggtgagcaacctgtaccttttttcagggaacctctttgtttgactgtagtgaagcaaacctgaaattaggacttacatccttttctattccttattcatccatttggtttttttactcagcaggttacatgttcgaattgacttgctagtagcatctcacctccttgagtgaaggaacgtcttcttgaaggacaacttaaaagcctactcagagtatcaagattcagtgggtagagcatcagcattcttctgctgtccttgacataggtgggtagttatgtatgtcaggaagtaagacttttcatacttttcttttcccctagaatctctattgcttttagataaatcaggtggcactcaatctgaacaaaatcactgaaaccttaccctcaaagttagcaatgtagctgtccccatccagaatgcaatcagtaggtctggattactagtcatccctcaaaactgattggtaaaggagatagtgttaaagagttactaaattatagatatcaaggtacctgccttagataactgggggtatgctcgtggagagatctgttggtaaaagtcttctaaaagagttaagctattaaatgcaaggttttcaaactacatgaaagaacacaattggaatttgctagcagagctgagttttgaactttaacagaaaataaatgccatagaaataaatagaaatataccagaagccactaaatgcattttccattttgtcctgccttcacttttgtaagcatcttaattcaacaagtgcttttaagcgccgattatgatcaagcacttttctagattctggggatgcaacaatgaacaaacagccctgctcttacggaatttacattctagtgggggagacagacaaaataaatatataaagtaaatactatgttaaaaggtgatacgtgctatggaaaaaccatatagagtaggctaaggaggaatcagaagtgccaacatggaaggaggttgacattataagtagggtggtcaggataggccttactgagaaaatatgatttaagcctagtcttaaaggaagcaaggtgggaaactatgtggatatgtaggggtagagtgttatggacagagggaatagcaattgcaaagaccctaagataggtgtctggcatgcttgaggacaggttaaaaaaaatcaatgtggctacagtggaatgtgcaagcaggccaaatggcatcgactgataagttattataagaactttggcttttgtagttttgagcacaagagtgacatgattatatttatattttaaaggattactgcctgctattttagagaatgtactctgggaggacattggtggaagcagggacatcagttaggaggccattataatacagtaatccaggagaaaactgacggtggtttgtaccaggataatagcaggcagtaaagatgctgagaagttgtcatattcaggatatattttgaagttagaaccaatgagatttgctgttttcttggatatcaggtgagaaaacagaaggtcaaggttgacactaagactttttagctaaggcaactaaaagcatggaattttattaattgagatggagaatactacaggaagaatacagaatacatttggtgggggaaaagtagacatttggttttggttttagaattgttaaatctaataggtctgattgacatatttctacatggaaatgtcaagaggacagttagatgtaggaatctgcaattcaggtttaagggccaagctggaactacatcttggatatcagtaaacctaaagattggattttaaaaccatgagattgaatgtgaccacgaagagaatgaatgtagacagagaagaggccgaaagagccctggagcactccgaaattcaaattgaggagaaggggaagaatcagcaaaggaaactgagcaatcctggtacctgaccctgagaatatggatgcagtttccccctttttccaaaacgaaatcaaacaaaacacatggaacaataggcagttttatcattgttcttattttacctttttttttttttcaagggctatttcccatgaaatctgctcagtctgtttataaatggaccatgcaatggtataggagacctggacattccagggcatcttctggtgtcttttgagctagaaattgcttcctttctgcaaccttgtctagaggcctttgaagtccagggatgtcataagactcttcttactacatcagagggattctattaattaccatgtctgcaaatgatctgttaacttacctcttggtctcctttgccaaattttcttcagctctattacatctttgaataaatgtcacttcaatttcagttaagaagactcttgaggccggccgtagtggctcacgcgtgtaatcccagcactttaggaggccgaggcagatggaccacttgaggtcaggagttcgagaccagcctggtcaacagtgaaaccccatctctactaaaaatacaaaaattagctgggtgtgatgacgcccacctgtaatcccagctactcgggaggctgaggcatgagaatcgcttgaacccgggaggcggaggtggcagtgagccaagatcgcaccactgcacatcagtctgggcaacagagcgagaccctgtcccccccaaaaaaagaagactcttggaaaaacttttattagaaataaaacaacacctaaaagttgttactgtatattaaaatttgatttctctggggtggctagaatgacagttacagactaaatttaaagctaaaaaatactttaaaggtcacctagttaacactgtcattttaaagttaacagctgaggcccaggagattaagtaccttgctagtgtcacatagttgtagtcctagtgcacagctgttgcactaccttccaaatttgtatctttatatctgttatatctcttatatcatattacatactgttatgacaaataatatagcataatagttaagaggacacacccaggagctagactccctgcatttaaccccagcttaaccatttaactactttggataggttatttaacctttgtatgcctcagtttcctcatctgtaaagtagggataataatagtctacctcttagagttgtgaaatgaaaatgagctaatacatttaaatagagatgattacaatccatttaaattattttccaaatctacaagttcctacatctggatgagagtaaggctttcggaatacttttattggccttaggatcacatgattttgaagttattaatttatccttaaagaatggattatttggagagtcacagaagtagccccaaatcttctataactccaacatgtgttctgacacataactgaagaattttgaggaataaggtttaaaggagattgctgaagtagggggaaagaaatgagtagaaaggaaaggaacaagaactaaatgtttcaaattgtgtttggaacctgttaagcatctgatcaagtcaagtccctgcagcttctctgtcaagcaagcaggctttcatttttatgcctaaataacccatcccatttatgcttctttgccagtgcttccaacagtcctagtttcagagatctttactattttttcccaccttcttcctttgagtaaatagcagccctttttctccaatttttcacagcgttgcttctggctatttgctggatcctttctctcgagcagaattttttaatcttgtgaaaccactttatctgctggagggtatccagcaactttctgtccactctccaccaccagtcagtatttttgccattctccttttaggtaaaatcctaagtctgttttgttttcctctctctctggggctcgattgcctaatatggtaaggtatttcccagacaagattgcgctgtggagttagaacaacagtttgtctaagtttaaagacatggtaggtgagctatctaatagttatttatgtagtaaagtaatatttttttttgcagtatattacataacaaccaaaatctattttttaagcaagcctctgttgcttttaacagacttaaagagataataaaatatagatttttctcctcttaacctgtttaggcagatttttttttttaaaagggaaagatagctcgtccccagaatgaaagggttttgaaaagtctgagaaatttgataacatgataatgttcataaggatataaaagtaagggtaaacttgataagcaatggctgttataaacagtcctgtggtagccagcctctgggaattggcaggcattccacgtgtagaaaagcaagctgtcctggatttctgcaattgatgacgatgcgcagtcccagggaaaaagatagagactgagaaatggcagccaaccaactctgtatgtgggaagctgcctgttatccagcatgcactgaggaatcttctctagtggttgactccacattggcctcgaaggatctttcctctcactgtacatttgctcttgctttgcaactatagtttcttaaaatactgcagatgctgtgattttctatatatgggttgtgtcttgctgtagcccaagctgtataaaccatcttaagaacaaagtttcttttggcatcttccttttatggactctattaattttaggtcgtgctgttgcccaggaaatctcagtaatcaaagctcacatgtattcctttgagaccctgtaatttttggacctagtgtcccattacatcagtgaattctgctttaatcataaatcttttttaagatagaataaattgatctttgaggtatctgtttggacttctctcatgcatctcatccaaagatgtgaaaggtttatccagctactaaggatagtatagttaacttcttgaccttttctttttttgatttcttcttctgcctccaattgctttcaagatattagtttgtgttagtgacttgtgaccttatgtctttttattataggaacagagatgagcttaaaactctgctggagctttttaaaaaaaatgtttataaaagatagtaaatttcattaaagaaaattcatgaagtatagaaaaatataaagtggtagctctcaaaagcagcaggagaattgctaaaggagtttgtaaaaattcatagggctactttcagggaatacagcgatgggggatgttctgcatgcattaagtggaaagggtgagagatgctagatatcctaaaatgccccatatcaaacaagtatcctgaagcttgcttgacttttgactgtctcccttgacagtcatagatgaaaacctatcagttatctgagtctaaaaccaaacttgattttatgtttaagctcatttttgaggggcagtggggaggaagacagttctaaaaattcaaccaccatgtaaatgaggagaaactgctcttagttttatttatccctgacagcaatgccacttacataatgcgtacatcatgctacacgttctgtagatctgcatttaacctctgccttcatggtaactatatgatgcatccaaatctctgactgcttctttatgccttctactttactggcccaagcattaacacattaaaatacatattttattataaagtgctttgctctttatttcttcttcatattctgttatttttaaaatgattttagttttatatcagtgatttttatttcaggatagtaagggggtgttaaaaatatttgttatgaaaagggattgtttcagctatgaaagctaagaaaaaattgtccataaccatccataactatacttttcagaagaaattattaacattctagtgaatttcctgctggtatttttccaaagtttttctttttaaaaaacgtattcaaaaccaactaatgacattctttagaaaaggatcattgtcaacttgagcattcctgggacaccatcattactatgatgacaattttataaggttgtcttcaaagcacttgggttcaactcttttatcaaagtagtcctatgatggcgttgatcatagacagccccaggaataattgtttctctttcagttggagtctaagagttacctcggttacagaagtattcatttctcctgttgatagcatggctggagagccttaaccatggcttaggcttagctaatgttagagttctagccccatgattgaggtagaaagcttgatgtgggatttgaagtcctttttcagcaaatggaatgtttatagatttgccccagcaggaatgttgagcttaaggcactaacagacgttacctttagaagtgttattttggtagaatctcaaaggtaggatagtaggactacctatcccaagctgtaaagcttcctgtataaagcttgtaaaaatgtaaagatgaatggccaccacctcccaattttaacttttctccatactgtctcagtcttcagtaaagcaagttcaaggatcagatagcagccatttagtgacatgaatctcttcgtagagaaaccatagttttgtaacctagtatgatcctttaaggtacataaatgttcacacagatgtgccttcatagaatatgtacttttaagaaactcttaacttttttatagtttaaatttttaaaaatgttttattacaacctgaactcttacaccttaaactatgtcagtattattggctaccaagaggaaagcagggaagttttaaaaatccattggcaaattaatacctagcataatacataatacaagtacttattatggtcttggagcttatagctcttgttatgtttctgaaaaattttttcaggaaacagaagcattttaaaggcaaacaacatgtttgagtattatgtcaccaaataaaacattgtatactttaagatggcattttaggagttggaggactttcaaaagtgatatgccaaatgggcgaaacatggggctgtttatggtgactgaatgctgtatttctcatttctcgaaatgtctggtatagctactacttgctggctgttgtgaagagtcaacactctgcctttctgaggctgatagggaaagcagatgtttatacctattctccggcagaacatgttggtggtgggacagtggtagcagcctcacttcatctttggcacgtgatgctctaggtccgcaaactttttatgaaaagggcctgatagtaaatattttccactttactggccacgtaatctgttgcaatgactgaactccactgttgtaatgggaaagcagccacagacaatatgtaactaaatgggagtgactatgttccaataaaactttatttacaaaagcaggccggtggactggatttggcctgcaggccacgctgcagtttgctggcctctgctctaggttactgatagaaaaagtatttgctaatgtcaacataactccaaatgtcaattttctctcatccaagcacttctctgataactcagcattgtgccaattcccgattctttgttatcagcaacagtttgttggggaacatcatgtgtttagagggataaatgttgtttggggcagcattaatgagttttggtcatgcagcaggaagcaagctgtaaaacttcctgaatgagaaagtgaaggagagagggggagttgcttccatgtcattttaaatatagtctctctgttatgttttagttcattaccttttgaggagaaagtctgaaatggttctcctagcgtgtccctatctgtttttctcatctgatcctattccttcttacttcccaaggaccagtctttgaggttagctaagattatagttgggaatatataatcacttaatacttgaaatttagcttttgtagattatgaccgtaagtaaatttgcctttaaggctcacaggttcttggaagagtgcctgtcagaagattgttagttgctgtcattcactttaattgcttgttgtcatttgaattccttaattaggagtagattatggaatttactagtctttttgccttgtcaacgcttagtctactgaatatgtgcaggaaaaacattttggggatttgtggaggggatgacagaaatcttcaaagtgatgaccctgtgcttgcttgaaatgatagttaggagggatggatgtgggggaagagaagctgaaatcctgattcttcaacaattttaaggaaaaaagtgatgaaaactgacattaatatgtcacagtaaagactcatataaggtgtgggaattgagcatgggatggcataattaattttgtgccaaataaacaaaatcagatcctttcttgagaataaatgttcacacagatgtgcctttatagaatatgtacttttaaaaaactccatatatgacatgttgtatgagaaggcctctcttagatcactggtgacctctagtactttggactaaaactaatgaaatattatttaggcagtttatgtatcatttctggagttcttgacttagagctaagggcgtgtgtagatactgatatccagcaagctgagccattttcaactataataacctaatgggtaaagcttctatagtagtctccttcaaacctgtcagtagcaatcactggggttatttgtttacaatgtaggtttttagacctctccccttgagattctggataaggaggtgacatggtggtagcgggtggaagtcctggaaatctatattgtaaaggtcttccaaagtgtttcttaacaggcaagtctgatggatagtgttcctagaggtataatgtttagggattgctaacatcccaggtaggccaatcattaaagagtaggattaactgtagcacactaaagaagcttagagccaacctctactcctttctgtcctcccgaaatacacatttaacccagagtaccaaattctcaaagaccctctaggacaattgagtcccatttgggatgtcttttgctctcatgcagcatgtgtttattcagtcaacatatatttattgatgagccattatatgtcaggcactatgcattagagatgcaaaaatgtacaaggtagacaaaattcctgacctcataatactcacattttatttatttatttttgatatgtattatagatattggagttatccaatacaagttttattcaggcaagtatatatatattatatattatatatttatactaatataatatataatataataatatttatactatttattaatttataatataatttatatgtattaatttataatacatataaattatatccaaatttatacaataatttaaaatataatttattaatataaatataacaattatatcataatataataatatataatatatattatatatattagcagagtcttttaaagtttatttcaataattttggggaacaagtggttttttggttacatgaataaattctttgatggcgatttctgagagattttggtgcactcatcatgcaagcagtgtacactgtacccactatgtagttttttttttttgagacagagtctccttctgtcgcccaggctggagtgcagtggcgcaatctcagctcactgcaatctccgcctcccgggttcaagcgattctcctgcctcagcctcctgagtagctgggactacagatgcccgccaccatgcccggctaatttttttgtatttttagtagagatggggtttcaccgtcttagccatgctggtctcgatctcctgacctcatgatccacctgcctcagcctcccaaagtgctgggattacaggtgtgagccaccgtgcccggcatatgtagtcttttatccctcatccccattccacccttccccctgagtccccaaagtccattatatcattcttatgcctttgctttttcatagcttagctcccactttcaagtgagaacatacgatatttggttttccattcctgagttattacacttagaataatgggctccaactccatccaatttgctatgaatgtcattatttcattcctttttatggttgagtagtattccatgatgtatatataccacaattttttttttttttttttttttgagatggagtttcgctcttgttggccaggctggagtgcaatgacatgatcttggctcactgcaacatctacctcccaggttcaagcaattctcctgcctctgcctcctgaaatactcacattttaatagggcaagggatatttctattagacatccaagttgagatgtcaagtagacagttgtcaactaggaatttggactttatgggagatattaaagctggagaaatacagacatggaagtcattgctttagtgctggtatttagagtcagaagactgggtgagatcaccaaaaagcataattaaagcagaaaagaagtcacctgactaggctctaggatattccagggctaaccctagaaaagagcaggaatatttcttccatgatacatatacagacagttgttgaatctcttgttgtgaaagtgagatcatgccgatctgacttattgtgatacatacacacatacccctttatacctagagagcaattagagcctagggtccaggtgaaagataatgtgctgagtttctgatggtaggtgtggagagaatggaacaatgtaagaaatatgaaaactcagcaggatttgatgttttactagatgtggatgataaaagcataaagagcagtcccaaggtatttgggaagatgcatggaattggctttggagccagaagacctaggttcaaagcttgttgcatctcttattagctgggtggtcttggaaaagtaatttaacctctctgagctctgaaagttctttaatctgtaaaaatgagattattatccttgttttgtaggcttgatacaaggaacagcagtaataatgtatataaagggtttagcacagtgcctacatttggtaaatttttaaataaataaaggcagctcatatggtagtatttcaccagtctcctctcctcccatctttgagctttcatacatggtattttcattctctagaattctcttcctcttactttactgcctcttcctctccctactccactttttaaaaacatattcatgttttaggttaagcaccacctcctctaagaagccttcctttgaccccctccctggaccagactaggtttcccctagcactgtgaatttatctttaatatggagtggtaatcatactatgttgtatttgccaactgactgaactccttgaaggcagggtctggaatgagatggagtctcattccagtgcccaggctggagtgcagtggtgcaatctcatgtcactgcaacctccacctcttgggttcaagcagttctactgcttcagcctcccaagtagctgggattatagtcgtgagccaccatccttggctaaattttgtatttttggtagagatggtgtttcaccatgttggccaggctgatcttgaactcctgacctcaggtgatccgcccgcctcagcctcccaaagtgctgggattacaggcgtgagccactatgcccagcctgtttcttgttcattatatttacaagaatatctagtatttaggtatgtcttctgtgaatagagaacaatgcaatgcatgatattcattttttattatgatgactgcatagataatatgccattaataagattgagaattcaggaggaagaatatgtttggggatgaagataatgattttgcttttggacatgctgagttcaagatacctatcagacataagaaagtaaatgtcctataggcaattagatacatgggtatgaagtatagggaagttccagggctagagataaagagttgaaaggtatcagcttgctgataatagttttaagctatgaaaaatacatttcccaaggttaacttttagagcagtgattcccaacttcttttcttccccagaattctgatggatatgaggtactcactgtgtaactgtggttcaatgtctcaatgactctgaagcaaaggcaagcaaaaggagcatgtttcccagggaaggccgattatcagaatgattgtggggtgctaaggagggccactgctatgaaaagagtacacagtttagaacagagccagggcacaccactgtttgagatggcagaaggggagaggtacctatgaaagagatcaacagggaaatgatcagagaagaaggaaaagagcctggaaaggagagttctgcttttagctcttggaggaattgccaacactgctttacacagtgaatactcccaccaatagtgtataagcatttccttttttctgcaaccttgccagcatctggtttttgttttgttttgttttgttttgttttttcttttcttttctttttttaactttttactaatagccattctgactggtgtgagatggtatctcattgtggttttgatttgcatttctctaatcatcagtgatattgagctttttttcatatgcttgttgactgcatgtatgtcttcttttgaaaagtctctgttcctgtcctttgcccattttttaattgggttttgtttttctcttgtaaatttaagtttcttatagatgctacatattatacctttgtcagatgcatagtttgcaaatattttctcctattctgtaggttgtctgtactctgttgatagtttcttttgctgtgcagaagctcataagttcaattagatcctactagtcaatttttgcttttgttgcgattgcttttggtgtcctcgtcatgaaatctttgcccatttctatgtccaggatggtattgcctaggttgtctccagggtttttatagtttggggtttatatttaagtctttaatccatcctgagttgatttttgtgtatggtgcaaggaaggtgtctagcttcagtcttttgcatatggctagccagttatcccagcaccatttactgaataggaagtcttttccccattgcttgtttttgtcagctttgtcgaagatcagatggttgtaggtgtgcaaccttatttcagggctctctattctattccattggtctgtgtgctgggtatatactcagaggaatataaatcattctaccctaaagacacatgcatgcgaatgttcattgtagcactattcacaatagcaaagacatagagtcaacctaaatgcccatcagtgacagactggataaagaaaatgtggtacatatacaccatagaatactatgcagccataaaaaagagtgagatcatgtcttttgtgggaacaaggatggagctggaagccattatccttagcaaactaatgcaggaacagaaaaccaaataccacatgttgtcacttataagtggaagctaagtgatgagaacttatgaacacaaagaaggaaacaacagacactggggtctacttgagggaggagggtaggaggagggagaggagcagaaaagataactattgggtactaggcataatacatgggtgattaatctatgcaacaaacccctgtgacacaagtttacctatgtaacaaaccttcacatgtaccccagaacctaaaataaaagtgtttgtttgtttttttaaaaaagagtagtattcaaccaaacaagggaatgaaaactttcaaagactcaatgtgacagaaacttaacttcttataactcaagcataaaggcttatgtagctagaaaatctgcatatttagcctggcctagctttaggcatagctaaatctaggaagctgaaactttcagatccctgctgccttctttgcataggcttcagaggaagaaagaccttccctatcctagtgtccatatatcttttttttgttttttgttttggtttttgcacacaggatcttgctctgttactcaggctggagtgcatggtgtgatcacgggtcactgcagcctctacctcctaggctcaagtgatcagcctcccaagtagctgagatgatagatgtgtgccaccatgcccagctaattctttttattttttgtagagatggagtctcactgtgttgcctaggctggtctcaaactcctgggcttatgttgtcctcccaccttggccttccaaaatgttgggattacaggtgtgcaccaccacacctggcctcgtagtgttggtatatccgattgacctttcctggatcagatgaacttccctgaaccaatttctatagccagaaattagatgagatttagcgagagaggcagtgaagcctgaaccctgaaaccaagtttaattcaagtccctcctctgctacttactgtgtaaccttgccaaattatatactccctgtgtctcagtttccttaactttaaaataagagaaatcatagtacttatcacataggtcatttctttaaatgagataatacatacaaagtgtacagaacagtgtctggcacatagtaaattatcaataaatcttagccgccatgatgatcataatgataacaatagtggtagtgctggtcatagtgatgaagaagaaacaagagcagcagctaccacttgttataggggtagggttaggagagggtcagctacatggaatagattccccacaggaaatagggattctgttatcaaaagaagagaaagagataaagggttggaaagataaattatagctaccaatagtcctctgtaatcacatccagtagtttgagagctgaagagtatctcgtaggtttgccagtaaggagatgttgctgacttgtgagagcagtttggtggagtggggctggggagcatgaaaggatgatatcttctctttgtgactcatctgcgtataacgattttgatggattttctgggaattaatagtctttggttagtagccatttgccttgtgggcagagctccaagatagtttgccgttaaaaaaaaaaatcctcataaaggcttaaacagggttcaaacagatctaatcgtcatatcatttggcacattgtggtacctgattccatctaaattgttttcccctaacaatccttagtccacatttctgctttctctccttgttaagaatagatggcaggtcaacattcttgcctactcctgcaagagcatcttgaaggaatgaaaggcaattatacttctgctgcaaaggagcattttccacatgttatgctaacagttatgaaaatagctagttattggattagttagtgaggtgtgattgtcagttttcatcaggttctcattactggtaatgttgcccagacctacattttttctctgaatatgcttctgccttttctgtgtctagcttacttgtttacaaaatgttttcagagagaaagtctaattcagggttaacaaagttctgctaagtcaccccaagattatctgggctaaaaacttcttagtttttacagagtacagttgtggaaaacagctcttaagagtttctgggttaatctagaatgatttcctaaaagaaaagttttagaagaattattaaaggaattttttcctgccagctctcccctcccaaattacagcagcacccacagacaaatatcacaaataaaacaaaactatataacagataaatatgaagaaagaatgaggaactgagaactctagcctccaactttaccattaataaaagcacattacagtgttccagacttgctctgtgaataagctgttctcagctatgtatttacgttagttccttaagttccttccagaatttatttcctaaaaatattggggcttttattgttactgcaacccacaactgacctttcaggaataaattagatttagatagtgattattagaaagctatttcaaaatagacaattaacatgcataagaaaaagtgtgtaaccttactggtgttcgaaactataattaaaattataatgaggtatctttttttttttttgagacagagtcttgctctgccacccaggctggagtgtcatggcgtgatctcggctcactgcaacctccgcctcccaggtttgagcagttctcctgcctcagcctctcaagtagctgggattacaggcgaccactatcatgcccctctaattttggtattttcggtagagatggggtttcatcatgttggccaggctggtcctgaactcctgacctcaggtgatctgcctgcgtcagcctccgaaagtgctgggattacaggcgtgagccactgcacccagccaaagtaacatttttttaccagtcatgataggcaaagactttgaaaagataatgcccaatttagccaagaatgtggtgaaatgggccttcccatattttactgttgggaatgcaaattagtcattattttctgaggagcaaatggctagattgacaaaagtcccaaattgacccagaatagccccctatgaaaatgtatctctgggaaacagttctaaatatgggaaggagggggattttatgcacagaaattgttatcacaaggtatgttatatataggcagctctgtaaatattcattctacaaatacttgagtacctactatatggaaggctattaggcactattgaacaaaacagatttagctcgtttagctatttataatagtggaaatattggaaacagcctactgtccagtattctggcagtggttaagtatactatgatttatccatctaatggaacactatgaatcatagtttgctttaccattccccaccagctagccatttaggggtgtttccttaaaatagagtggattataaggcagccatttaaaagtgagttacaaagatagtatagtaacttggataaatgcttacagtatagtattactaaatgaagtagatacacaattgtatatgtcatctgattacaaccataaggatgtagcaggcccaggtaaagagaccagggagaaagtgagcaaagtgttagcagtggttgtatttctgtgatgagactaaatgtgactttttttctgcttttctttatttcccaaattttctttaatgaggccttgttatttgtgtaatttttccccccttaaatgctttggtaacacacttagaaaaagtttgcatgaaagtgaagactgctcagtggctatttcgtgaactgagtgggaattttgtcagagaactttatccctctcttttgactgattggctatttcagctctggtggaagtatgcaatagtggatagaaatctgctggacactcacccttaatatagtctgtctatacatatatagcagcgttgatgcaatacactgtgcctcacaaatagcaatgtagatgataagatgctttttgttgtttttttagaaaacagtatgtctttagtatgttatttgaagactcgggattatggctagctgtgtgccaactttccatccttcagacctataaaatctgaatcagtttggttttttactgcattgtggtgaaattaaacaattcacataaatttttattgtggctgatagtcaaggctctaggaagctctgagatttaatcttgagttttccttgccacttcaacccaattaaaaaatttttttttttctttttcttttgagacggggtctcactctgtcacccgggctggagtgcagttgtgtgatcttggctcactgcagtctccgcctctagagttcaagcaattctcatgcctccacctcctgagtagctgggagtataggtgttcaccactacacccagctaattttttttttctgtatttttagtaaagatgggcttttgctatgttggccaggctgatctcaagctcctggcctcaagtgatccgcccacctctgcctcccaaagtgctgggattacaggcgtgaaccactgtgcctggcctcaatttaaaaattattaatccactcttaacttccatttagtggaactccaattttattctttcttttctcattgtcttccctacatttctgttcacatgaaatttctaattgtacagactttgcagtgtgcagagtcaaatctctcatatcctgtaactttgctgcatgctccttagttttttctttatctacacatatatctggtcagtttgatacatttttttcttttttggtcttctcagctattagaaacagacatgtttgtagaaaagaactcttaccatttgttgcgtctgggacttgtgtggagggtttttgttttggtctgggttggtttgctttttctatttaaaacttagattgtgtgtacacccacacagaaacttcatccagctaccaggctattcctttgtagagtggtgatcaaacaaaaatatgcatctggtgattctttcatttgatttgaaaactgatttcagaaacacattattttcttcttttacctggcagattatttctgagcaagctgaagaatggaggactcagcctacttataaagtaccaaactgttaaggtcacagaaaattatttctggaaggtacattagaagttgttctagcccaactctcttattttacagatggaaaacctggggcccaaaagagggcctggcttagcctaagctgtacaatgacttagtggtagaaaatgaactagaacatttctgaattcccagtccagcattctttccactaagctgatggctgtcttccaggtgcaggagtgcaggttggtacttattacaggactctgctggctgcagtggctctttctggtgctgtggaaagtaccctcttctttgctcagtctgattccatttatgggaagcagtggtggagtttgtacataagatttacagtaaagtctgctgctgtcccaagtttcttaacctttttaaagtcatcttccttccatttctgatttcctagtacatctattatttatttcaatgtaaacaaattccaaataatggaaatttgtctctactacagcttattcaagtttgaactttgagtatatatgctaatgtttacagactggtgagatcaggaaaattgaactgctgttatttcaaaagtgaaagctactctgggacttctaggtcagggtggcagagtgaatactcctgaatcttattcctctcattcaaaaacagagaaattatgcataaatatttttaaaggttttaaaaaatacatagttattcttaaaaataagaaagaaaagtctctttgggccagtaatagaaaagccactatgatggcaggggatcggggggtgctatgaatggatatgggcaattgggaccaggtttttttgcaatgatcctgtctgtgcatgaacccaggacccaagagcacaatacaaataggagctgggctaatctaacttatcccagcagtgtcacagccaggaataagctgcttgttcctgaccagaagtaaagaagaattggcagtcacaagcaagcgcaggaaaccactcaagataggacttggacccaaaatacttttgggctaaaaattcagaactgggctacctaggaggaaagaagacccagagctaccaacttaaggtctggttcaaggttggcacattatcagatttaagctgaggcaacttaaaactgccctatagatacaggtacttacattttttagttatcataaaaattgagcccccaaaacattacaaagaacccagtaaaacctaagatcatgaaaaagcagtcaagagaacccaacaaatgagagaatttatacctgagaaaagaagaacaatctggtgagagtttaaaaataagttaaaattctcaatatatgtacagaagaagttagattttacagaatgaagaacagataatgaaacaagaagagaaagctgtgagaaagaagcgtttagacatcttgaagtgaaaaatattataaatacaatattgaagtaaaagaacagttagactgcacatactttctatagcttaagagaaaattacagaattaggaaatagaactgagaaaatctttcagaatgcagtttagagagagttagaagaaaatgaaagagaaagatggacatgaaagatgacctgaggagctctaacatacatctgctaggagttgcaaaggagaaaaaagaatgaataaaaaagtggcaataataataacaataactgcagctaagaattttttcagaaatgaagctgagtcttcaaaatagaaaatgctgccatatgtaacacaggatagataaatccacaactacatacatgataataaaatcgtaggaaattaatgataaagagaaaatctgaaattctgaatacaagtataagaaaaaattctgaataatggaatggtagtcaaattggcagtaggctttggcaacagtagataccagaaaactgactagtatcttcaaagtgctgtagaaaaataactgtgagcttccagtttcatacagtggtttatatacagagtgggagcaaaataaacacatcttcagatacacgaagctaagttttcaactcacaaactcttggtgataaaagaactaaaggatgttcttcagtaaagagaaaaataaatgcagaaagaagtggaatactaaagcaaagagtgttaaaatatgagctaaagctaatatgcttcaaaagctagaactaaatcttagcaataataatatggtattaaagatgtaaatgtgtgctaaagtccttgttttgagtagaaaagatacagatgaatgttatagacttttaaaaaatatatatttaaataagtatgttaaatataagggtatccagtatagtaatagaaatatagaaatagaaggtacaagtccttaatcagtaggggaaagagaaaagataggtaatattttaaatgctttcactccattcaatagagggcaggaaagaagataaaaagaagcaaaggaaaaacatggaaataggaaatacaaaataaaatatgtaagtagtcataatataaattaatctacaaagccagagagatagtcagattatccttccatatgctgttttcaaagtaacactgaaagataaaaaaatacaagtataagacaggaaaaattttctcttggttaccaccaagtgaaagctggcagcatgaacatcatttgaaacatgaacatgtttttgctttaaaacagcaaatgacagaaatatatgtctcacttataaataaggaacaatccatgaagatgatataaaatgactctagatactgaaaatatactctcaaaatatataaaacaaaaccgacagaattatcaagaaatagcatatccacagtcagtgttgcagattttaacacacctctcttagaaaccagtatatcaaaaagtcaaaaatactcaagaacataaagaatttgaacagcataattaaccagcttaatctaacagatatatagcacacatagggcgtgtgtattgtgaccatgctaaatgaaaagtcaacattcactcattcattcaacaaatacttatttgtccaatatttgccagatattgttcgaggttcttggaatcctttagtcaacagtatagacaatgatcctgacctgttgaagtgtacattctagcagggagtaagatgaaaaggcagacaataaacaacaaacataataaagtatgtgttagacactgatgcaatttggaaaaaaaactagaaaggagaattgaataaagaggattggatggagaaagtacaggttgtaatataaacagtgggtctgagtatatcttattgacaggttgagatttaaagaagcagaaggagttagccacaaagatatctgaaggaagaacatttcttcagatgtagtgtagtgaggtcctctagcaagagggtacagctagagcaaaggccatatggtgggaaagtactgacacatgaaataaatgacaggtgagagtagcaggaaagagaatcagatcatctgaatgcagagcgtcataggcctttgtcatttactatgcacaaaatgaggcgccattgcaggattttgagtagaggagtgatgtgatctgacttaagttgtttttttgtttgttttttgttttgttttgtttttttgagacggagtcttgctctgttgcccaggatggagtgcattggcgccatctcggctcactgcaagctccatctcccaggttcaagcgattctcctgcctcagcctcctgagtagctaggattacaggtgcatgccaccacgcccagctaatttttgtatttttagtagagatggggttttaccatgttggtcaggctggtctcaaactcctgaccttgtgatctgcctgcctcggcctcccaaagtgctgggattacagatgtgagctaccgtgcccggccaatctgacttaagttttaaaagaatcattcaagctactctgttgagattagacttcagacaaaggtagcagctgagcagctatttcagtaatccaggcaagaaatgatgacaggggcttggatcacatggtagcaatacagttgttgaaagttggttagattctggatatatttgaaggtagagccaacatttcctggaagggcttgtgggatgtgacagaaagagggaggaattttagatgattccaaggtttttgacctaagcaactgataggatagagttgccatcaactgacatggggtaggctacaaatgaagcaggttggggaagaaaactaggaagccaatcttatttatttatttatttttcccatagattttgggggaacaggtaatctttggttatatgaataagttctttagtgtgatttctgagattttggtgcacccatcatccaagcagtgtacactgtacccaatgtgtagtcttttattccttacccccctctcacgctttcccctgagtccccaaagtccattgtatcactgacaccttttcgtcctcatagcttagctccctcttatgagtgagaacatataatgtttggttttcagttcctgagttacttcacttagaataatggtctccaattccatccaagtcactgcaaatgccattatttcattcctttttatggctgagtagtattccatgttgtgtgtatatatataccacaatttctttatccactcattgattgatgggcatttgggctggttccaaatttttgcaattgcagattgtgctgctgtaaacatgcatgtgcaagtatttttttcgtataatgacttcttaggaatccaattttatttttttattttttggacagagtctcactctgtcacccaggttggagtgcggtgacgcgatcttggctcactgcaacctctgcctcctgggttcaaagtgattctcctgcctcagcctcccgaatagctgggattacaggtgtccgccaccacacccggctaatttttgtatttttagtggagtcggggtttcactgtgttagccaggctggtctagaactcctgacctcaagtgatcttcccaccttggcttcccaaagtgctgggattacaggtgtgagccaccacacgtggccagaatccagttttagatatgttggtttgagatacctgttagatttccaactggaaattttggcagtttggttatacagatctgccaaaatgctgtggagtatttagatgatatttaaagcaatgagactgtatcaaataacagaaagaaaatatagaaaagggaagagggcccaagaagtatctggtgtcctttccagtgtgagtgaaaaaaaaaaatgtatcatgaaagaggtagttgtcaacagtgttaaatgttgctgatagggtcatataagatgaagactaagaactgaccattgattttgataacattatgaccttgataagagtggttttgttcgaatagtgggacagaaagcctgactgaagtaattttaagccacattgagaagagaggaattgaaaacattgagaaaagctttttttttttttctttttttttttttagagagaagtttttcaggaaggggggttagcaaggaaatggagtggcagcttttggggagagtcaagaaaaggatgttttttgttttgagatggagtcttgctctgttgcccaggctggagtggtgcaatggtgcaatcttggcttactgcagcctacgcctcccaggttcaagtgattctcctgcctcagcctcccgagtagctgtgattacaggtgcccgccaccacaccttgctaatattttgtagttttagtagagacgggctttcgccatgttgaccaggctggtctcaaactcctggcctcaggtgatccgccttggcctcccagagtgctgggatcacaggcgtgagctgccacacccatccagaaaagggtgttttttaagctacatgtttgcttgtgagaatgatcccaatggagaacaacaacaacaacaaaaagatgatgtgggaggaagaatggagaactgctgtaatgaggtccttgagtagggtctagggtacaagttgaaggatttgacttcaaatagaagcatgttagattcatcaatggtaacaagtgaggagatgataaatggtggttaaatgtggtaatagtttgtggaagttcttttctgattgcttcagttttcttagtgaaatagaaagcaagaccagcagccaagaaagaacgtgaggaaggaggtgttgggtgtttgagttaaaagggaaaggggtaaagtatttatctaggaaagtaaatggactagggaagtatctgtgtgtgcattatagtccactaaaggttcaaagtaatgaatttaaattgagaccaatgagcatggttgtatgtttttttccagccacatttagttgcacaggtgcgggtgtggagtaggcagaaaattggatttaaacaaggttatagttttgccaagcactatgaagggagagaggggagagtgatgataataatgataaatcatggaatgtaagctcgataaagaggagagtgaagggacatcaagagcatgagagacagtggagatttcatgaggttgaacaatgaacaatagttcaggatcaccctagtagaaagaataagctggaaagatacgatgtggagatacagaattgagattatggaggggttatagttttttgtaatggcaacaaaaagttagctgaagaagaaaagaatacttctgaaaagtataaacttccttgtagatactgcatgggtaaggaggtaattataatgagaattacaaaatagttagagctgaacaacaatgaaattacttcacattagatcttgtagagtagctaaagagagaaaactgtaaccttaaatacatgtttaaggttaaaaaattagaaaaagtgaaaataaatgagctaagctttcaactcaagaagttgaaaacagagtaagcccaaagtaagtagaaggaatgaaataaaataaagataaaagcagaaattaatgaacagaaaacagaatagcagtagaaatagtgttaataccagaagctgattctttgaaaagatagaaaattcaataagcctttttattttccaatgtccaccttgactgcagtgttctaggacttctcaaaggcatcttacatgctagtctggggcctgggatgcaaacaaaaacagatcagaggcagttattttggcaacaatagggagagagaagagtcttcaaggtcccttaaagcaacacatagaacaattgagctgcatacataaccagggcatctactttttccagctgctgcacactgagccccatcagggagggtaaaatgcagtaaacctttcaaaagctgatctagagaaaaactataggtgaaaacaaatagtatttggaagagaaatagggacaaaattaagataaacatatttaaaatataagattattttgagcaactttatgacaataagcttgaaaacttagtttaagtggacactcttctgggaaaatataaaatatcaaaatgacttaggaagaaatggcaaaacaaagaagtcccgtaacctttaaagaaatttaatcatacttaaccaccacctccccaacctcctgcccaaaacaccaagcctagagtaatttgggggatgaattctatcaaactgtcaaggaacaagtataataatacttgccttacataaactgtttcagaaaataaaaagaaggaagcgagaatctacactagattgttttgcctccaacttgtttagtaacaacaaaaagaggctaagaattgaggcaaagaaaaaccaaaataaagtctgaatacttcccacaaacagcactagaaaaagacatctgattatacctaggtggtacaggttttaaggattggacctttgactttgtgctcatccttctgtgtggaccagctttgctctttgattccagttattttaattccagttgtaatgatgggttttggacactctcagtcggtattatgaccaacagcatgtatccgtaagatagctaggtcactaatagtctgtggcatggaaaaaaatttgttttgttttaatatggtgctaactaagcatatagagattgactctgtaactttaactccagtaacacactgttatcaccacgcaaattgaccagcctagttagtaacatcatatgcaatatcatacaaactacgtagaaccatgcctggggcactcatctgttagctcttacatgccctttgtgctcaaagagaacaatttgtggttgttgtatgccagtcaattcagtcatcatggagcttagttgtttactgtattgcatgctaagcagtagactctaggaatctaataaatttgattctcacattggtcctgtttgccacaaacattgccatgcctcaagaacctcacaagtttgtttttcttagaacagtgcatatgtagttctcatactctgcaagtgtttgcctcagcataattgtgtttatgtggaattgcactggcattgcaatgtgagaatgacagagttgacaggaccactaacatgtaccctgggaattgtttcccccatccccatagctggctgaagaaactttatttctgagttattatgtagggactgaaaggttttttttttgtttttgtttttgtttttttttacatatatacacagattgttttttacctacaatgagcaaaaataatctggacaaaaaaataatgctctccctgttttttctttcaaatgtatacatatatttgaaatcttaggcatagggaaaaacttttatgtcatcttcagagctacagccatattttttagctagaaccaactcttaaatctctcccgacagaaccttaaggaaggggacaaagtgatctccaatggaaatgtgaaaggcataaaaaggaaaagttagatatctggaggattcagatgacacaaagaaaataagttgaagataaaggaaatgagagggtaaacctagtagtacaatggcatctttcatcttcaactattttaaagtatttttacctgagaacgtgaagataaagtgtatatagatggcacgtagacaactaataaatgaataaacatttacattgcatatgtcagaagtatctgcaaagcaaaaagggtgcatgccagttcattgttgataaggaagagtctttcatatactcttccaggatctatgttattattgaaaaaaaaaaaaaaagaagttagatgttaagtttgggagtatttttagtaaacccagatgaagagagcagcctttatttctggatcaactgcaaattcacaactatgaagactagttgaaatatttaaatttctagatgaatcatacatagattgcttttcgtagggccttttccttaaaactctgcagttaactaaaagtgggaaataattatttttcttaacacctgatggaccattcagcctcatttataggctctaaagaaaactaacaaaatattttaaaaaatcaagttgatgacaatttaaaaacttacatagaatttctgaaccttctttaagttataggttacattttcaagaaactgatcgttatcaaacttgtgagctgaaatttaagtgtgttgctaccaggcagtaatacgttttgcctggcatacagattataagcacaacttaactatcacagatatctttgagaactaaatggatttatttattttaaaagttattctaaaattaattctgtacctttctcctctgtacctttctccttaagttttcaaaacacctttcttgacatataatttctgtacaactgcacatatttaaattgtaatatctgatgaatttgaggaaactatctccctaattctccctaactcttaactgtactaaatatttatagtcttaacaaaaatttcagataaatcatatgctttaaagctacttattcagtgtttaactgacactatatagagcccttttgctacttttaagctaatcaaaaaagatataatataccctgttagtgcttctgatcagttcaagcatttttttttttctcatcaaggtgctgtgagcatttggcagggtaattcttcactatgtgggtctgtttctagaatagcaagcattcagcatccctgagcctggcatttgaaatgccagtagcaccctccaatcattgtgacaatcagtgtccccacatattttcaaaagctcttgtggtaagtgttgccccttcccctccccgtgacaaacctgccccttatacctttactgatgtttctagcctatgtggcctacaaaaaaagtgtgaagggggaaaagctatgttgttcacattaaaaagagataggttttcatttctgctttttgtaagccattgctaaagttaaatttaattgcaaaatactaaactcttgaaccaattctaggacaggtttgcagaatgattttcttaaaggacctttataatctattaccctgaaatgaatttctgagacttaacattcgtaacactagggcatgattaaatatatgggagcaagattgggaacattttgtcagctagtaaagttattgtgagctccatgctgtgcaacttgtatatcctgtcttgctttgcctctctgttgctgccttgtactccaaaatagcaccatctcttctccctactcccagcaacccactagactatgcagaagccattagtggatatattttgttggtctgatttttagcttttttgcttgttcacaaagaacatgtgtcaaaggccctttattacactgaaagaattgcgtgacttttctctgttctgcattttcttacatgtggaattaaggctgactctttactctaaaatgattcattttgtggtaaagtccctaatatgtctccctcactcaggagcatctgtgcaggagtcaacattaaatgtgagttatcattattgatcttctccatcacccccaaaaggggaggattttcacatcgcataaattaaacaggattgagatggaaaaatcagaagaagaagaagtgacaaagaacctcctgtttcctttagaacttatttcctgcccccaagtaatatttttggcccttctaagtacccagtaataaaacgtcgctataaaagcatagaatagtaaatgaagctgttatgaattctagactatcttccaacttggctgtgtgctgttgatggtctcctttaaaaataaattgtttgtttagtatgagatcaaaaattatttatataaaaatatatggaagagtagggcttgatattttttaacagtatggagatctttttagtgatacaaattttgagatttcctataatctctttgaagacacgaatcatgtcttacagtactttgtatatccctatccctaatagtaccttgcatagaataagaacttaatagttgttagttgatggaagaaaagtatcagttgaaaataaaaataaaaatattttctttggatcttatattcataaatggactgaaaatgactgccctgttccaaaaggaggaacagagatcttaaactatacttcttaactggtaatacttgactcatcaccttcttgcctaaatctgaactaaaatactgtatattgtatctactcagaagtttataaactaacctaccaaaaaattgatttgaggacgaggcagagacatttttgaaagactaggtaatttccacctaactgttgatctcctttgggccttaaaggaccttgtggttttgttactagaaaagcagtccgatctggaccccaagaaagggttcttagatctcacgcaagaaagaattcagggcaagtccatacagtaaagtgaaagcaagtttatttagaaagtgaaggaataaaagaatgactccatagacagagcagccccaagggctgctggttttatggttacttcttgattatatgctaaacaaggggtggattattcatgagttttccaggaaagaggtgggcaatttccagaactgagggttcctccccattttagaccatatagggcaacttcctgatgttgccatgacatttgtaaactgtcgtgtcactggtgggagtgtctcttagcatgctgatattttataattagtgtataatgagtcatgaggacgaacagaggtcactctcattgccatcttggttttggtgggttttggctggcttctttatcgcagcctgttttatcagcaaggtctttgtgacctgtatcttgtgctgacctcctgtctcatcctgtgactgagaatgccttaacctcttgggaatgcagcccagtaggtctcagccttatttacccagcccgtattcaagatagagtgcctctggttcaaacacctttgacaaaaacataccaataccttagtctactatgtgtaatgcattccaacatttgctattctgtttattcactttttattgatctggttgtggccactaaattgattcataacctaataatgagcctcattgtaccttcagcccaagtgactgcctgtttccgttagcaaacccaattctttggtgaacatataatcttagagtcctctgtaaagagagactatctttcaaagttgtcaggaattaaaaaagaaagtcacttccttgtgcccctttctcactgtagtgagatgaaaaaactctgttttttttttaaacactgttaaacttacagaaatatttcaagaataaagaattgctgtataccctttacctagagatcacattcacttttttttttttttttttttttttttgagctggagtttcactcatgttgcccaggctggagtgcaatgttgcgatctcggctcaccccaacctctgcttcccaggttcaaatgattctcctgcctcagcctcccgagtagctgggattacaggcatgtgccaccacacccggctaattttgtattttcagtagacatggggtttctccatgttggtcaggctggtcttgaactcccgacctcaggtgatctgcccgcctcagcctcccaaagtgctgggattacaggcgtgacacattcacatttttaccagttgtcctaatgaagtccatgggagcagaaagatccaatccaggatcactatacccaatttttgtgtatctctagttagactttccttgacttatatgaccttggttttttgggggtattttgttttgttttgttttgttttgttttgttttgttgttgcccaggctgaagtgcagtagtatgatcttagctcactgtatcctctgcctcttgtgctcagaggatcctcccacctcagcatcttgagtagctgggactacggtgggcaccaccatgccttgctaattttgggtttttttgttttgttttgttttgttttgtttttttggtagagacggggttttatgacattgcccaggctaatcttgaacccctgggctcaagagatttgctctccttagcctcccaaagtgctgagattacgggcatgagccatcacgcctggctgaccttgatatttttgaagatagcaggccagtcatatatgtccctcagtttaggtttattcagtgttttctcatgattagacccagcttatgcatttttggccacagtgtcatagaagcgatactgtactcttctcatttcatgctgtcagtttgtcatgttactagtggtcttgtctttgaggactggattgagatgacgtctgccaggtttctccatggtaaagttagtttttcctcttttgtgattaataaatgttgtctgatgtggtactttgagattgtgtaaactccagtttctcctctacttttacccactactttgaacatccattaatacttctttcttggattgattttacagtcatggttgccaaatggtaatttttctaactttattaccccttctacatttattagtaggcattctattgtaagcaagaagcttttctcctcctatttatttttttcattcatttatttatatcaatgtctactcatgggttcctagtcagtgggttataattcattgctatcattatttattatgatgctcttattatcccaggtttggctttttaagcaggcttctgtgtccttgtgtcatatcatttaagtgttgtttgaggactttctcaccttctagcacaagagatcaggctcattttctttccttaccccagctctggaattagccatttctccagggagccctgttcctcttagtacaaagtggcatttagaaacaatgatctgggcactaggtacgctaaatgctgctggagtgttgctcttcccaggcccctttcagtggacagagctaggaaagacatacatatggatgcatttgcttacatatacatgtacatttacatctttatttctttatctatctatattgaaaatcatgagttcataccaacatggggttctttctagctttccctttttttttttttttttgtatttatgtctgccttctctaacaatgagaaacctagttgccattttcaatatgtttacttatttgctcaatcccttgtgtaaagccaatcccctaactagaccgaagtagaccaggctactacctcaccactgtaccctcctcttattgccagggctctttgccttctaagaaataaggaaagctgggaagagggaaggaggaagataggtagagataagttttttcttaaagcatttgaaaaggagattctatcatctttttcagtaaccttttacataatcacaaggaaaataaatgcatagaatataaaaactgatatttaagctcttttttcagattttcatttggattcttacatatattttataaatgcacatgcatgttaaccaagtatttttttgtgataatgaccatgtattgagcatgaccgcatgctaggcactgtgatggatgattatgtgtgtgtgtgtatgtgtgtgtgtgtgtgtgtgtgtgtgtatcctaaaccatataacaactctgtaaataagcatccttatcactgttttgggtgatgaaccaagtaagattcaatgaggctgaagaacttgatcatatcagtcagttaagcaggggttagaatttcaatccaggatatctgacctcaaatacacacccttcccaaaccatgtgtacagcaccatggtatattgctagcattggaaatcatcactggggagcattttatcaaacatcacccttaaaccatgccatttaggtttttttaatttaaaaaaataaaaagaggaaaaagtagaaattactcaactggttcattaatttcttcctttactaacttttgggagagttgagtcaatgagagtcgatgattagtattcacatcatgagacattttattgacttattcacacattagatatgtcccatctaaaaaactaacatatgcagttcctctatttgatagttcttatatttgttggaaactctgttgagccgactacctggtgctcttaattccattataacaacgccctaaagtttatagacttttttcttccctcttttttacctacaagaaataaaatagatgaactcaacatcctatcctgcttatctggaatgagttattttctaaacaagtggctgtttgcaaagctcatcctgtagaagtctgtggtcaagaatatttccattcagttcttatttttacaggggaattaatatcttttcagtcagaaaggaacaataaatgcttgttggctgggttgaaaaaaattaaatctacaaaaagacaagtgaagaaagaaagagctcacattcaactttctggagaatttatctctgtttctctgtatatctgatgtgttcctgcaagtgtctcaaatacccagaattttactgaaggatttgaattggtagatcttttcagatctgtttttactttactttaatcaaccaaagtttattcttcaggcagttgtgttttgctcccattttactggctgtgtgtctttggccaagacacttaacctttcagaacttcactttcttcatctgtaagatagtaatatggtcacgagtcccttaacgacagggatacattctaagaaatgagtttttaggcaatttcgtccctgagcaaacatcaaagagtgaatttaacacaaacctagatggtacagcctactacacacctaggctatatggtatagcctattgctcctaggatacaaacctgtacagcatgttactatattgaatattgtagagctggaacatgataagtatttgtgtgtctaaacatagaaaaggtattgtaaaaatactgggtaaaagattagattaaaaatgatatacctgtatagggcatttaccgtgaatgaatgcaccttacaggactagaagttgctttgggtgagtcagtgagcaagtggtgagtgaaggcctaggacattaccgtacactactatagactattaacactgtgcacttaggctacactaaagttataaaaatgttttttctttcttcaataataaataaccttagcttactataatttttttactttatacgtttttaaaatttaatgttttgacccttttgcagtaatacttagcttaaaacaaacacatacagctgtacaaaaatatttctttatattcttaatctataagcttttatctgtttttttttttaactttaaaactttcttgttaaaaactaagacacacacacattagcttaggcctacacagggtcagaatcatcagtatcactgtctttcacttccacatcttatcccattggaaggtcttcctgcatggagctgtcacttcctatcataacaatgccttcttcggaatatctcctgaagaacctgcctgaggcaattttacagttaacgtttttatatataagtagaaggagaagtacactctaaaataatgatttaaaatatagtatggtaaataccaggttaggccgggcatagtggctcacgcctgtaatcccagcaccttgggaggctgagacgggccgatcacaaggtcaggagatcgagaccatcctggctaacatggtgaaaccctgtctctactaaaaatacaaaaaaagaaaattagcccggcatggtggcaggcgcttgttgtcccagctacttgggaggctgaggcaggagaatggcgtgaacccgggaggcggagcttgcagtgagcaaagattgcgccactgcactccagcctgggcgacagactgagactccgtctcaaaaaaaaaaaaaagaaaaagtaaataccaggtgataagaatttttcagttccattatagtcttatgcaaccaccattgtatgtgtggtttgttgacagaaacatcggttatgcagggcatgactgtacagtggtatacttttcagtgtggttgagaggatcaggtgagataatatatgttaaaacactttataaaatataaaagagtttgtcattgttactacttcctagaagtggacataagatagaagtaaaaagagacaaagaggccagtttgtagtaaaagaggtttacattccctctctaattgccagtgagtgtgaaatcactgtatgaatcttacagaaacaggtcaggaaactgtgtctgatcaagttgttcttgccatgcctttaaggaataatgtaaaccggtgactttcattcaacatatcaaaaaagtgtcactaacctttccctagccagtcatgctaccaagcatgggaatgttagtatttaggtttacatcagtatttctttaagtgaaaagatctaatggagactcaccttatcagatgagattagctatataagctatatctataatatacatcatataagatctgaattcccaagataattggcaagttgtttttgtttgtttgtttgtttttgagacagagttttgttcttgtcgcccaggctagagtgcaatggcacgatctcaaggcttaccgcaacctctgcctcactgtttcaagtgattctcctgcctcagcctcctgtgtagtagctgggactacaggtgccccccacaatgcctggctaattttttgtatttttagtagagacagggtttcaccatgttggtcaggctggtctcaaactcttgacctcatgtgatccacccaccttggcctcccaaagtgctgggattacaggcgtgagccattgcacctggcaacagttggcctttgagacacactgtattctggtttatgatagaatttatcagtcttcttaaggaagatggaataatttccaggacccctaataaaggggttctgattcattctcaatctaaaagaatgagtttgtaaaactcttttcaacctatattcctcagaccaacttccaagtagttgatcacttcccttgatttaatttcacaaagttaatcataggaataaagaagttgtcaaggcagttagaaaagaatagcatattgagaaagtttgaagtgaaaagtataaatttcatgtggaaaaagggaaagcaggatagagtttccaagagtccagagaaaagagggttgttactttggggataaacccgttggcttagaaaacatttggcctagaaattttggttagtgtagtggtaacaacaaagtgcaaaagattaaattttagatgtttcttccaggtcaaatccaaaatccttcaacactatgcaaataaattcctctctttttaatttcgttttccctgtactactgagtcctgtagccttgcaattgcactactgtctgttttctctcttcatttctgacccttctttcttttccctcacctttataccactttccattgtcattttcccgattgtggcatcttaggaaactctggtaagctttatacttacagatccagccagtaaggtctgtaatggacagataactttctttgcagtgagccagagcttcagtttgcttcctcacggtgcaacaggaatggcatctcattaaaattgaacattaagggcctgaaggtgctttgactaatttttctgtctgggcgttgttacttaagagatctagaagttgaaaaatcccccttctcatagtattcggagcaatcagccttagagactgctgcctactctgaggcaggggacactggaaggttggtgaggtttgcctctgagcatgcccccaaagagcctccctttattcctagaagctggcaggctttcttttcctcctacaagtggtaacccgaattctgagttgaaagtgaatctttgcccttggctcctctccagcattcctcactgagcgaatagggatttggaatgtcagaaaatagaagaggggaggggaaaagatgtgtgtatgactgtgagtgtttatatgtaaaagcagcttcgtctgggaggacttagggaaacttgacttcctcagactgcttccttcttataaactcttggttccttatttatcatttttcgtttttgttttttaagttgtttgacctgattttatcatagtagttccaaatgccttacagcccagtggagtcaagctaaggaaagacagcatgatttccacaggatttgtatttcttccctctggataaagtgatagtagttcccagactcgctgccggcaggatccaaggtcgtctttcctccgggatttaatctggtgtcatcaggaacctagactcaggttttattggagagcaaggctcaataagaagtgtcctttgaggagaatcaaggactcaatctaggcataaaaggtgttgctcagcacaataccctctacggtaagctaccagtcctgagaacctgtggtcaaagctgaattgaaaatattgatggaactcagactctgtgtaactggggactggttcagagctcaagactataatttacagggctgcttttatcctttatttagttctatccaaagtcatcttgcatcaactcaaaaggagagattctgtgagggtaacctacagggaaatttcccagctttgtgtgaagaatccagtggttgagtgtctatctgcatcctgaggaaccatgtcctctttatatacccgaagtaaagaattcactcggaataggaaatctcagtctgattctcccccagcatctccctccccgactgccaagacgctccgagtaagcagcattttttatttacgtatgttcatagctgtgtcaaaggtagagaatgtgtatatatataacttggggcattaggtttagagcaaagggatttcagagcatatgggaatcagtacagggaaaaaaaattgcaagtaaagaccctgtaagtttctctgcaagaggttatggttcataatacttaatgtagtcttaagtaaaagcagacttaaatatgtcgggctacagtttctgccttttagcttttaactatcggttgtaaactgcttaacagtaagattttacagtccttatcactttatcttacaaggcttttctcaatttctacagctattttagtcactgcctttcttgtgttttatgagtcaatactatgtttcaagagaaaaacctctgaaatggccacacaactatatacattaaacttcagttttgcaagttctgtgtgtgtattcatgtatgtatgtatatgaggtagagtatgcttttgcctattttgtatgtctgtctgtgagaaagaccaaaatgagcaatgagcaaggagttatggccacttggaaccttactccttaatcaccaagtaccttcaggaaatgtcttgcttaaaagccaaagaactaactcttggccattgacaaccagctgtatggaggtgtttgtgatgtcctaggtagagccatttgagacttttctccattttctctaatgaatgtctcagtgaagagatttacatatgggcatttgcatctgatttagtgtcttcctctgtgggaagctgataaaagcaagaactgctaccaatagcaagggatgagaagctctgatgggcatattaggtagcaggcaatataacagttactttttcaggaactagattgcgctttgctgtatatacagagtaagaagaaggacggccatagcttccttatttagggagctatggggagaaaatttgcaagaagcctggatagactagtgtgggtttttttttcccccaattattttgtatgcattttcaatgtctttcttaccagtataaattaccatgtagtggaatttggtatatggcatgttggtctaagacctcagctagggatgagaataccaaaagaatattgttacgaagttattttattcacaagtttttgtgagagcaccaagaggggctccgatatatatgttactgtcatcgagttccaggagtgtctcttcaacacatagactggtacctttttttcccaaggagccacagaatgctttcaccccactagctgttgggtattttttgctggctaccaattgaggtccacaaaactgaacaccttacttcagttagtgtttatctttgctcccttccctcttatactgagtagtacctttagttgtaaagatccccttattaatgtctcttcaccactataaccatagctcccagagcaatgtggtgagcagtcaacaataacctgtttggtgaccttcccccattttccctttctgtttttcctctgctttcttagagttaggtactgctttcgtcttgtctcacttctaacagctgccatccaacctccctaccctcgtttcaccacccctcatccctgccttttagacagaggtcacagtgggagaaaatctgagttacaggaaactaaaacacagatggcttaataagagactgcttcccaattttagtggtcactggccgtggattcctacaataccatcaacttactctaaccaacttccagtgtccaaatggcttgagactataataaagagaatgttgattttcatataccactcatgttccattatgttgcttatgtctttaatgtcagagaaagatatgcaagactcatttggtggctgctgacactaaggactggttataaaatgaagatttcatctcttaagatctccctagcctagttcatttcctctcatgtccaactaattagggtactctttaaaaactggttttgagtgtattttaacaactggttttgtgatggtgttgtgctcatatgtcttttgatgcctggttgtaactggctggtcctcagccaccctgaaaggtgggtattgctatccctattttacatatgaggaaactgagatacatagaagagaaatggcttgcctagcattgctcaactagtaagcagcagagccttgattaaagcaccaagctctctgactctaaaaccccatattcccagcaacattggagtacatctcaaatatatttgaaggtcaagtttaagaacatgctaaagggcaaagatgacagttaaaagcttaagtagctgtgggagtccaaaatttatccttgatggagacacaggaaactgaaattgcagaaaggaggaaagctgtatttataggccaagggagggaattggcaggccataactgaatctcctgtgcctggttctcaaatcccagtcatactctctgggaccatggagcccacagaacctgagaccttatgggcttcagggtctttgtatttctctagaaaagtggaaatgcttgagtctttacagtaaagatactgggaagtttctgtgtgcatttcagagttaaagtcaggacagctctcttactgtcctcttccaaacttctttaacttgtttgtatacatacatacagtttcttctagagatggcacagagttacagagggacagcacctgatccaacattcttcaaaacggaggattgaaatttcagccagcatttagaagtttgattcttttttttgagtgttgttaacagggctaaatagtaaatgcccccatataaggaaaatatcctcagagagtatttttaaaataatagctattcacatggagagaatattttggacactgtaccctttgtcaaatgttcaagcagtagtaaaggcaaactataaactgtaagtcaaacaagttattatttttaacttgagaaaacaaaaggcaggatgatttttcagtgactagaaaacaaacttttattatatatgtttacttttaaactcgtaacagcagctgatgatatactccctaatgaaaaatcactcatatatagaagatagtgcatgtcctcaccagccaagaagatttttgtttaccttctctagtttgtattttgaaaataataaatatttttaattctctgaacacaaaattatgctattaaacatggtttttaaaaatatacatcccagctgggcgcagtggctcacacctgtaatcccagcactttgggaggctgaagcctcgtggaccacgaggtcaggagttcgagaccagcctggccaacattgtgaaaccccatctctactaaaattacaaaaacttagctcggcatggtggcgggcacctgttaagcttttcgggaggctgaagcaggagaatcgattgaacccggaaggcgggggttgcagtgagccaagattgcaccattgcactccagcctgggcaacaagagcgaaactccgtctataaataaacaaagaaacaaacacatccctcttcctcactagagaaaatttcatccatccttttggcatgccctcactcgctcctaccgacagtaagaatgactgttataagtggtatgctcctaatattgctattttggtctctgttgatcctaaataatgaagtaattttttttactgctacttttggctttcatatgaagtttccattagttcagtatcttttttgtgtctaaaagttgagaagttcccttagtaacagctctgatcatctctgatttgttactcaggaaaagcggaaaaactttcagattcacttgcatttctaatgggaaccacaccaggtagatattgatgagaatttgaaagctcagtctcttttctcataccacgaaacaaccctaatataagatgctgggttcatacaattagtagtaaaactttcttttgacagtaattttccaacattaaaaaaaattatttttcttctgagtcttcgtagttaaagaaaaaattctaaactacaaatacattagacacttctagctcttgatttttaattactatgtatattattgggtctaacatttataaattctataaattaggaactactcaatttagatggtttagcatttttaaattatcctaaaagtaagagccaggtaatctttggtcagtattctcaaatttttcttatttgctaatttaaaaatttttcaatgcagggtatatttaaaggaaacaaatactagagtatgtccaaattgtagtgcttatctgatatttattatattgaataaatcttgaagtaagtgggtcattagctgaaccctgggaatcttttaattaggcacattttcattgaattggtatttgttataataggatttgacctgtatttataaagcaagatcagtagcattttcccatttagtctggattgctattccttcagttctaacatgtcaatttaaaaaaatgacaaaaacaaaaaaatacaaagatgttacataatatttttcagtcagccattaatgtgcataaagggaacatttaatcaattagctttgttttataaccagtcctacaaactaattagggtacatttgataaataattggatgataaaggattgttgccttcatgagagcttgtctacatagcaactttggttagcaggccagaggcattctgcctctttgccttccagactgtcagtgttgacaattattttttgcatgtgctttgtgccttcctctgacaagtaccaaacagttatttagcatattatcgtatcctctatacatccaacactacatctgatgcactaccaatctggaatccatttttactccactttataatccgttgtcatggaatgagaaacacttggatgaacaatgctaattaagagtgcaatctgttaaccattttttccgcctaattaaaagcaggagtgtattcgttttgggggttttttatttcactcaaggaaaatcaatagcagtaattgttcagcccaaggaatcttcctagaatagtaaaacctgtgggaataaaagtagctttcccatttggacccattacatgaattcttagtagagactggcctagttaactcatgtcctacgtagagctgggggagatggcatctgaattcttggtttgttgaccagagagactgggagcttcgaagacatcagctccctttcctgcaagcggtgtcctgcccttctactctaatttttagttccatgataaatgtgtatcaaagccatctgccctattgtgaatcctcccacaacattttatgagcatctgctttgtagtaggctttatattggacaccagtattcataaatgaaagacacagttcctgccctcaaagaattggcagtctaattggggagataaagaaaatcaagaattagaacaccagggaggtgaattttctaataaagacataggttcagggtgttttagatcagccatgtggttaatacattagcctgatgtttggagaacaatagaagctagatggacaaagaaggaaacagtacattacaaaggtagaaaaagaatatgagaacataatggcattattctgagagctgcatatcggtgtggctagaacaaaagatatatttagaaatgtaataagaaatgagagaggaggcttagcaaacccaggtcacgtgaggcttagtatataattttgaggatttggggagttatcctgtggataaagaataaaggaatgaagatttgaagtaaagttgctgtgctcagaattgcatattagagaaataactttggcagctatggaagctggactgggaggagggtcaggacatgatcaggtcactggcctttgattgcagtattccgggtgagaaatgttaagggcctaggcagagatattttttctgggaaatacagagaagcattcagttgtttagaaggtagaattgataagatatggactgatagaatggggataaggatgagcctgagagagggcagagtcaggagtgactaccaggtctctggtttaggtgactgggtagaaaatggtatgataagtatcaggtgcaggggctcacacctgtaattccagcattttgggaggcagagatgggaggattgcttgagcccaggagtttgagaccagtctgggcaatggagtaagaactgtttcttcaaaaaattgttaaactagccaggtattgtggcacgtgcctatactcttagctacttgggaggctgaagtgggagaatagcttgagctcaggaggtcgaggtttcagtgagccatgattgcaccactgcactccagcctgggcaacagaatgagactctgtctcaaaaagaaaaaaaaaatagtgtgacaaaattgagttggcaaacacaggaggctaaatgctgttgagtggggaaatggtttcactttggatatgttaaattagaggtactttgggacattcagatagtgatttccagaaactagttggtctgacgcttgggagaaaattatgggctaaaaatactgatatttatgattgaagccataagagtggtaagcttgtctaaggagtagatgtaacataaggaagggctgagagtaaacctcgagaggagtaaccacaagcagataagagatatgtttctttttctaatggcgctttcctattccatcaccactggaatcacatgcaggaagacagcaggtcttgtatctggtttctttgttcaaaggtattgtggtcaaacttatgttacggtgatgagtttcagttctcaaaggattcagaaatttagttaagggtcaattggttatgagttttgtgttgggttctagttttgttttcagtacctaacctaagctgtgtgacaaatacctaagctgtgtgacaagggattattttttaaagtttggaaaagttcccagactattcagcattggtttttaatttcttttcttaatctgataatatttgggtgagctggcaatttattactgtaagaagaccaaagggaaacaatcaaagttgcctttcatcagctttttatttcttttaagcctcttttttattctattcttgacctggttatcatgcagtgagtgatggttatccacaactgggatgttagttctcataacagttccaaaatccaacagctttctttggttacacagcatggaaagagttctaccagtgacatgattagataaagatactgaaagtgtgtctggactttaacctcttcataggtcattatgaaagcaacattttcatataggagttgtacataaaattgcaagtggctattttaaaagttgtttgtatgaaaagttaaatattctagatttaaataaaattgtaaaatagatgagagtatattatagcattttaaaaaatgttttgcgttgatttccaaaatcaactttacatggttggttgtctggaaggacatatatccatccagacagtaaaataatgaccttaaatgtgtgtagattagaaagggaagtaggaattagcctggataatcaaaatctacaaataatcaaaaccctttacttgagtgctgaggaatttatttgagcttattcctcttgtagccaacaaacattgggagagccaaaagaccaaagagggacaagagagagaatagaaaaaagtacagagaactgtagtaatatcaatagctaaaatttattgaacatttactctttgtcagtgctgtaccaagcacttacatttattgtctcatttaatacatttgataaccataaacaccaagtttactatctcattttaatgacagggacactgaacagagaagttaagtaatcatgtaagatcacataacttagtaaatgctggagccagcaatctggatcaggagcctcagccttaaccagtaaggcatgtaactgttctagtgaaactactgtctcttctttaaatagctcctagattattaccagtatccctgactattgaatctgacttggaaagagagatgacgacaacaaaagctatattaaggaaaaatgtaacagaattacaggaacagacaaacctagattagtaaaaagtcagaatgttttgttttgttttgttttgttttttttgagacaggatctcgctctgtcacccaggctggagtgcagtagcaccatcatggctcactgcagcctcaaactcctggcctcaagcaattctcttgcctcagcctccctaatagctgggactataggtgtgctggggcctcaccaacttgttgaccaagctggtctcaaactcccaacctcaagtgatcctcctgcctcagcatcccaaggtgctgggcttacaggtgtgagccactgtgcccagccaaagtcagaattttacataattttaaaataggtgtggtggtgcatgcctgtagtcccagatactcagaaggctgaggcagaaggatcactttgagcccaggaagtagaggttgcagtgagccatgatcatgcgctcgctcactcgctcgctgtctctctctctctctctctctctctctctctctatatatatatatatatatatatatataattttagtatttataagtatctatgataaaactcaggacctgttaaattgtaacaagttctgaattagtagggcctgaattactgaggtttttctcatctgaggagacccttccctgccaaaaccaagaaaataaactacaaaagcatcccctgtcccaaaagtctacattttaaaatacctgttctgctctgggaggtggtttagccccctaaataagaaccttgtgcatttgaagactcaagttccctattgggggtatgaaagtggaagaatcaaagaaagcttcagttctttatccttctgaacttcatctttcaaggcagactagcactttgggatgactgtggccctcgcaaggccccaacttatgtaagatcacttacaagtcacacataatagtgtcatttttcatgaccacccagtttcagacttcaagctgatgtatccactaagcttgttccttccattatcaccttgccaagaatatctagtcagtattggtctctccctttcctaactacccctttttatttactgtatgtactagatggtctaacatttgattgcatttaatcaattacctttttttttttttttttgagacggagtctcgctctgttgcccaggctggagtgcagtggcgtgatctctgctcaccgcaagctctgccttccggattcatgccattctcctgcctcagcctcccgagtagctgggactacaggtgcccgccaccacacctggctaatttttgtatttttagtagagacggggtttcaccgtgttagccagggtggtctcaatctcctgacttcatgatccacccgcctcggcctcccaaagtgctggtattacacgcatgagccaccgtgcccggccaactttcttgaattacactctgttttatgagtgtgcatattttacctcctcagagaagagctctttgagatcaaagagccatgtcttagattctgtaattgtcgattttattcctgtaagtactactcacaaggctgggcacatacaggtgcttaatgtaaatgcagggaatgaatgctgctgcctgagatttgatctctccgctcctatcccatttagccatctggaaaggagtcagaggccacacacacttgagaatcttatttctaacatgaaggctaaccatagatcttcccaagtcaattcagattcctgtttattgcaatttgctagtatattggtcactccaaaatatgtgagttaatatttttgtttttgtgggaatcaaaagagaaaaagcctgtggaatctactagaaataaaaagttctaccctatgttacttaggtcccaagtattaatatttatttcctcatgaaatgtgaggtctggagagcctcactaattcctttgtaaaagttttgattcacagcctagtccaaataaaaataaagttactgctacccaaacaggctgctggactgtgacatttaccatatgaaaaaacccgtctcttcccaggcttcatggaaagcttacttcctaaataggtataatggtggtcagtaacatcatgacaggctagtggggagagacctggaatctcaattagagaaatggagtgaaactcaaacagtgggatttaaggcctaaataaggacttttaaaatttacgatatactctatgctgtattctaacaatattttggagggactgatcaggcttcttaggtgttcattgaggctgtgtttttttttaaaatcatctgaatgtatttcatagtttcagatgcccatacacatctgtgtgaacctaaaactccaagctatggggaaagtaaatatagatattaaatgtgagaaatgtgacccatgtgctagagccacacaagttttagagctcctcattcccctgttggtcattttcatcctatatagtacacagcatgtgaaaggctcgatggaaaatatgccggaggctgcaaatgcatttatgaatcacaagagtttatgaattatacatataaaatggcttgccttaggtattttatggaggccttagtatatccatatatttccttctacaatgagtgcattttgtgagtttccaaaagatcagaaattcttcagaagctgggaatattcacaaaagggaggtgcaggtctgcatagatgctaagagctttaaaattctaataatattaggtagcacaatagagacaacaaaagatgagtctatcatttaatgaacttaatggtttttcttttaaaatatagtgatatgtgctgcaatatgtgagatgatgttacatgatatcatttttacatgccttaaattgatagggtagtcacaatctggcatatgagatttttcagaaatatttataatatgaactgaatgtaaatactgtatttgactatgtttaactttttgttctatatgtattaagtagtcagtaaagacaaatcaagacatataatatgatgaagacatatgtgatttaatacttgcttttaaaagttaatttttccttggaagtatactctcttacacatatgtataccaggtcacatggacgcctgtttttttccctgcataagacagcacttttggtattgccctgattctgaatgtatgtaatcacctagtgcagctgagaggccatgtgctatggatgtttcttttaggatgttacagataaattaaaccattttttttttaagggagatccttgtgatagttggaatttctaaaatgcctccccaaaagtcctcacctgatctgtagaacccacgtatatgacaagatagctctcgcatgattgttctgttacatagcacagttgaccttaagttagggaggttttcctgggtgggcctgagctaatcacatgagcctgtgaaggcagagagccttctcagcagatgatggaacgggaagccagagaaatgtgaagtgcgaaaagaactcagtgcttcaatgctggtttgaaaatcagaagggccatgtgaaaaggaatgtaggagcttctgcaagcagtaagcagccactaccctgcaaggcagtgggtacctgaaacctcacaggactggattcctgccaacagcctggatgagcttgaagcagattcttccccagatgctcctgataaaagccagcagcagactccttgatttcagaccgttgagaacttgaggagggaacccagcagaactgtgcagacttctgacctacaaaactgtgagataataaatggttttaagccactaaattttgttttggcagcaatagaaaactaatgaaattgaaaatttgatgataatttttttgatataaaaaacagcataggcctcattatcattgccctctactgtcacatctttgcataaatcttggaagttgttgttccaccctcacatttatttccagattatgcaggatccccagataaattactagaacaatgcaggcttcacttcaaagttagagactggtagattctctttatttcaagtttcctaagaatcttctctgtttgaattatgaagaaatcttttcccttaagatagaaggatggaaaacttttgtctctcttagacttatatatgaaaccagaatgattcttaaactcaaaagttacaaaattatactattttgcaattaactcagaccatgattaggtttgcagtacctctgaaaatttgaagggtccttgctgcagccacactcacatcattggcttgttcatcatcagtcaatattctgagaaaactgaagggaaagaagatggttctctgtagaccatcccagaatagctcaaattgtttcccctggctcagctagtacacaagaacataatataaaatgttccttctgcttagtccctcttcaggagaaaatgtaaatagaagttttttcccatcactgtggggtcaagccatgacttcaaaaggaacttgagttaaaccagtttcagccttggcagcagacatgtgacttggtctcattcctttcccttgggcccagctttcctgagccacaattttattttaaacttggtaggagtttggttttaattatgtgccttcctgaactcctgataactttcaagttaaaagtttttgtggggatttttctaagccagtctctggtgttttgagggccctacacatttcacaaatcaaaaccagtctggtttctgtccctttctaggattgccatctgaattaatggtgatcttcattctgttcttttattagaaacaggcccaagcaatgagattattacgggagaatttcaagaggtatgaaagaaagaagtctgcttcttagttttgggacatttttaaaactatggtctatccagctaatcattctttttacctctactctacaatgtattcatattggtttctgagcagcttttagtctcttcttctctagagtctcatttacattatctgttgtccccagttgggccataaaagctgtgaaagtaattccttctttgaacagtttctatctagttcagacacactagagagtctcattttagtggccatcatttgtcttcaacagaaggtagagcaaaacaatctttaacaaaaacacttagagaagttctaagacttccagattagagcatacagcataataaatttgtgaattaacctaccaattggagaaaagattcatgccttttctaaaatatatgatatcatcatgtgcagataagctattcagactctacttacagagtagactaacttctgtttttgagaagagagagggagtgtacagaggaggaggatggaaggatgggaccattgccagagcatagataagatgagtccgcattcctagcctctaaaggatcatcgatttggctggagtccctaagccttgtgttctaggacttccccttattttctgcccactcagctgacctcttagaatcctcttctctgggagaagcttcagtgttcatttccctaccttatgttctgcttgcctcttctgatgtcacttcctggctcactgttcccctgagattacttaggcaaactcccactctgtcttatctcctctagatttacttagtagtctccctgcagggttggcagtcagctttcttgaatgaagtcgtgttagtctaacagttgatttgatctgtgcttagtttgaatgacaggaggatgaagaggaaaaattaaagttaagtcttctgagtcaatccagccactctgcttctttacccaagaaaccccatcttctctctccctaaatccaactagtgttttttcatcaaaccccggattatctagggtatcaagaagccaagcaaaacactagtttctagaggtattccaccaatgaaaattagttaggaagtatgatctaaaaaccaaagccattttatcagaattgggggaattaaacattaaaccctatatacttttaagctatcttgtcttactctttttaggctaaaaacctgaaaggaaaccatttctattacagcgagaataattcacccttagaagtccagttttcttccttttttgaaataatattgtttgtattaaggtaactgtgttactcctactgcatccaaagctcactaatctctgaggttttaggagatttatctactctcctctaattggtagggttgactttcccaggacattgctaaggttagcccctgaaggcaataatatttaaaaaaataaaaaataaaggattccacatagctccaaaagtcaggtaaaagctggagggaattagagatagcaaggaaagatcaaggattaacttgcaagctctattttctctaatatctggatctaggaaaattgtctaccgccttgtctgctggatcactcatcacctacgcattttataaaaggctacccaaaaagaaattgttaacaaggaatgttaacaagcctttaaaagctaataaacaacagactgtggtgtttgctttcagttactcctggcaagcagaagtaagagcgtaggtcatcaacttcctaggtggctgtagggaacacctcctacagtaagcctatagggacaaaaactggtatgggaatcacaagtgtgagcaccattatcattaccttcctccacatgctctcatttgtggaaaaattaatctaggcctctcgaaaaccctatggaatctgccttttcatgtccaggaaccctgtgggctttttctgattgctgcttgatagtgctaacctattttttgtgtttttcaatttttaagtgtttgtattttatgtcaacctcctcagtgaaggtcatacagtataaacagccatactatacagccatatatctgaaaactttcttggcttaattgtgcttctagaacattctaaatgaaaagggttaatgtcatttaaaaagtaaagcaatggaaattattagcatgctttgatttatagataatggctaagattgatgcttggtaaaaccctaattttcctgttttaatgaaaaaaaaaaaaaaaaaaaaaaaaaaaagcttgtttcgtcaccatagaggcagctgccagagtctacacagcagaatttaaaactaaagatatagtaaaatcttacccaacaaataggatatttacaaagaagaaactaaaaaaaaaaaaaaaaaaaattcaagtgaggtttcacatttcaagaaaaagtcagcagcaaaaaagcatgatttaattgtcagaaagttaggcctcagtctgcacaccatggagaaatgagctcctagttcaataggaggaggaaaaggcccaagggaccagtttgattgtaaacaggtcatttttccatacctaagacgatgtggaaagtacatctttggaaagagtgtcaagaatgctacccccatatgaagggtatagtttgaaggctgttctactcagaagcactgagagaaactaaatggtcttctaaattattgtttcatttggttacatgtgaattcaattccttgaaccaaaggtacgaagttttaacttggtactctaaccagcatcaatagccaatataatattctttttttttttttttgagacagagtctcactctgtctcccaggctggagtgcagtgacgctatctcagctcactgcaacctctacctcctgggcttaagcaattctcctgcctaagcttcccaagtagctgggactacaagcatgtgccaccatacccagctaatttttgtatttttagtggagatggggttttgccacgttggccaggttggtctcgaactcctgacctcaagtgatccacctgcctcagcctcccaagctgctggtattacaggcgtgaaccactgcacctggcctaatacgatattcttacaatttaaaaaatgaaagcagaggaatggtggcagggaagctgacattttaagagttcacttccttgtagttatcacagttaattcttactgttagaataagtggtaacttgccaaggtcacattgctagatgtcagagcagaaattagaaatcaggtctagccaaggccatcacacttctcagagcattaacaattcaattcagttagtgtttattgaacacctattgtgttctggccctgtaggtactaaaaatataattaggaataagatggaattttagggaaacgttccctccataacaatatgtttttttaaaaaatgtatgtatctcttctggatctttgttatcagaaaaaaaaatgtgtgtttgtgtgtgtttctctaatatgatcttcccaaaactcctatcttttaggaggttttcttagttggagccaatgggttaccactgttatctccatagcacgtattctcatgttttccctacattgcttcaggcgaacttgttaattatgttcacagtgctctcctggttctgtcgtgcaacttgttctgcttcttcctcagtgcctcctctacagggctctgcacacagtgggctgttaaatacaatagatgctttacatttgctggtatggagttcaggctcaattattcacaagtatttgacatgtcacaataaatagttttcctggacgtgaattttaattcacccagatgctaggtcttctcacaaagctaatgagtgacatagcccatagcccaggatctcagcttcacttggatactttttgtttgtttgttttgttttgagacaaggcctcactctgtcacccaggctgaagtgcagtggcacaaacacagctcactgcagcctcgacctcttgtgctcaagtgatcctcctgcctcggctttccatgtagcatggatcacaggtgcccaccaccatgcccagctaacttcttaaaaattattttgtagagatggggtctgccatgttgcccagactggtcttgaactcctgggctcaagtgattctcctgcctccagagtgctgggattacaggtgtgagccactgtgcccagccctatatatgtgttagttcttgagaggtgattaaaatttagtttcttttttgaaaaaagatatcaagaaaaaaaaacttaaggtaaagttgagaaagtaggcaatgatagtgtggggtatacatatgaatgccactagagattagatatataaatgtgggacaggaaaaatgcctggaattgtcctgaattttagatttccaactttcaggattctcaactcaatgtatgagaatataccatatacttttcttaatgagtcctaatgattcccccacctcaaatgggggcatgtctccatgttcaaaaaccttcgtttagtccagcggtatttaaccagggctgtacagcagaatcacctggggtactttttaaaaatacatataggaaggctgcattctagacctactgaaacagcatctccagtattgaggttaggacatgtacattttgcaaaagtgtgcaggattattctgatgagtataacccctgatttaaagagagattctatgaggaaatgtcatcgtttatcaaggtgactctattcagtcctctttagtcatatgtgctgtcactgtatacctctcctggacagctgtagggtgtggtgtgttgggttgtcctgctatgttgtttgacaaaccagtggcttccagggactgtttaatgcaaagcagtgtcattgagtgactcctcagaagttcaaggattcattatccattttgtagattattggacctttgcttctcttcctcctcttgtctgtcttgaagattttgttgttctttaacacttcagaaagggaaataattaagtgcatttaaatcaattgaatttttatttgccagagttctttaaaaaaaaaaaaagggataggagggtaaaggtcatctacagtaaaaagtaaatgtcaaacacagacataagcactttttgttgtgtgatttgtttacaatgaccaagcttactggttgtatctataaaactcctttcttttgagacctcagagtacctactttttttttttttctaaccagcatcctagggacaaggatgggagtttctcccctctcccttactcttctactttcactagcaacctaggagaaactgaggaagtctcctgagttttaatatttgtagttgcagtattcactcagggcaagtttgggagtttgtgaacaaaggaaattaatagaatgaatgttgagatccagagaggccaaatgtcacatagaaagtcagtgatagtcactcctagaacacaagcttggctagttagttgggtggggagttgggggcagtttttgatcattttacattttgctaacttctagtttaaaaaggtgctatccctaatgcctcaaatctagtgaatcatggcatgcaaagaagtgtgaactagggctaagtcacctttgtgtagtcaatttgattgcttttcttaaatggcacccccatctccagctgtgaagttcagccatctgatttgaaaagtgcatttatagatggaaataatacaaatcagtctcttgctaatgctgttttcttttcttttttctttttttgtttttgtttttgtctcctttctctagcatgaaagactttctaggtaagaactctccctgttatatatgcatgcttaatacttgtgagtgaatgcatgtcgaattaaacttagctttatataataattcagtaatgtttctcacatcctttccatccttttcatttccacagccaccacaataattcagacttttattacctcctgcccaaagcaatggaacaagcttttcaatttaccttcctgcttccagattctcctctttccagttcaccttgtagacttccactagattaattttttttaaagcaccagcgtaccaggcaccatgctcggtattagggaaacaacatgaataagacagtatccttaccttcaattagctaacaagccagtagagagacagatcatttcaacagaacatagtaagtgcccattagaagtacagacaggtattctgagcacagagaagagcaattaatctaatctgatggttcagattgaggttagatactgttatttaatagtggatccaacaaaataccttatacctagatgatgctccttagtagtttgttgaatgaacaaactaaagacctgttttgcaattgctgaaaaattaaagaaggatatcaaaattgggggaatgaccctctgcagtttttcacctagtatctaagggtacaaaactaatcttctgaaagaagaaactaaataaaaaataatagactatagagccaaaagttggaatctttctttttctactgttactctgatggagaaattaagagattgggagaagatatagttatgggactataggccaaatgagtttccttataatttgtttggtattgagctggttctgtcttattaatatattctaatgttcttcttctgcttgccctctcaccaggcagcagctgaggacaaatcatttacttctaacctagcagaaaattacttagttttgcaaaattgttggagagtggtattttgccgtaatcttttgtgaactctctcgtattataatagccatttgtgaaaggaaactttttcccacagacttcaaaatatgctatgaaactgtaccaattaaaacagtgaagcactagctcaagaataaacaaagagacctatggaacacaatccatagccccccaaaaatcacatgtataaggtgacttcatctcagtgaggaaataattattcagtaagtgatcattaggacagttgattatctgtttgagcaattatatccttcccttcagccataccgagaaacaaatggatttcagttggcttacaatttgtaagagaaaagtgttttaccataaaagttagcagaagagaatattttataatctttatataggaaaagcctttccaagtgtgataccattaccggaaaggggtcctgattcagaccccaagagagggttcttggatctcacgcaagaaagaattcagggagagtccattaagtgaaagcaagtttattaggaaagtaaaggaataaaagaatagctactccatagacagagcagctggttgcccgtttttatggttatttcttgtttatatgctaaacaaggggtggattattcatgcctgccctttttagaccatatgttgtaacttcctgactttgccatggcatttgtaagctgttatggtgttggtgggagtgtagcagtgaggatgaccagaggacactctcacggccatcttggttttgtgggttttagccagcttcttcactgccacctgctttatcagcaaggtctttatgacctgtatcttgtgccagcctcctatctcattcagtgacttaaaacgccttaaccgtctgggaatgcagcccagtaggtctcagcctcattttacccagcccctattcaagatggagttgctgtggttcaaatgtctctgacaataccataaagataaaaatcatcaaatttaattatataaaatttaaaatctctaagtaagacactataaacagagacagaaagtgaagtgggaaaaaatatttgctgcctatattagttttaaaagcccgatgacgagttagtgggtgcagtgcaccagcatgtcacatgtatacatatgtaactaacctgcacattgtgcacatgtaccctaaaacttaaagtataataataaaaaaataaaaataaaaaaaataaaagccctactctacaggaggttcccctactacaataagaaaaagatgattaccctactgaacaaaggctatgaattggcaattcagaaacaaaaaaaaagaaaaataaccaaagatattgattgttcataatgattttaaaatattaaaattaatgacagatacatatttctgtcataagaaatatttcataagaaggtaactggacaaaggcactaaggtttatagataagtctgctcattttagcattgtttataatagctaaaaaatttgaaaaatttaagtgtctatcatagaagattagttaaattatcttacaggcatgtaatggagaagactgcagtcttttttttttttttagtgaggcaaatctatttttacttagatggcaagatgtccacggtcatagtggtaagtatagagaggaggaggagttagacaatagtgtatgttatctgaatttatttatagaactatgtattttaacatatatgcttgacattctgcaaggatatgaactaaacagttaaaagtagttatttcttaggcaggattatggggtgaccctttcactttctactttagatacttcagtatgaactttttctacaaccatatattgcttttataatcaggaaactcaataaagagatttctattaacaaaagaagaagaaaaagaatgttttgaagaatgtgggacttagcatctctgtgagtgaaaagaggccaccattgtcattaggagctaattactttgcctctgccttctctgtgtcatccttattgcttctctatctcttctaatacttatttcagcttccccacccccagctatggcaaatagctaccacaggacagatacatcagatgcaattttcacagttgtgactcttcaaaccatcccagttcaggatgtagcactctgcagggctgatttcagtttcatatgtgctgccttttaatttggaaagagcaaagtctgagaaaaatataaaccagcgttaaggatttagggtgatagttgtacacttaaacaggtaatcagctgagagatccttcccttaatgaacttaccaatactggaaataaaaccactatcaactctaagagctcagttgctaaaatatgtcaaaattctaatcacaggcacagcagtcttgatgtggaatatggataagatggtagaaaactagctatttgggcactgtgttggtatccctaaaatgtttgggattccagcaaacctgtagagcacctaaaaggcatacgtagcatgccctagtggccatttcattcctattcaacctccagctcagatctctaagtccacatgtttctgattcattgacagttcattgtaatcatttttccaagagccattgaaattcaagaaatctttacttttaaaagcacacttttgagggaagctgttcaatcctaaactaatatgaaaagctcttaagatttaagtcagctcataggtccaaaccactaatttttcaataagcttcattcttggcaaatgatggtcagcctccctctccaagctcgtgcagtttagccctgaggtctgggaacgctggcagagagattgaaggaaagaatgttatgagttgtttctggccagggctccgaaatacttcttagaaaaggcgcaaactacccctgagcattaccttctccccactactttgttctcaaaaccaatttttatctttaatattatctcccacaggttggaatcgggaggtagtaatcctacaaccagtgattcttacggtgaccgggcttcagcaagagcccgtcgggaggcccgggaggcccgcctagccaccctgaccagccgtgtagaagaagacagcaacagagattataaaaaagtagggtctttattcaattttccggttctttggtgacatgtaaacctctcagccttcctccaccacacccagaaaaattaccatagctctgaataagcagaagaaaaggcacttaagtaataataattccttgcagttttctgggtttacttcacctctccaaaaaactagataaagaccccttcagatattgaggtgttttgttttgttttttgagacaaggtctcattgttacccaggctaaagcgcagtggtgcaatcataggtaacttccctctcaaactcctgggttcatagggtcctcctgccacagcctcccacatagctagaactatagccatgcaccaccacacacggctacattttttattttttatggagattggatctcactatattgcccaggctggtcttgaattcctggccacaagcaatcttcccacctcagcctcccaaagtgctgggattacagacgtgagccaccatgcccagccatatgttgcttttagtgcagtaagtgtatagttagaatcaggtatttagaagtgtagggaaaagtaagaaattaagaatataaaaagggtgaaaaacctaatgctgtctctctgagcccctgagaatcatttggtagactgttatttttaacaaacatgtgcttctaataaggtcctgtgaatatcaactaaatactacttggtgttagtaaaaaaaaaaaaaaaaaagaaaagaaaatcatcatcactttacagtttatttccttttttcttgtagaatagtacctaactccaagagtagacttaaaaaccttccctttcaggtgtttgcgataccaggaaaaactatttttgtaaagaaaatatttaggatgggcatggtggttcatgcctgtaatcccagcacgttgggagggtgaggcaggatgatcacttgagcccaggagttccagaccagcctgggcaatatagtgagacccccatctccacaaaaaattgaaaaattagctgggcatggtggctcatgcctgtagtcccagctactaagttaggaggattgcttgagcctgggagttcaaggctgcagtgaggggtgatcatgctactacactccagcctgggtaacagagcaagaccctgtctccaaagggaataaagagtgcttgttctgttaatgttttgttaagcagaacttgactaaaatcaatatacacagtagactggttccaaaaaaaaattgtctttttcattgctcttttaagcaatgaaaatgtcccatagtaatgactgtttttcccccagagattaacattattgaagttggagcatcatcattctctttctgttcatcactttgaaaaagcaagagaccagttggctgaatgtactctgctccctacccttccttcattttctctctctaccatatagtggtggcttggggcacagagccctgggcattctcatgtgatgaaatggtgtgagttctaacgcgaacgctgatcctcttttttccctctcctctagctctatgagagtgctctgactgaaaaccaaaaactgaaaacaaaacttcaggaagcccagctagagctagcagatataaagtccaagcttgagaaggtggcccaggtaagacggaagaagaagaaaaaagatgagaaccaagggttgatgtaaggaagcaaactagactagggatctaagggacaggaagtaagatagagtcaagatcaggccttctcggggcaatgagatagaagcttcttagattctaatttattttaggtttcaatcagtgtttaacttaaaaaggaaaactgataattcagtgaacaattcctgatggtctgaatgctaataattaatactatggctcatcatctacttatttattagtagaaaagcataaaccagcactacaaagctagtcctagacagttcctcttgtcctgttcattatgtttcagttcagtttatctacacttcacctcttggagagagataagcaagaccctattaaacctagggcagagagataacaaattaagcctagagaagtaagtggtttgcttaggccatataacaaatcaagggcaaaggtggtgccacaacatagggttaagtcccaaagcaaagattctgtagcatatgttatctccccaagccaccactctttttcagcctacaaataaggaatattagtggcagaaagactgataaactatttcctctcactgccaggtttgatttaattagatgatgctttagaggatgctggaggtaataaccttgtcaccagtgaaacaaactccgcagctgaaagctaaagcaagcactgcttttggttattgctgagttatcaggaaacctattgagttatttccctcctagaatgcctggggacttagaatttcgaaagctgaactgaagtaaaaatgattctttagcaggaaggcttgaaatgaaaaccagaggtggctagtcattctggcaatatgactggctatccaaaagcaaagactaaaatgctagggttgtacagtaccaaatacatggagtttggagggcaggggtgttgattaccctctaaacatcctattctaacccctctggaattgcatgagcaggagggtgccaacacttggaagacagccccacagagctgcgtaggactccagcaagacagccaggacactcactttctggagaagggcttacccaggtgtaaaatgtgaactgcctgtcagtttagaagagccaccccctttttcctgattatagtagcccaacatggctctactggaaatttctgagacttactgcaacacaaatagataataactaggcttaaagtgattttgtggaataagaaaagtaggtttctaaatctaaaagagaaaaatacacacatagctatagccctgccataaggcagcggggtggactgaataaatctcactccaacattattgagccaggcaaaaaaaaaaaaaagtctcattcacagtagaccctcaaaagaaatctggggctaatttttattctgaatggcgccacatattggcagtggtttataaatacagatcttatgctggttcttgtcagttattactaggattgttttacagaaaattaaagagcagtcatgtgaggaaccacaggaagagcagtttcacctgctccccactcttctcagcggaagcttctgacagcatatgtcttgacctttaggggttctcagcatttccaccagcccatgccttagaacagtgagcagtctaacaagctgctgacattgacttgcacagagggcactgaaaataaaatcagcctttccagttgctggggaaaagcatttactctctggcccactgctttgctgggtgtgtcaaaatatacttagttttgccaaatacaagttattgaaattcataagaaatggtgctgctacaaaccaagtctctgccatttaccaaaaatggagttgtttggcaggacagtggagggagggcttctcagcctcacacatttgtatggagacagttaccacatgaacatacacaatatttttacataaaagatccaccccaactctaagggagtcaacattaaaaacagaacaaacaaaaaactagttctttgtgtatataaaccttgaaaatcatgaaatcatcacaacttctacagctcctcaggcttaggaaagaaagacttacgaggatattaacaagctgtaggatctatttttgcgtttttttctcttccttctgcttcatagtagatgcagcataaaggcagacagccatgcccttccaaacagaaggtgaaagcccaggacaggagccagaattctgagttttattgttagttctggccattccttaattttttttttaaaaaaagaaactgctgcaagaagaccagcataatttctatatttatttaaatgttgtctctgcatgacactaagcaaaataaaaataatcacccagcagttattaaatgtctactgaatgtaagaaattctgctgagttctatgaccctaaggccaaaagggacttaagggttttttattccccttttaaggaagggccattatctgaggttattctgttttttttgccgtgaggctaagtcttttcagcccctctgcaaaatttaagtcaaagatgatctaaaataaacattctaaatcttttattcaaataaaattaccttatctggaagcccaatatataagacagatgaaagtggactacctctgttcaaagcagggcagatgccatgaatggactcctaagaaccccttaaagcccacccacatatgaaaactgctgctctaaaagaaaaatggtatcaattcccaaaacagaaagaataggggaaaggggattatttagacaagtgccattggccttagacattctcgctcaggagttgccagccttttaaagaaaagccttttttttttttttgttatttcctctgggttgtgatattactcatagaatgaagagaggagaagaatggtgagatgtaaaattgtaattagcattgaagacctgtggagagagagagagagagagagattgtgtgttgtaagtaatttctttgtaatttcagggaatactactactgccttcccctccccagagggaatcctgcaaacttcagagaggtgataatgttaggcttagagatctatcagaacctgtttgctggggatccctgctataggggaagtccaaagttttactgtttatttctagatgtctagtagtgaagctgaactagactgggcgttctactggcccttagacaacttaaataacaactgttttccttccatttgcaccagcagaaacaagaaaagacctctgaccgatcatcagtgctggagatggagaaacgggtatgcgcatgtctgtttccccctccaccccatttcatctcttctttctgactctctcccactttgttattcatgccaatggaaaaagtccatcttaagaaggagggagttctgccacattccattcccagcttgatgataaattctttttgtctgactctaggcagtaatttgattgctagtccttttgatttcctcagatggtcagtactttccacatatttagtcttagggtgggaagggtccttggaaggtcatctcgtacattgttctgactgtgggcagaactgcatacacacacaacccataacattttggtttactgtaaatcattgcatacacacacacacacacacacacacacacatccaaggtctctttaccgttttcataaccttgaacagaaaggaagctttcagtgggaccctctgccatttaggtcttacgacttgaaacatgagccaacacagtctttcacttattttgactgaggggaggatttctggttcaattgctgatctcctcccaactgtactcagaatattattctgggattttacattcttggattgggaaaattcaattagatttattgatggaccctagctttgatttggccctggagatataatatgttcccatctgtcctgttgttgtctgtttaatttggaaagcagctaagttttacattttattcctttggcctgtaaccaaacttccttggtatcccatctgatcaaaaactcctcattgggtttaggctaaaccaagagtcagttgctgggaaagagaaatggaacgggagagaagcaactacagggggagggaagaaactagggggagagatgctgtttcttagacaatgatgtctacttcccggctcaccatctgctcctcatcatgagagaagcagtttcctaggaatttagggagagcattactgaagataatgatgcctttttgataatagagagcaagggccctagtcacttgcagacatttgaaattctatgaaatcttcaacctgcacagagtaactgaatgtcttcttctgtttgcatattagcaagttgcttctccatatatctactgattttatgataggagatttagataatgtgatttttatcagtgaggtagctccatcttacaagtggcaggatcagatagtgctcagatctcctgagtaaggtttgcctgagtcagcagacaaacctttgaccgtgaatctgctgatcacacagcagctgggaggcagcatttttactcccttctgaattcaataatgttcaacagtctcattgttccgaaacaggagaggcgagccttggagcgcaaaatgtcagaaatggaggaagaaatgaaggtatgaagagattttctttctttttgtatgcctgttctctgaatgcctgccaagactggatatttgagcataggcctgccccctccagatttcactacaaactcaatatctgcaagaagaaatgatgtgtaaaaaagtgagcatctctcctcagccatttcctaggctctctcagctcacacaacatccattgaggacaccttaaaggcattctaggaaaaaatactgcctttggtttaaggagaggtcttggcaggcttgaaacaaacttgagtttaacttttaaggcttttcaagcagtatctttgccctctagagggtaaatgagaaggctagaacaagttttccagctctgggagcctcccattgggtgcctggggaagcctgagcatggccataagctttcttccctggtgcccctcccaacccatccctttgctggcaagaacacagattgaatcattctgcagcaaaataaaaatgtattcacatattgatttcctgccccagtacattaactctgaaatattcagggatgcttggcactctcccactagaataagctcatgccaccagatacacttcacagctcactactttcctttctctcctcaccatgacctgcagtgaccatcacctccattagccactttaatggacagctgccatcctgggcagttttgagtgctaagaactggaaatctacccaaagcagtcaatttgctgccatgggaggcagtggggcagggggaggggaggagggtgaaaggggcaagatggatacagagctgcagggaatatagagctggtcagggtagccacctggagattattttgaaacatctgattcctgcaatgcatgatgacacatgcccataatcacttagcacctactcagcttttttctttcttcaggcatcttattttaccagatacatgatgccaagcattcatttggtgagacagggttattcaactgggaagccaaagcactgggatagtattaggcagatccccaaatgtctttctatgagcaagcatccctaatatgcagtttgggagagacatttattgttccagtggcctaaatagattggttatttattgaaaaaaaaaaaactttttaagacctgttgaggttatagtttacaccagatctggtgctcataatcaatcctgttactctataattccagaatgaaggagaaatgctgagccttgcccttgcatttcctaccactatcccaaggctgtaactgtaacattcacatagaattttaagcaatacctgcttatatctcaaacattttaaatcttccaagttgattcaagcagcaagaaatagaaataataaataattgattctcatgagatggtagaacagtatgccctagcacctaaacttctgcatcttgtgatttttttcaaacgcaccttactaccacacagaagtattctctcccgcttagagcagtgagttattagagataaccagttcttttttaatttttaagagatggagtctcgctatgttgccctggacttgaactcctgggctcaaataatcctcccatctcatcctcccgaatagctgggactacaggcacgtgccgccacacccagctgagctaactgtttcttgatgagtgcatatccacagctccttgttgcatggaggctcctccatttttgaaacctcctgagttataccatctgtactctgctgttaggcagctgtcagtgttccttattaagaaatgtcctaaatgctgatctagagcatgtaattgaggcaaaagctagaacctttcaaggagtacctgggagcccaaagccagcctccactcaccagtcatggggctctgtgtcacatcaaagcaggcccacacacaaaaacccagaaagtggtcaaattagagaaattgaggccctttgttatttttattccaattctaaatttggaattatggaagccccttcagtggttctagttgccctcaattctgtaggttgagataggcttacattttttctctgtctctttatgctatcagtctatgatttcctaaactagatcatgagttctttcctttcctcaagagattataagatacgaaagtgtttgctctccccagccataagccatttgccagcaactctaaaatcaattgtaaattatcaagtggagccagatcatgaatgtttagtccctaaaccaataggtaagctgttgtgaggctgttttttgttttttttttctctttgagacggagcctcactctgtagcccaagcctgagtgcagtggcacaatgtcggcttactgcaacctttgcctctaggcagattcaatcgctcaagcgattctcctgcctcagcctccaaggagctgggactagtagtgtgtgccaccacacccagttaatttttttgtatttttagtagagacagggtttcaccatgttgcaccaggtggtctcgaactcctgagctcaggggatccacccacctcggcctcccaaagtgctgtgattacaggtgtgagccatcgcgtctggccaggactgattttttttttagttaaaacattcagattcagtcaggtgtccattattctccattatccattacaaagccaaatgaagaagaaatgcctgtaaactctaaagcccctaaacactatttgctcaaatcaaagcccaatgccaggtttgcagatcgtccagcaccccctagaggactaagggagaagcatctgtgcctctgcattctcaccagttttatttttctgtctgtacctacttgaagacaaaaacttcaaagatgcaaatatataaatatgataaaattggtatgactggccctaaaagagtctaagaaaatacttgtttagctctcaagctcttcattcagactatggtttatggtgaccaacattgctagagtgattaatagctaaaatctctctgtactaggcagccaaaggtacaggtgactgtctggctgaactgggacccagtagagcttggggccagttggtcatgcttgttgcatattcattttgtacagatgctcaaacctccttggagcaatcagtagggaacagtagagggggctgatctccagtgaacccttaaaaatatagtaggttactcaaggaaagaaagtgacttcagtcctatttttctaactctaccaaataaagtacaaaggccaggtgaaatgggggaaccatgagatgggctaacccagatgtatatgtggctctgtggttatgagatgtgttgtgcctttctggacttttattggaaaggtaagtatttatgaattctcctcaagagaaactccacccagatcctagattggagtaggattatatgccaacttctgacaggtgtgcatgtcagtgtgagctgtgccaggcctgcacctggtcttggcgcccacatcagatgtgattacttctctactgcatcctccactcagcatcagcctccttgtcagaccttctccccttcctttcctaggtccttgcatgagagggacccagcaaccaattcctttttagattggtcctggaatttttatttttctttggaaagattactagctgaccctgctccttagccctgcccttgcccatcctgcgctgggccctgccccttctcctctcctccttgccttgccttgttttcaatactgcttcctatagaacattgaccagattgtttcctgcctctctccctcatgctgataacttccaaattctttcaccttgatctgcttatactcacttgtcagattgagtcactttcatcattcatgtctttaatgttattccctgggaggtaagtaccacttcatacaatgacaattatttgataatgattatgttgaaagctttggtccaatgtcaacaccaaagaagggtgagagccagggactttccattggcttttaaatttggtccctgcccattgctttaatcttttccatatgctgtaccatgatctccctcctctatcctcaccatggccaagatgcttacagtgggcaaggaagattgcccggtcctcaccctccaatggctacatgagacagtttggctagcctacctttattccaaggtggtcattctttctctttggttaaagagattcagcagtttgtctctgcttgtttttccttttcactgtttttccccttcatgctacctttcattttcttgcttcttcactcccaaacaactataactccactaatctttcatttctatccttctcatcttatagatatgagagacttttctctgatacctggccacctttttgtagtcattataacccacaggattgtccatcctcatctgtgaaaccccatttgcataaaaaaatcattattctcctcccaaagagttgatggtctcagtttcggggcagtgcagatgactacttaggaaggacagtagcagagtcggcaggcctttgatataattccaattattaaagtctttaaatgtcttatggaatatggggtatcaggaagaatgtctgtgggctggttattctgttccgcttgcaacactgacaggcagaaagggctggactagcacattggtccagctagtttcattatcattgggcttttatggtttctccagcttttttgcacagctataatttccagagtatgagtctgtttatgaacacctttaagcagctcccaaactgcttgaactgagacaaagaaagcatgattagctgtgaatttagtgatgcatataatcttatagcaggtcagagacaggttagcagtttttggatcctgaaacaatctctctggactgcagaggaaaactatcagggttaatgaagcttcctacaaagcaggttagaggacgatccagagagctgacagttctttcttattttggtatgtgtaactttaaccttctaaacagtacatgccccacaaaaaaaaaaaaaaaaagcttaaataataggcctctcttttattttttaaaaataaatgaggccaaatgcagtggcccacacctgtaatcccagcactttgggaggctaaggcaggaggattgcttgacctcaggaatttgagaccagcttgggctacatagcgaaatcctgtctctacaaaaaatataaaaattatccaggtatggtggtgcatgcctgtagtcccagctactttaggaggctgaggtgggaagatggcttaagcctgggaggcagatgtttcagttttgtgccactgcactccagccaaggtgacagagtcggaccctatctcagataaataaacaaagtgaaagaagggagctgagtatgaggggaagattagaggaagggagagagaaaggggcagcagctagatttaagaacacaccaagtcctcagctctaatctcagtcatgatgaagggtccctgaagttatgcctcaaccatgttaatttggttcagaaggctccaaaccacatgctggactttcattctcaaaagcaatccatatgtgccttttgagagcctggcagttatattcatatggcatatttagatcttagccaagaatcagacatagctctccttccctgttgcttttctccatcatccttccacctgccacccatttgctccatgactcctgcctttctcatttcctttcttgcatgcaaactaaaaacaaaaacaaaaagtcatgtgatttctttgtcctacttttctctcctctggtctgtcttgtctctctctgtcttttctgtctgtccttttcatgtctcaatctctacagaacctccaccagctaaaacagattcaaaccttgaagcagatgaacgagcaactgcaggctgagaacagggccctgacccgagtggtggccagactctcggagtccatcgagtcctcggacacccaggagctctagttcttgcccctactctccaactcacttccctcctccactactccaggcaggttcagtcttcttgttagtcccagaagctctgtgctcatcccctccatccgagcctccatatgcaggttcctgcaaagcttggttatctgcagatggaagcagccaggactgagatcatagaatgggacataccagcctaggtcaagggaggcagtgagagagacctcagctgggctaccaatatattcatttggtaaggtcaccacattagcttctcttcccctggagactgagtatgaatttgttcactcagctacacataggtatacacgtgtatgtgcatatacctgtgtacatgcacatatacatatttcattgacggggtcattgccagatggaaattgatctttcttagccaatagcaacccaagtccaacccactcccctggagcaactggggttgggccttgggtaaccaagggcaggggctctcaatcttggctgcaagaaacatctaggagcttttaacgtatacctatgggtatattttaaacatatacatagcttttaacatatacatatagggatgtctgggtccatccccaaataatcagtggtctgggttgagacccaggcatcagtattttttcaaacctctcctattgattccttatacaaccatggttaagaaccacagccctttggataccagacagtcctcacggctgacaacattaccgatggagaggactaaaactcaaggttggaactgttcctgtccagctccactaccagcaaaaacactctgcatcccattattcaagcataattggataagcattctttgcctccttctgcagtagtctttgctttcttctcccaccttaggaggcatatctctcattcccgtcacaaatctttgggccctagggatgtgcccctccctgtccttagtgtgtgggctgtgaggcagaacacagcctatataaatgagaccctcatggagccaggccctctctaatgaggccagctttgcaaaggatatggcaggcagtggagcagagagcaaggatttattttcaactgagaaccaaaaatgtgcttggcaaactggatcctttccctagctatggatctgaaagacaagctcacagacaactggtttttctatctcaagatggtatgatggggtcaccactcctctgagatgaatttttaattgtcagcaacaatctaattagtcctgaccagagcctgttctttctttcagcctatttgcttttgccttcagggttagtagctggcaactaatatccactagaactgaatcacccgaattatcatagggctgagctaatatcctgctgtagatgctatcataggcagaaagaaaattgaaaggcaagttctaccatggcctggctgtaagcagccactgttaggtccagactccatgctttaaagttagcctcaagattcctggaaatttttacttaggctaaactagggaccccccaaaaggtgtcccagttatttttagtatccctttgttgcaagatagtataggatatggggcaaaactagatctcatgctttcagtagttaataaccttaacagttgtcatttatttaaggcctgtgctgaatgctttatatagtttttctcatttattccccaaaacaattattgtaaaaatgaaaaaaaaaaaactgagtcacagattaaataacttgcccaaggtcactccgagagtaagtggtagaaccaaaattcaaaccaaatatgtcaggttccagagtgcaaacttttcaccactgtaatataagctgtctgcatatttggcacagttttcaccatttgttaagcatgtggcccaaacaatgcaagaaggatctattgagcaactacactgtgcccccagcattgcagctgagggaggaagggcagcattctgctttctgagcactgtgacttccttgtcaaagcctaacttctaaagagccatttacctaccaaaagattttgctgctgtaaagaaagccattgcctggtacatgaccatagcaagggttagcaaactgtgacccaccaccagtatggcccataagccatacaaatagtcaaaaaagaaatcaaaagaagaataatattttacgacatatgaacacgaacattatatggaatttaaatttcaatgtccaaaataaaagttttattggaactgaaccaaactcatttgtttacatattattgttatgtctatgggtgcttttgtgctacaacagcagagctgaggagtagcaacagagactgtttgacctgcaaaccctaagatacttattgtctggcattttacagaaaaagcttgccgattcttgccagaaggaaggatgagataactaagccaaactggcagtgcagtcgagagattttactctacctttttttttttttaatagttccctggaaaaatcatcttatctcagcatgtagagcaaaccacttaccaacaaaataccagaggggactcccttcccactttccttgtagttaaaagcaagacagctcatgcaagactcatcctgagtccctctcaacctacagctagccttgctctaggtctctgaagctttaggacccctgtagccccttcctctttaacacattcctcaaagactgtaagaagtaacagttgagaaatgtgtacttaattttatttgcccagggtatctttaacaccaaattgtggtaagctgggaacttaaaaattaagaaactaagatccagagagttaaaatgataaagctttgctaaacttcatacttatatcgtactttcacatatgttcttatttaaccattctttaacttcaagtggatatcagataacactgttcatttccccctctctctgctgagattgaactttgtggggcttcccccgccccttgatttctacattccacctcttaacactttttgccactccctttagatgtcaattgtagcatgttgcagctgcaaaactgccttgtccaaatttttttttcaaggaattgacttcttaatgtggaaataaatcactaaaactctacaagactctacaagttgtttatacattttttaaggcagcttagttctgatttgatgagctgctaagcagtgaaatgtaatccattgccatatatagcttcttcctacctattatggaaatgtggctttcgtctcacttatacccaagctgcagccccagcatggggcgttaaagagcagattgaacacggaaacatgaggccaccctgggttttttctaaaaatctcattgaaatgagtttccaagcattcagtctggtaggcaaggctacagggatagaggaacgaaggagagggcagccagagctgctttgattaaatcagaggtaggagaccagggtcaaaggactgcaactttatttttatattttctggattaagtcttcttaataaagtttgcagattatttgcctgccctcccacagtcatgagaaaactcacagtgattgtaggaacactcagtatcgcaaagctcattatgtatgtcaacacacttccacatctgttacctcctgtgagccttgcagagtccctaccatacgagagagtaggacagggactgttgttcttacgaaagtacaaaaatggaaatgcagagaaggcgagtgatctgcctaaagtaatagatcactagtgacaaagacaatgctggaatttcagtttctaggcgtcaaacatttttggtgttttgttttccatcccacgtgtaataaaagaatgatctttggagtcaggcacactgggattcaatattagctttgctgggtgccttgaactagttatggcacttttcatttccccatttgtagaaatcgggataacaactgtatcatagtctcatgaggcactagggagaccctctagcacagtgccatccacattatagatattcagtaattttctttttatttccctgatacaaattatttatgtatctgtgattcatatttgtgtacatacacatatatttatataatttaacctatatcttctctgagagatcaaggaaacagattatattccttaaggcacagttagatctcctaagtggttaatagcagagccagagctagaactaaataggcctcataacacctcagcacaggtcaccctttactgggggcattacctgcccctggggtcctataggttgaaatgactagtcaaaggacacctgtattgaacagatacagatgtagctttctgtagcctgcatagtggcgatgtacttacctgctatcctaaatcgctcttgctgccagtgggacccacacataaactgtacccttatcaacatcccattaggatttttcagatgcacagcgtacttgttgaaagtgcctgatcatgtaacaaagacttgaacttccaggatggaacttgaggctatttttcctttttttcacaagttagacaacagtatgtgtaatgttccaggatagcagaactaataaaattgagtttccactccctcccctgcccaacaagcatctatttctgtgaattacaatgccatcccctaaaactgctgatgaggcctctgggtatcctttggtgactgtcagtggggagctttggggaggattaaatacatgcctagtgttcactgtgcctcacagctctgtgagtgtaagttttctgagttttaattgttgaaagtggatatgtatagtatgaccagtgagaatttggaggattattcaccgaaggcaccaagtggaggatgcttaaatcatcttgtgcatatggcaagaaagccgagtactgcctctctggcctttgctcttgtttttgatgagatgtgaagcagtatcctcctttaactcttctagttgaccaccaccccctttctgaattctttccctatgtcctcaccagcccattttggctctctccccaatttctttaggggtgagtttaagggcaggagaaattgaaagtggttactgattcagtagaatgaaaggatatacagtgtgaaatgtgaggtctgcctatgaagaaataagatattactgctaaatatgccagctcaaaagatggagtggctataatctccctaaagattaacattaccaactcaataaaaaggaagattgaagggaatttcatccctgggagaagggaccatgagagtttattccacacattgtctcaaaaggccctgctcaccaggctggcctggcctggtcagggagggccaaggaggatcctgccaggctctaactcacctttccctctgtcaccctacaggtgttaacagaactgaaatccgacaaccagaggctgaaagatgaaaatggtgccctcatcagagtcatcagcaaactgtccaagtaggctaggctccagatttatgaggaaagaaagggacagcatttgctgcccccacccctcttttccagtccttgccttccaaccaaaagaaatggatgttttggtggaaggacacttctttctatcaccctcttcagtcacctctatacactctacattttctctgcactttcaatgccctgttcttccaaacccctatcccaagttttatgacagttttaattgaagcatgattgtggtaattcgagccatctggagaatgctctggggagtacaccaggctcagctgtggacccctcaacttcctgctgctcagctactttgtccacattggatttggtccaaacatgtaagacttctaccctaatcagtatccttcagctttttacattaacccagtgtcctctgatataggtgagtcttgtggtagccactccaggatcctgattggggtgccaagagaaacagcaggatgttgaattgatcatcagatgccctctggaatggttagcatccaaggtgacagtgactgcattgaggcgctctattcttcttcacctctcaggaactgacttttattttttctgtcaacacccagtaatctccctaactagttttaacccttattcctccctcatacctagccatttctccaaggcgcaaatggccctggcttcatttattcctttcctttctatccttttatatttttcccttccccaccccctcactcaatggtataaaagctaggacagagcacctgacctcagttgtctttggccattgtgggaagtcattattctggagacaagaaaatcatcactctggtgccttggtggcagcaccactgcctgctccctggaaggtagactatggcataagtgtcagctcattgttttcgtctcccacttatcttcccccttcaaagtgattttctttataagaaaatttgggctctgaatactccattctgcctcacttccttgaccttgttttcctctcttcgccctgacacctgcttctaatgagaaatgaagtcagtgcaaggaggaatgagaggtggggaggggagattgttgagagatggactaggaagtggaagcaggctggaaagacacatatggcgaaagtcaagtatctgaggccacttgcaacattgtgacaaagaagatggaagatagcagcctactgggctgtgagaatagtggtgaatttgattatttccagtggttagatttagcagagagatttactttcttagaaattaataggggaaatggcacttaatagaggtttaatggaatgaagtactttcaacccattgatgagagtcatggaagtttagagtggcaagacccagaggtcattaggtccagctttctattattgtgtcacagggacccctgctaccacagctttcacccatgggcatggtcaggtagcctctggtggctatgcatttattactcaaaagttgggcaactctaataacgagagagtttttcctcatatcagctgaagtctgcctgtggattctccttgtagtccagatctactatctgcaactctttaacggcacttgagatatgtgcagtgggtggtctccccctcagtcttactttgagctgctgttactctagtcctttaagtcattcctcatatggcatgcttttcttacctgtcacatcttggccatcctcctctagacaaaaccagcctttaaaatatcatgtccaggcctggaaagaatacaaatccagtgcaaaattaaaccattagttcttgatgataacctagcattaatacttacagtattttctttttgtaggagttttatcccttggttcacttgagtgtgcaagtcattaaatcctcatcattttagggttgccagtgatattcagtgtttagagtggttcattcccttaatatatactacctctgtctgttaattctttcctaacatgacatgtagctctccatggtcctccctctgaaacaccacatgctgtttaaactagaagctgtaattcaagatcccaattccaccaggtgcagtggctcatgcctgtaatcccagcacttcaggaggccgaggtggacagatcacgaggtcaggagttcgagaccatcctggctaacacggtgaaacccaatctctactaaaaatacaaaaaattagccaggcgtggtggcaggcgcctgtagtcccagctactcaggaggctgaggcaggagaatggcgtgaacccgggaggcggagcttgcagtgagccttgatcacgccactgcactccagcctgggtgacagagcaagactccatctcaaaaaaaataataataataaataaataaaaaatcccaattacagaacaggagatatgtttcctctgacaaaaccccatttttagagtgtataaaattctgtctttcatttccaaccatttttcaagagaagctgctactatcttgagacttcgtattatcatgggagtactgtaagttcagttctcagggaatgctaaattagagtaataagttttatatccttcattctgggagaggaaatcaacataaggtgttgactaattgattatcctggaacattttgaatattggggaaggaagatgatacttctttctcaagaaaagaaaattggattattaggaatacatcttgacccttttccactcaatagaccagggaaaggggttacagagagcctcctcagatctgtttgtgcctttcaaaagtactgggggcagattctcaaaactcttagattggtgttgcatccctgccacttcacatgacccttccatgttaaagctgacttttcttgccagaaagttttccttgtgacaagaaatttgcaagcttttcaatctcaggaatactggattctatagccaagaactcatgaaagtaagtgtaaactatcctaggtaatttcaggtactttctcttatgcaattaattttattaactgatttctggtctatctccagagataaaataccattccttcacaactgtattgtctggaagccccatgagatggtaattataggccttctactagccagcagttctctctggatactggcatcagcaggtctcctttttcttgtgctgcttggacaggtacctactgctggcctcttcagtggccacaatcctcagtcctcacctgctggtttggagactcatgagcaccccaggcagctcaagctgaataaatagctgcagacatggccaacaacatggggctcaggtctgtcacttaacttagagtctttacatgaaatatcagaatgggaaagagaatgttcctggtaaaactctgttttcattaatttgttatttttcaaaaaccgagccacacctttggaagtaatgatttggccattccagagattctggggctaaagtttgtttttccagggctgctgatccttttccagatagctccagagtatgatgaccccagccccatcccaatctctagcgaaagggttatgcaaatctcagggtgttgcctctaaagaatctaaagaatagacatgctttgggcttactcagtgtaccagattctctagtgggccattctcatttgatgttccctagaacctccctgtcttccaactgcaggatgtgtttacttctcttctgggcttcccctggtttctgtcctagttcccaccccaagtttaagaagacttagattcatttattgctatctgaggccactagtgagatttcagatctctcttttgcaacattttacccatttcccttccccaaaccatgtgcttattagatggttccactcaggaagcaaggaagctaaaactcaagttaatggtctgtggatcccacgaaagtgtgtgtaaactactgactgtttctccactagaggcatttaattgagccaaagatgatggaagaagaaactctcaaagccatgtactttgttaggtgtctggatttttggcctgtttgcagcctctcctagccacagacagacactgtctcctctcagagaaaggccagtgtttcggtccaggccactggtgagtgtcggcacccttgaggtgggcatggagtgagcagaagaagcctggagaagagagaactatttaaaagtgttgccagttattcagcttccaggcggctttgcacctccaaaggtgcaaaaaggaaaaagaaagcagaaaggattcagcatttaagcagaaagaaaagggaaattctactctaccagatgagccactggttccactggagcttatcagtgaagtaacactgcaggagccctggtatccttccctcagagatatcatcaggggccctcaaaccccattgtttatgccagcactgaccgcactttaagcacacacttaccaatcagaggtcgtgtaattggcctaaatctaggcccagttattactacaaatcttagtcaccatactctctcgcccaggctggagtgcagtggtgtgatctcagctcactgcaacctccacctcccaggctcaagggatcctctcacctcagctcccgagcagctaggactgcaggtgtgcaccaccatgcccagctaatttttgaatttttttgtagagatggggttttgccatgttgcccaggctggtctgaagctgctgggctcaagcaatccacctggctgggcctcccaaagcgataggattacaggcgtaagggcccacgcccagcctaccatactgattttcaaggcagggtctaacccttcataagatgtgagttcttccaacccaataagcaggcagctttgaggacaaaaaggcaacattaaaagataagaccctagaagtcagaacatctgtattccaaggccaccccttctccttttagtcatgtgactttgggcaggtcaccctccctgtctgtaaaatgaggttggactggataatctttatgtgccctttccttttggcttaaaattctgtgatttattcattcttaggaagatcagcatatttattgggatttctgcttcaaaaattctttctaacctcaaaaatccaagtccagaattttttgttttcttctggatttaaactgtttaatatgagcacatcaaggttgacttctcatcctttttgggaagtgaatttaatattgagggtaattgaatgatgttgcaatggctttccctcctgctggcttggtaagaatattaaagcctgcagaggtggaaattggagctcatggagaaatggatagaaagcaatttgttgcaggcagcctttggacaagttgttttaataggaaatagacctgctgcttcataggtttcctcaaccacctttcctcagctttcttaaaatgggatctacattggctcttcacacccaaatagcagactaatcgtttttctgcttagcaccgtctggttcattgtcttgaactctgccttacagcagcaagaaaattttcctcgacaagaacctcaatctttagttccattgagctccccctctggattttggacttaccagaagtaggaggttctgataccattcaagatggtctttccttcaaagcaggtctgaagaggagactaccaaagcagtgtttacaaacccagagtccacacaaccatattgcatagaacagcacttggctttcacaagcctcctacaggacctggtgtaattggagtgaaagggcagagaccctggaagtggaggtggctgtgtgctgcgatgggaagaaggcagaaggcccaggggctttggacatagagcagggtggaagctgcaagtactgggaaggaagagagtttcacagaaacaaagctttgtcacacagaaatgagttctgtctcactggtgacttcatccctcaggctccagctgagcagagattttaatcagcttccttaatgggtattgacactgctcaggaagcagtagaccctgtcagggacagctattgatcttttgtgttctgattagattggaaaatagatcaacttcattgtagtccaggaactgttggtcacagctactaggaatgaggtgatttctgagggctgagaaaaaacacagaatcttggccagcagccagcagctgcatggtgaaagatgcattcacttctcctttgagagttggggttgagggcaaacatagaacccaggtttggcttacaacccagtgtcccggaagccctccttcgggagaactgtaagtaagaggtgggtgtgtctaaagacaataccattaatgaatgttctggccttacctaaaaaggtttagcaatttggggataactcttggatctagcttatgtgcgttcacatgcacatttgctagcccagagcttttaaaatgaggtctggcatatacttgattacaaatgaaaactcagaaaccaattttatttattaaatcatatcttttgtttttccccctcccttctaatcccccaaaggacctatttgagctgttccccaattcatctgcttattttggaccatgaatctgccagagtgatattttctgttatttctcctccaaatttttccctgatgtttccaataaagatttacttgggtggccccttaaggtgacatcaggatgctcttatgtccttccagaataagcatacacttcactcctctccctttcatctccctctgcattcttaattccttgcttttctcacttggagccgagggtgctttagagaggtggttttccatgaatcagccaagattcctgtagaagttgggtataccaaccaccaccaccaccgccccctattccagtttcaaagctcctcggctatgctaatgtcccctcagagatgaggtttgacttttaggcccgtatgactcctccatagcctggccaaggagaccatgagtagccatgtctggtttactctttatcctgagactgtttatagcttaaaacagaagtgtgtcttcccagcacaaacctaatcaatcagtgtatcagtgcatctggtggcaacagctcagcccattcaaagagcaaggattcaggaaaggcacactgatggtggggagcctcttaagagcctctaatgttctcccaaaaccagagttgagagtcggagtgccagtcgtcggggcccactattcctgaataagggacatgcaagggccagaagtagcttgactctcgcctaaatatctgtgcctttgcctgtcctttctcccactctactgaaacccggaacagattcccgcttgccttctgatgaagagaggttaggtaaagagagtttggaggaaaaaagacaccaggaggcaggctgcggggtaggagagggttctgagaggaggcagcaatccagaatacctccttttctagccagcatcccttgaacttttgaaaggttgtgcctaccactggctggcacaccagggcaatgatttccctgcagaaggaaggaaagaatgtttcacccttgcatccttcttggagaagctacagcctgtgctcagttgagtggttcacactcagactttggctttatggttttccttcctccttgtctttgccctgaccttgatcaacaggggtgaaaagaaccaccctgaggtttccatgcctctcccattttagtggtagcattttgtgtctttactccacccttcaccctagttccaccaaggttcacacaccagatgtaactgtttttcagctgagttgtatggattaacttcagtccactgtaaatacacctgggatggggtggggttggggttgtttagggagaagcagccagacttgctttgtgaactgaatgtatttttatgcaattttgagtggcctttcaaccctaagatgaatggttttgttttactggttgttgttatatagttttgagtattctgtgtttgaaagtttgggaataataatattcacttctatatgatgcctgtaaacacaacagtatttataaatgagtaaataaaactgtgttttaactttg

SEQ ID NO: 36031 - DNA, 239862 bp, Homo sapiens; identical to SEQ ID NO: 36030

SEQ ID NO: 36032 - DNA, 17450 bp, Homo sapiens
gtagcagcggtgggcggggcaaaggatccgtctgaggcggcgacgagtggtaggagtcttctttcccctccttcccctttcccttcccttcccgggagaggctgggacccggcaccagggcagtactgtggccgctgcggcctcagctccgactgggtcaggttgcggagactccaggccgcttccagggcggtgcgtactgcgcctgcgcgatcttccacctaaaagagggtgtgggaggggaggaggtgatgtcccaggggtattggggcggggggttgaaataactggggttcaggaggagggatggtggtagagataaaaatgtgagaagggagcagcactggcgaggagtcgggaggtgagaagggggctctggagaacgggttgttggggaaggtccattggaataggggagctttgagaagtgcgggagggggccggggctagctggaggaccggcacctgcagaactgggggaacagcgtggtgtttaaatgggcaatgattgacgggccagaaggggaggaagggagcattccgggggccagcctgggcaggggcggtggaacctaaacccccgccctcgaagcgccatagcttggctcctctcccatgccttgtcgttggcagccttgtcctctcattccttccccgctcctcaccccctcccagccctccatgaaggaatctcacattcttcacatccctgcgcttggtttgcagcctggctctctggcagggttcacacaccacacactggaaggccttccctaactcaggactttgggaaattgggtagtggggaggagggggctagaggaagagcagaaagccaggaggggtgaaggcgttttgcttgagggattgacagactgcttccccgttcagaaacttcatttcatttaatagcaagtggggctgttattgaggccactgttcttggggactggcccgtgatagtgttatccctttctatacaggggttttagagtctgacaatagggcaagagactgatagtgttgttggctgatagttttgccccaaataagaatgtagtggactagtggtagggaatgtgagtgatgcaatgttaagccgaccgacctgtggctagccctgccttctagtaaaaagaaggaacaagcttttgtcaagcatttcctctccgactctcagtactctaaatttattttgcattcttgtttttttttttttttgaaacggagtctcactctgtcacccacgctggagtgcagtggcacaatctcggctcagtgccacctctttctgggttcaagcgattctcctgcctcagcctcttgaatagctgggattacaggtacctgccaccatgcctggctaattttttgtatttttagttgagatggggtttcaccatgttggccaggctggtctcaaacctctgactgtagccgggcgcggtggctcacgcctgtaatcctagcactttgggaggacgaggcgggcggattgcctgagctcaaaagttcgagaccagcctgggcaacacagtgaaaccccgtctctactaaaaatataaaaaattagccggggcatggctgcatgcacctgtagtcccagctacttgggaagctgaggcaggagaattgcttgaacccaggaggcagaggttgcagtgagctgagattccaccactgaactccaacctgggcaacagagtgagactctgtctccccacaccccccgccaaaaaaaacaaaacaaaaccctgacctcaggtgattggtccatctcggcttcccaaagtgctaggattacaggcatgagccactgcacccagccttattttgtattctgttgctacaaataatcttacttgaggataacagtattcagtatcctttcatatttatttatttatttatttatttatttatttatttatttttgagacagggtctcactctgtcacccaggccggagtgcggtgctgcgatctctgctcactgcaacctctgcctcctcggctcagttgaccttcccccttcagcctcctcagtagccgggactacaggcactcacgccatcatgcccggctaatttttgtattttttgtagagacaaggtttcactatgttgcccaggctggtctcaaactcttggactcaggtgatccactcacttcggcctcccaaagtgctgggattacgggtgtgagccactgcgtccagcctcctttcgtatttattatttcatttgatttgcagacagtatgtataaggggtgcgcgcgtgtatatacacatatatacacacacacacatatatacaccttatattacgccgggcgcagtggctcacgcctgtaatcccagcactttgggaggccaaaggtggtggatcatatgaggccagtttgagaccagcctggccaacatgttgaaaccctgtctctactaaaatataaaaattggctgggcgcggtggctcacgcctgtaatcccagcactttgggaggccgaggcaggcagatcacgaggtcaggagatcaagatcatcctggctaacgtggtgaaaccctgtctctactaaaaataaaaaaaaaaaattagctgggcgtcctggcgggcgcctgtagtcccagctacttgggaggctggggcaggagaatggtgtgaacctgggaggcggaacttgtagtgagccgagatcgcatcactgcactccagcctgggtgacagagccagactccgtctcaaaaaaaaaataaataaataaataaataaaataaaaattagcctggcatggtgacacatgcctgtgatcccagctactcaggaggctgaggcaggagaattgtttgaacctgggaagtggaggttggagtgagctgaggagattgcatcactgcactccatcctgagcgacagaggaagactccatctcaaaaaaaaaaagaaaaataggccaagcatggtggctcacgcctataatcccagcactttgggaggccgaggcgggcggatcacaaggtcaggagattgagaccatcctggccaacatggtgaaaccccgtctctactaaaaatacaaaaattagctcagcatggtggcacatgcctgtagtcccagctacttgggaggatgaggcaggagaatcgcttgaacccgggaggcagaggttgcagtgagccaagatcgtgccactgtactccagcctggcgacagagcaacactttgtctcaaaaaaaaaataacatatatatatataataaatatgtatatattatatataccttatattaatatataaggcaggtatcattttccctacttgacagttgaagcaacagaaaaactacagcagggttacttgacttgtttaaatgtgtagatttgggggtgggcgcagtggctggtgcctgtaatcccagcacttcgggaggctgaggtgggaggattgctggagcctgcccaggagttcaagaccagcctgggcaacatggcaaaaccccatctctaccaaaaatacaaaaattagccaggcatggtggtgtgtgcctgtggtcccagctatttgggagactgaggtgggaggattgctggagcctgctgggaaggcgaggctgtagtgagctatgatcatgccactgtactccagcctgggcaatagagcaagaccctatctcaaaaaaataataataatttatgtgggccaggcgcggtggctcacacttgtaatcccagcattttgggaggctgaggcgggtggatcacctgaggtcaggagttcgagaccagcctggccaacatggtgaaaccccgtctctactaaaaatacaaaaattagccgggcatggtggtgggtgcctgtaatcctagctactctggaggctgaggtaggagaatcacttgaactcgggaggccaaggcttcagtgagccaagatcgcgccattgcactctagcctaggtgacagagcgagactctatctcgaaataataataataatttatgtgaaagcactttggaaacattaaagcagcatccccagcctttttgtggaagatagtttttccacagatggtgggcgaggggatggttttgtgatggaactctaccacctcagatcatcaggcattagattctcatagggagtgggcaacctagatccctcgcatgggcagttcacaatagggttcatgctccaatgagaatcaaatgccgctgctgatctgacaggacatggagcacaggccttaatgctcgcttgtttcctgctcacctcctgctgtacgacccggttcctgataggccacagtctggtactggtccatctggggatttggggacctctgcattaaagcatcatcctgtacacataatgtattatggatctatgcattttgctttttttttgagtcagagtcttgctctgtcgcctaggctggagtgcagtggcgcgatcttggctcactgcaacctccgcctcctgggttcaagcaattctccctgcctcagcctcctgagtagctgggattacaggcatctgccaccatacccggctaatttttatatttttagtagagatggggtttcgccatgttggccaggctcatctccgactcctgacctcaggtgatccacccgcctcggcctcccaaagtgctgggatcacaggcgtgagccatcgcaacctggatctatgcattttgtagtcacagatttggaatcattattactggtagttatgtgcactgaataaaagaatcttaaatctccaacaactcctctacttttcctcttgtcttttttttttttttttttaagacggagtcttgctgtgtcgcccaggctggagtgcggtggcgcggtctcggctcactgcaagctgcagctcctaggttcacgccattctcctgcctcagcctcccgagtagctgggactacaggcgcctgccacctcgcccagctaattttttgtatttttagtagagacggggtttcaccgtgttagccaggacggtcttgatctcctgacctcgtgatccacccgccttggcctccctaagagctgggattacaggcgtgagccaccacgcccggcctctcttgtccttttctttccccctcccagctatgttcaaatctactggaccccgtgtgtgtgcttccttagctggtgagctccctccttagaaggtagtcttatttgcctagcactgaaaactgtagtgcttaatggagttgtctcatcctccccaaccaactgccagatccatctgtccagtctccttgccaagtggaggtagttctcctgactctcctttctcttccttgttcctattactagagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggtaaagagctttgattcagaatcccattccaggcctcaaccctcttctctgtcgctcgggattccttctgcccttgaaagtccagttcttaaaacttctttctgcagaaagctttctgtgattaatctgtaccatttgttcttttttgtatatttacaacttacataaattattgacttttacttgttaataatttgcttaatacgtttatgtgtttttatgtgttttttttcctatgtactcattgggctcaagcctacaccttagtttgaggacaaggattatgtgtttcttcttttttttttttgagacagagtcttgctctgtcgcctaggctggagtgcagtggcatgatctcagctcactgcaaccttcacctcctgggttcaagcagttctcctgcctcaccctcccaagtagctaggattacaggtgcccaccaccatgcccagctaatttttgtatttttagtagagatggggtttcaccatgttggccaggctggtcttgaactcctgacctcaggtgatccacccacctcggcctcccaaagtgctaggattacaggcgtgagccactgcgcccagccagttgtttactgacctcttctttgggtttgacctttgggagcccaaagaaggggcatggcgccattgccgctgtttgagtccttgctcttttggacctctctttttttttttttttttttttgagacagagtcgtgctctgtcactgggctagaatacagtggtgcaatctcggctcactgcaacctccgcctcctgggttcaagcgattctcctgcctcagcctcccgagtagctgggactacaggtgcgcaccaccacgcctggctaatttttgtatttttagtagagacggggtttcgccatgttggccaggatggtgttgatctcttgacctcatgatccgtctgcctcagcctcccaaagtgctgggattacaggcatgagccaccatgcccggccctctcttctcttctttatccccatcaccaccaccacctaagttcagactcttaccgtcactctcctgacttagatgttcttccggtctccagtttctcccctgttaacatactgattctaaaatggaactattatcacattgttttttaagtccttcagtggctctctcatacccttcagaataaagtccaaaatcctcacagacttttcacagcatggcccttgcttgcctctccagccttgtctcttgacaggccctccctcccacctctcaggtcagccttttcttgaatcacttgaaattctctgaacctatcatatgccctcttctgggcatttggatgtgctattttatgtgcataacaccctaatgccctgctcccccaacatttagctgactcttgccctacaggacacgtttctggtgacgcccagtcctggaaaacttgtcaaaaccaccctctgctttcagcctgggttaggtattcatgtctcttgtcctcataaggtcctgtctctactctgagtatttatcactttatattttaaatgtgtgcttatataatgtcttcccccattagaattacatttctttttttcttttttttttaaggcagagtcttactctgttgcctaggctagagagctgtggtgcaatctcggctcactgcagcctctgcctcctgggttcaagtgattcttgtgcctcagccttccaagtagctgggattacagatgtgcatcaccacgcccagctaatttttgtatttttagtagagctgggttttcatcatgttggccaggctggtcttgaactcctgacctcagctcatctgcctgtcccggcctcccaaagtgctgggattacaggcgtgagccactgtgccaggccttagaattaattttttttttttttttagagactgaggctcgctgtgttccccaggctggagtgcagtggcgcgatctcggctcactgcaacctctgcctcctgggttcaaatgcttctcctgcctcagcctcccgagtagctgggattacagatgcgcataccacacccagctaatttttgtatttttagtagagacagggtttcaccatgttggccaggctggtcttgaactcctgacctcaggtgatccgcctgcctcggcctcccaaagtgttgggattacaggcgtgatccactgcacctggccagaattaaatttcttgagtcagcttccaccgagccaaatgactgctgcatagtagactcccagtaaatatttgttggataaatgaatggatcttggcaatgagtgtatgtttgtcacatatttgtaggcttcttctgaactggcctctttttcctgttgtcctttcaggacctgggtttcagtgatgagacatggggtatgatgtaacccgtttccagggggatgttgacgaagatcttatctgccctatttgcagtggagtcttggaggagccagtacaggtgagttggtctgatggcaggtttggtggggcaacaggtagcagtggaactagtagaaaatattcatgggcagcgggacccatggtgaagtcactgtgttcttctctccaccctcacccaatagagatttaggtcaaaggagtaatggtgactacaagaataaggccttccagaatcaatctagaggtggatgccacagagatccagtggttcagatttttttctgaggtcactctgaaagatttctcctgtaaaacagtcagctgcttgtttctgtcttgtgatagtagctgggtagcttcctttcctctacaggaactcttactaggttccatcttcctgtccgtgattgaacttctggactctcctaataagttctctctgcatttttatgatgtagtgcttcaggtaatcagccaggctccctgcaggcctcttctacctgcctactgtctaacaaataggaaggctgggcacagtggctcacacctgtaatcccagcactttgggaggccaaggtgggtggatcacgagttcaagagccatcctggccaacatggtgaaaccccgtctctactaaaaatacaaaaattagctgggcgtggtggcacacacctgtagtcccagctactcaggaggctagacaggagaattgcttgaacccgggagtaggaggttgcagtgagccgagattgtgccactgcactccagcctgggtgacagagtgagactccatctcaaaaaaaaaaaaacaaaaacaaataggaagtggggaactgtatgtactgacctatttttttcctgggatctactgaaaagaccagcttttgatacagccatgcactctgcattttgatgtgaaagctgccaccttcaataggtcatttctctgccagccttgccagaccagagtcagttgtatcatcctggggcaagtatgaggagaagctcacgattaccaggcaagtacaatgagtgaggtgaatccttaagagttgtattcatgggacagcatcctccaggatccttattgccctcattctgtaaataccaattaatcctttctctttcctggctatctagagattatcacattttccaaaccaggacactaggcaatgaggtttcatggcccttcccccattcactgctcacctaactcccaggggctccccttgagcctttattttttctcccagtactactccaaaaggagtactgatgccttgagctgaataaaattcagactgcattccaatggcaaccaactctggacctgtcttctttctaggcctttgcagtctgctgccattagaggcatattagatgggtgtggagcaagtcatcaagtagtagtgtcaagaggtcacagggtgtgtcaggttccctcctcaccctggcagggccttgtctgttttctggcactatcattttaggcaagtcacttatggaaaggtgagtcgtagttggtgacagtctagtcagaagccacccatctacctccaggctttatcttctgaggagcagagcaggcaaccctcatgatgccaggttcccagacacatttctaaggttagaaggctcctgctagggatgctgatttccccacatcataattatttattttttgaataggtgaaaaatgaacatagttcagaaatcaaaaggtatacagtgagaattctcacttctgtctttattactgtgcacctaattcccccacagataactatttttattagtttatttggtatccttccagtgtgtcttaaggcagatataagcaaatatgaatagatgtctgcatatatatgtatttgtgtatacatatgtatatatgaatatatctgtgtttcaccatgttggccagtctggtcttgaactgatctcaagtgatctgcctgccttggcctcccaaagtgctgggattacaggcatgagccaccatgcccggccttatttagctttgttttgttttgtttttttgagatggagtctcacactttagcctaggctggagtgcagtggcatgatcttggctcactgcaagctctgcctcccaggttcacgccattcttctgcctcagcctcctaaatagctgagactacaggcacccgccaccacgcccggctaattttttgtatttttagtagagacagggtttcgctatgttagccaggatggtctcaatctcctgacctcattatccgcccacctcagcctcccaaagtgctgggattacaggcgccatccaccatgcctggcctagctttcttacattgaatttttgccagtaaatatgtcctcctcctctctaaatctatcatctgaattatccttcaagacccatatcaaattctgtcctcttcataaatacctgccgtgattgagctagcctgaaaagacctcaccctcctctggacatttttggcaattattgtgtatgcaatccagatggcaattaataattggctgccttgtgtcatctgtcctattgtcctagaatatcatttgtatctcttattgttatataactttttacttgtttgtcttgtttcacaactcatttttaatcttgagcacagggaatatatatatatatatttatttatttattttgaaacaggttctggctctgtcacccaggctggagtgcagtggtgcagtcttggttcactgcaacctccgccttatgggctcaagccatcctccatcctcccacctcagcctcctggctagctgggactataggcacgtgccaccaggcccagcttttttttttcgagatgtattgcccaggctagagtgcagtggtgtgatcttggctcactgcaacctccacctcctgggttcaagctattctcctgccttagcctcctgagtagctgtgattacaggcatgcgccaccacccctggctaatttttttatttttagtagagacagggtttcaccatgtcggtcaggctggtcttgaactcctgacctcatgatccgcctgcctcggcctcccaaagtgctgagattacaggcgtgagccactgcgcccggcctatgcccggctaatttttgtaatttttgtagagatggggttttgtcatgttgtctgggatggtctcaaactcctgaggtcaagcagtgtgcctgccttagcctcccaaagtgctgggattacaggcatgagccaccgtgcccagcaggaaacgtatcttaagcctgtcccctacaatgccttgcccgtagtagatctatactttgctgtgacccagtggacctcttgtcgtagaggctgctcaaaggcttgattggctttgtagagttatatcatatccaggctcttaggtcctgctaattcccttgcgccccttttgccttgttctctcttctaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtgggtgagatttgttcccttctgccccacatggataagggccatctcatttatgcccctgtctctggctgccctcctcactagctgaggaggtctctttggcatgttggcaaggagtattcttagcctccttggcttcctgctctaagatcttactttcttgctgcttttccaactataatcattttgctcttgctttaacaaaagaaggggcacagcaatttagtaaatttgtgtaataacattaaagcttgattgactctattcttccctttcagtccaatactactttccgtttgtcaggttgactgctataattgccagccttctcatatttcctcttgccctatttttttatttctgtgggttatgaaatattcgactaaatgttgatagctgaagggcatgttagctcacacctgtaatcctagcactttgggaggccgaagtgggcaagtcacttcaggccaggagttcaagaccaacctggccaacatggcaaaaccttgtctctactaaaaatacaaaaattagccaggtgtggggccgggcgcggtggctcacgcctgtaatcccagcactttgggaggccaaggcgggtggatcacgaggtcaggagattgagaccatcctggctaacacattgaaaccccgtctctactaaaaatacaaaaaactagccaggcgtggtggcaggcacctgtagtcccagctacttgggaggctgaggcaggagaacggcatgaacctgggacggggagcttgcagtgagcagagattgagccactgcactccagcctgggcaacagagcgagactccgtctcaaaaaaaaaaaaaaaaaattagccaagtgtggtggtgctcgcctgtaatcccagctactcaggaggctgaggcatgagaatcacttaaaaccagaggtagaggttgtagtgagctgagatcgcgccattgcactccagcctgggtgacagaatgagactctgttccccctaactaaaaaataaaaagaatgttgatagctggggctgtgaatatagggcttctctgaaggaataagtgcacaggcagaatctgtaggaggaaaaggagagctgtgcagtagataaaaacagtgtgtcaaaataaataaataggccccgtgcggtggctcacgcctgtaatcccagcactttgggaggacgaggcgggcggatcacctgaggtcaggagttcaagaccagcgtggccaacatggtgaaaccccatctctactaaaaatataaaaattagccaggtgtggtggtgggcacctgtaatcccagctactcgggaggctgaggcacaagaattacttgaacccatgaggcggaggttgcagtgagctgagaccgtgccattgcactccagcctgggtgacaagagtgaaacttggtctcgaaaaaaaaaaaaaaaggccaggcgcggtggctcacgcctgtaatcccaacactttggaaggccgaggggggcagatcacgtgaggccaggagtttgagaccagcctggctaacatggagaaaccccatttctactaaaaatacaaaaagttagccggccatggtggcgcgcacctgtaatcccagctactcgggaggctgaggcaggagaatcgcttgaacctgggaggcagaggttgcgctgagctgagatcatgccatcgcactccagtttgggcaacaagagcgaaactccgtgtcaaaaaaaataataaaaatacaaaataaaataaatttaaaaaatagataaaacactgtgtcttgattggggaaagaaatttaaggaaaatagacagcaaaggggcaagtaggaagcttggacgaagaaagtgaagggaataaacaagagggaggcctgaaatgaatgttagaaattttgggtaggacaaaatctacttagcagttatctgccacagaataggccatttgcatacatgtcccagggatcacctctgttctgctctttccccaccctggtctgcagcctggagatgcccaaagatgagctgcccaaccataactgcattaagcacctgcgctcagtggtacagcagcagcagacacgcatcgcagagctggagaagacgtcagctgaacacaaacaccagctggcggagcaggtaggccccaagacacgggggagaacatatccctcatatgcagataactgcctgcctgtgggtaataaaaaccagttgtgaacacacagaccagtgcttacacttgtgagcctagatgagtggatattctgcctgtggcttagcagggaatcagattggagctctccttgacttttcttcatcccattcatagcattaattcacctaccagttatcacatgcctcctctgtgaaggcacatttgtaagtactaaggagacagctgtgagtgagacagtcttatccctgtcttcctgaagcttacaaactggttgttcttcagatctctcagttgccctcattcttggataaacttttgtcttttttctgctgtctgccttaaccattattcctgttcttcttccccacaacagaagcgagacatccagctgctaaaggcatacatgcgtgcaatccgcagtgtcaaccccaaccttcagaacctggaggagacaattgaatacaacgagatcctagagtgagtgtcactcaggacgtggagtgatttcatgtcctgacaacaaggcctgaaaggaggaagagcaggagagtagcagaaggagggcattggagagctgggctgggggtcactgcttctcagatattggcattaaggacaggggcagaggagaagaggataacccttagctccactacaggatgtcttatgtgtttgggtggatggagggaaagcctgcccaaggatgcactttatccagaattaggtgagtacccatgtacaaagccctgtattaaaggctgtggagtgctaggagggccaaaaagaaatagaagatatcgtcctgtcttcaggtagcttacaacccagagaagaggaggcagagtgcaagtccaggaaagtgatctctaaaatgcagcaaaaacaagcgaagtatacaagtgaagtctaagatctctttcagttctggagtcctatacagttcatagagtaaactgtaagtgtgaatcaatatatacagggcaaatagtgctgagtgggacataggatagaggaataattgttttattcactaaacatagagcactaactgtgttaggcgctatatgtgctaagtattggaatttcaaagaaaagtaacagagacagagtgcagacttgtggaatttaatctggtgagtaacatgtggtgactcagttgggaccaagtggggaaagatttggggtttctgagccaatgatggaaggaaagaaggaagaataggtaagctgagtgcagagtgggtagttatttctattagcagaaaaagccaatacagagaaaggagatgagctggaatgaccatctttaaccacctccacacaggtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctccatccattttcctgcttagggtccctggttccagttattttcagaaagcacaaagagattcaatttccctggaggatcaggacagaggaaggaatctctaatcgtccctctcctccaaaaccagggaatcagagcagtcaggcctgttgactctaagcagcagacatcctgaagaaatggtaagggtggagccaaatctctagaaataagtagtgaggccgttaattggccatcactgatggcccttagggaaagactggacctctgtgccaagcagtatccctgttcagcccaccttaaaggtgtaggcacccactgggtctaccagtatgcaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttcctttttttttttttaagaaaggaaaaaagaaaaaaaaatcaaacttgaaacttttcttttgatgttcctattgtgggggttctggatagggtgggacagggatgggggtgtgttttatattttttccttttcagcacaacctttggctttaatataggaagagccaagggagtcctcggctgaacttacgatatctgccccaaacctctgtaaccccaactgaaatgaggagcttcctctcttcctgtgaaggatatgacagtccagcatcgatgcctgtgccctctggaaaaatttcctcctagcccttccagggccttatcataaaactctggatttagagtattcattttgaaggcaactcccccttccccaagtttccttggagctgtatagctgggttctaagcttcaccatgcaaatcagaaattttatctctaagtacaggctgtgccgtgtctcacccacacccccctggggacttcagttccatttcaggttacctggggtataccttgatccctagagtgactggcagagtaagagaaggggagagataataggtgtgattattttaatatggaggtgggagtgtggttggagatagaaaggctcctccccaccatgtaatggcttcctctcagaattttattccaggctagcttgctgcaggtctgggtagttggatcatggctccactgggattggggtggaaagcttgaggggagtagggttccagctctgggacattgtgctcaggaatttgaaaacgctgctatacttactctggttactacatttcttccactcccctttcccctacctgccttaaccaaggctcatactgtcctgtccttaccctcagatggagccaggaagctcagtgaaaggcttccctaccctttgcactagtgtctctgcaggttgctggttgtgttgtatgtgctgttccatggtgttgactgcactaataataaaccttttactcaactctctaa

SEQ ID NO: 36033 - DNA, 70466 bp, Homo sapiens
tggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggaggtgagtgcgcccgccgtgcggagccgcgcctgctcccgcggcggtgcccgggccccggccgaggcgccggctgacgttgcccttcagggccgagcccggagcagcggccgccgcggaggcgcgtgagccaccccaggctcgtggggccgcgccgcctttccggcctcctgcccgcggccccgcttccctcggcagccggaggcctccggggtgcccgtgctgccgcagcttcctgtgtctgagtcgcgggcggcgcgggcgcggggctggtgcgcggccggggatgcgcgcgggaccgacccttgtgtgtgcggcggcggggaccggcccggcgaagcagccggaggccgcgcttcggctgggaggaggtggcccagctgggccgctgacgttgccctcgtccgcggcccccgcctgcccagaggccgggctcgcgggcgttcggaccgcgcgtggggcgagactgcactcgcgcccgctgagatgccggccccacgcagcgcggcggcacgaggcccacaggcagctcagaggccgctgccagaggcagacattctctcggtgactccagaggagtgcccgtggcccttgcacttggccgtggagtcattgatctaaggagtgctggcattttttgaaattgagaagcaaagatgatgtctgtcacctggcagcgtagacggagagtggcggtagatgacttgaatggacacgtggattcgagtctggggacaggcgttcccccagtcggtgcgttgtgagagtgtggaaaccccttccccactcagtccaatttcaaggttatggagcataattaagagtgaccattctaaaagcgttctctagtgccctggctaagacttttaagcttcttggtgcaggagtgtctaaagtcccgcgactctcactgccctgtcttttattttcttgacctttgattagcgttgagagaaactggttaaatcttgcagtttctgccacccatttcacaacttaacctgtgattgtcccaaagaaaacaattattggcttcttgctagcaaaaaaatcaaaggcttccggttgattgtttctttcttttttttcttttttcaagtggacgtggaaggttaggctggctaaaacttaaagtttgagttgtaggtctgtgctgggtaggcttgagaagatggagctttttaaggaaccattgctcgccatcagattggagccagacagtgcagtgtgatatagtggaaaaggaccaggtcttgggagacttactttcttgttctgactcaactcggaaaacacctccctagtctgaggcccccctccttatatttgtgaacaaactgcattagactaaaatctttcacgagtccaaattctgcgactagaaaaataaacttgttagccgcacaccttatacctctcccctttaaaacagacatattaaagacttctgttttctgaatttactgtaaacagaatacttaaaaaaaaattacccagacaggcgtggtggctcactgtaatcccagcactttgggagaccgaggcgggcagatcatttgaggtcaggagttcgagaccagcctgaccaacatggagaaaccctatctctactaaaaatacaaataattagccaggcgtggtggcatgcatctctagtcccagctactcgagaggctgagccaggagaatcgcttgaactcaggaggcagaagttgtgatgagctgagatcccgccactgcactccagactgggcaacagagcaggactctgtaaaaaacaaaacaaaacaaaaaattacccttccccacaattataagcattttggcatatttccttcctgtctctgttgttcctattttggcagtatttttattgttatcgcaggcagcctgactgaaaagaaatctgggcttctaagtttttggtatttaggaggtagatacaagtgacccatgcatgtagggttaggtatctatttataccatgcaggtagagttttcatagccacctctacttttgggtgaagtttaggctaactgaaagtgtaccagcatgcatggtgtatgcagaaaaatgaacgtaattcagattatgtgatagttttctcttgttgccattatatataacccagggcttaccacaaactgaaatttcttatgcattgacatttagcatttgatgtaaaatgactatctcagagttgctgccacaaacactggtaaaactgtccctactttctagcatgcttaatgtctaggtcttgctacatcttttttgatgtaactgttttgtggaaaatggttgtgtgtttggggaggcttttgagaaaagataaggttgtcttgtcattataactgggtatttctcctctctcccttccagtttcacttgtctggaaatagcaagactataggagtagtaatttctagatatttatagtcagtaaccttagaggaatgtttagtttttaagatcaattgaatttattgtgtaagtttgccatttaaaacaggtgcccatttgtgtttactgtctcttgtaaccaaactctgttcaattagaatccattagtaatgttttgtggagagtcttgtttggatgatgcagtgcatgaggctcctgtactacaaaatagaaaagaagttcctctaaggcagctcaaagctgttgatatcctgaagcctttttaggcctccctctctgacaggcggtgatctgacaggaggtagataaaggtgccggagtttttagtgaaggttggcagtccaacttggtagtcagacaaacacatgatggtcaaaagtgcctttgacactggggcctggagaagaattctcagtggccagagctgatctgaagctgcaggcagttgagtttgagtttcaacatgttggtacttcaaggggcttctgaaaagttttaaaggagcacaagccctgaaggagtagctgaacttagtgaactggagaaggcaggggcagttttaccagggtttgtggcagcgactctaagattgtcattttacatcaaatgctgaatgtcaatgcataagaaatttcagtttgtggcaagccttgggttgtatataatggcaagaagagaaaactatcacataatctgagttatgttcattttctacatcatgacattttcactttcttttttttttcttttttcccagataaggtctcactctgtcgcccaggttggagtacaggcatgatcatggctcgttgcagcctctccacctccctgggctcagttgatcctcccacttcagcctctccagtagcttagactacaggcgcacatcactatgcccagctaatttttgtatttttttcgtagtgaagcggttttgccatattgcccagttgtctcgaactcctgggctcaagcgatttgccctccttggcctccccaaagtgctaggattacaggcgtgagccactgcacccagcccactttcatgttcttgactgtgttagaaacaacacagtattgattcacttatgacctttgaggaatcaagaggggcgggtgaaatattggagactccttgaagtgtggctggcttggagggtgtcacccttggacaaaaacttaagtggaggtgagtaagggccctgctcccctgtgctgcctgccttagaaggatgtgatcatctggaggcaaatagcttgttgcttgaggccaggagttcaagaccagcctgggcaacagagcaagaccccatctctagaaaaaaaaaagtaaaaacaataaaataaaatctcaaaactggtggttccatataggtgcctgggctgattctctttatgaattatttgctggtcttcaagtttaaataaaattctgaaagctgtctaatatctaaaaaccacttgccacagaaaagctgtatttgtttttcatattttaagagtcatacatacttactggagaaaatttgggaaataggaaaaatgaagctcttccagagattaaatactattaacattttgttatatttccttccagtcttttttccctatacaataaacaaattttaagcatacattgttaattaaagattacaattttgacaatttaactttatcacctaagttatattgtgggcttttttacacgttgttacatattcttcaaaaaataagttctgaagatgactgcattatttgctgtatgggccataatttagttacttctccccatttgttggatatttttcagaacagtttaccaacctttgttatatgtttaaatacgtctttaaaaaataaaaaatgttctgctttaaaactcttgaaattaacaataatttgaaaagtgtttttactaatgaataggtttaatggacttttgggttcatgtattctagtcaaaagcagttgaaatagggatttcatggtttggaaagagaaatggaaagaagttagggcatcagaggaggaaacggggcctgcctgtagaccatttcctcattctggaggggacttctgataaatgtaggctctatccattagcacagctttggctgctatagaaatgggcactttccccttaggtttgttgtgggagaaatgtccatataagaaggactgaaacactctgaatactatttattcctttattaagcagagtcatgagaaagtgcttccggagctagtttctccttcagggtccaggtgtctgccacaaagcagggctgtggtagctgaccgaggtggtagccacagcctggacacggccaggcttaggaacagagcagtgatgagagcagcagacagagccaggtgctgctaagcttctgatgggttaactcattagtaccttcagcaaccctgtaaggtaggtcctgctgctatccttactgtacacaagataaaggaacaggtgcaaagattaagttccccataccagaatttgaacctaggcagtctggcttcagggtctgtgctcctaattgctgggctctactgcccctccagagctagaagttctcactccaggagggcctagaaagttccaggttaggccaggtgcggtggctcacgcctgtaatcccagcattttgggaggccgaggcgggtggatcaccctgaccaatatggtgaaaccccgtctctactaaaaatacaaaaattaactgggcgtggtggtacgtgcctgtagtctcagctgctcgggaggttgaggcaggagaatcgcatgaacccaggaggcggaggctgcagtgagccaagattgcgccacagcactccagcctgggtgacagagtgagactctgtctccaaaagaaaaaaaaagaaagttccaggttatacagctggcagtaagacaggaaggacagagctgggtctccttcggtgtcactgctccttgattttacccccatctcatttacactctgccttgaattatctctttataccactagagtgctgaaagagaccacaaattttgattcagcgtggctcagggagtgataagatcacttgctatgtagctgtgactttctagagaattaaaaaataaaaggctttgcctgccctggacattggtcttgtaaggctggagaacaattgagacgcatgactggccgggtgcagtggctcacgcctgtaatcccagcactttgggaggccgaggtgggcggatcatgaggtcaggagatcaagaccatcctggctaacacggtgcaaccctgtctctactaaaaatacaaaaaattagccaggcatggtggtgggcacctgtagtcccagctacttgggagtctgcagggatcggaggggggtgacttggccaaggtaacacaacctgcctgaccctctggccatgcacacgtgtggagtttgttcccgggccctgtgcctgttcaaagaatggctggacgtcggtattgcccttggtttctgccctgaagtccagtcagtcagcagttctgcttattctgaccctctctgtgcagtattacccaacacacatgcatttcctccttgccttctcagtattgccatcgtgaaccagaattgtcacctccaatttaaacagtgaaggcctttgttaggaagaggggcagggtgcagagggggatggttgctttttctaaatcacagctctgatcaaatccctcctaagcagaagccttccaggctcccctccataaggctccaggtgtttacttaccttgcctgtcaggggcttctgcagcttgcttcctacctgctatctccactcctctccaaaccaccatatcctgaggcttctagaaagcaaactctggcggcatggggttaatgggtctgtgtacccaagacactgtacctgggtgctgtcatctgcctgactgaccttcctgtgtcctggtccgatggtgtctttgatcctatagctaagatcaagacactgaaaatctctagactcaagtctgtgcttttgctgggataaagtttgtgttgagtacatctaggctgggtgtggtagctcacgcctgtaatctcagcactttgggaggccaaggcaggtggatcatctgaggtcaggagttcgagaccagcctggacaacatggtgaaaccctgtctctgctaaaaatacaaaaattagccaggtgtggtggcaggcgcctgtaatcccagctactcaggaggctgaggcaggagaatcccttgagcctgggaggcagaggttgcagtgagccaagatcgtgccattgcactccagcctggggtatagagtgaggctctgtctccaaaaaaaaaaaaaaaaaaagtacatctaaatggtacgatgcccatgttggcctatttggaatgccattccttgtcccacagagccctgctcctcagaggcacttttcctggagtgactctccccttcctcacctacactcactgtcattcagctgtagatgcaccagcgatcatgctagtggttaaaatatcgaaatactcccatcctggctagagaatagctgctacccaagtgcccccgcccttcatatggaaactaaagggttaatacatggggcagtagaggaactttggagccctgttttggtgcactggcctgtgtcttttctggctggttggtgtctggccgtactggctattaaatattttgatgagcatcccagcctctgtcccacgtgcatcttttcatgagtgcatatctggcttccacagattggcaccccagccacactctaagctctgggcacatgggagacctagtcattgtcatctctgtgttttcagcagcgtttaatacagggccttaccgctagtaagcatgtaagattatctaatgatggattgagggtagggcaggttccgatggtcagatgtcccatagaaggtggtccctaacaagaatatacattgtaatgttccaggtttgtctattctgatactgtgcaaaacgtagatcttatagccaagatcaaggcatcgaaagtctgtggacctaagcctgtgctttcactgagtgaagtttgtgtttcggagtacatctgaggtgtttctttccgtgtagtttcacttgtgttggagaagcaggtggctgtggtctttgcagggtgtgagaggggaggagattagtgttgagctccagctaatgttacataactctactgtagtcttcctttacctggtattcttgtgttcaaattgccccttgtttctgtgccactagtgaaatggtcaaatggctcattgttccttctgtaggacagttacctacattgcgcctcaggcaagcttctgaggcatcccaggatggggagctggcgggggaccttatctgtcaagcagcccagccaggcacctcacagtggacggaactgagttcttgagggggtggctgagcagcccagactcccaggttagactctgaagacagccagtctgtgcttttctctcctgatgtgagtcagaggcaaactctgccgatgccaagacctccctagagttcaggcagggtgaagatccttgtccttggggtcagggctgaagcttcagggtgtccaggacagaccttcagaggaggccagccctggagcctggcgtgggtctcggcctcaagcctctctgtcctgcagagaggccggctcagtctcttcaccctctcaggcaggccaggcgacggtcaccagtagcgtcctgctctctctggcatgcttcccttcatcactgggtgatgctgagtgtcttttcctccctctttgatgtgacagtccctttttgcaggcttttgcaggcactgtccctctgcctcccaggtgtggcacgcatttcagggtgcctccattagcagtttcatgcattgttgcccatggtggggaacagatggagacacaaggcaggcaagccaccaaagaggctgcagggctgctcaggagatggaaggactgtctccagagtggggtgtatgccccatagtggctgcctagaccatccattagattgtagaatagaatagaaacattagaacttctatggatagttattttttggccatcttttaaattcatatttgtgtgttttctaatggtcagaaaatacttgtatatggtttatagataaaagcatttaatgtgaggggtgcatttatttattggggtacatcatcagaagtctagagaaccagaaagttaactccttctctagcaccagtatcatgagagacctctgaatgccattttttaaaaaggaaagaatttgtcaattaaaggggaatagaaactgctctctggctaggttgtgattcatgtcaaataggcctgtgacttaaggagagtcaggttaactccagagtatgttttgtctctggtcccaaaacttagcagtgtggaagcctcattgggatcagggttttatttttttctcttttgtttactatcatatcccctgaggctggagctgacttgcatatcctcaatatttgcaaattgaatatatgggcgtttttcttgcatgataattaagtattatgctgagttggatgcttcaagtcaatattcaggttgcctccttttgtttaaacctttgggcagttggcaagatgcagcctacatgccagtcagttttactgtcctgcacatgatacccccacgcggtagaaccatagagccgtggaggcctcagaaatgtcacctgagagacagggtgttgggatgtaacttaaagtaattttttaagaagtgggtataatgaaacagcaaaacgttgatcattactgaagctgaagttggagtcacgggtacataaaatatagttttattatacttctgtgtctacttttgaatagatttgaattttcataataaattttaagtgaaacataaagggaatatagagaccccaaactagtatcacccattccgagcaggtaatggccgaactgcatagtctctttttctttctgtcttttaaacactggtcattattctataatcttctgcaacttgttaggtttgttttgattttggcttccccagagccagtcacctctttttatagttacctgagctctttgtgtaattttagctcatgtctcgtggttgtcaccagtacctctcttctccttcccaatacgatgagctaaatcctggttaaccttttccctatttcacttgttgcttcctccaacaccactgaggtcttccacatgacaggcacaattcagaggccagaacagggtcccatgttttttgcaggctgcgtccagtcctggggaacctcatagcctgtgattatcttctagattccattcatgtctgcttttttttttttcttttggatggcgtctctgttgtccaggctggagcgcagtggtgccatcttggctcactgccgctgcgccccccacaggttcaatcgactctcctgcctcagcctccgagtagccgggactacaggtgtgtgccatcacgcctggctaatttttgtatttttagtagagatggagtttcgccatgttggccaggctgggcttgaactcctggcctcagatgatccacccacctctgcctcccaaagtgctgggtttacaggcatgaacctgtaaacctggcctcatctctgctttttaaagtaacagcaggtacctgttgaaatctgtaaaaactcaactcagaagtggatttctccaaactcgtgagaggctgatcttcttctccctgggcagagaggtctttgtgtcctgtcttctcacccgtgtcctgctaagccatttctgtggttatcagtctctgaaaccttggtctattttaagaggtgtgagtaactctacccaacctttgccctttttaaccttcttatccaggtcactgatatgtgatagctgtgacctctgcgagctgtggggtgctgtggactccttgaagacaaggactgggtcttactcttcccagtttccccccccaggcctgggtcctggaggggacaggagggctctgtgaactaaacacccactgggtgagggcgagcctcctttagccagctgtttcttactcagccaagacattgacaagaatgctgtcatgggagagagagaggcagaggctcctgacggttgccttacaatgcggctgcgagtccccagcccacctgccgctccttcagggcctcctccctgcctctttgctcacagcactgtctggctgttgctggtgtttctccacccactcctgtctctgcctgttcagacttggcctggttccaccctcagctctctggacagccctccctcggatgcctggtgcatgcgtactgttttctccctcccctagattcctggagcaccagggccctacctgccgtggttatcagatctgtcttctgtagctctgttaactcttgcaggtgtgtttgtcttcattgatatcctaaacttgctgaaggcaaagaaaaccttgtaagtattttatcctcaggctttctgattgtcaggaactaaggagagttggttatccccctggaatgttcagagtgttgcttctttttttgtggtgtgactcctttttcaaagaggcacgaaagtggaagtggctcacatagcaggtcagtggctgagccgggtccagcgtgggcagacggggcaaagcatagctacatattttccaggaggggtttatatcctatctgtcattctgttctgaggacaggtcactacctaaatccttcgtggagcaggtgggaaatacataaatacaggaggacattaactgacctgactcacttatagcttctttatctggagaaacttttaaaaatacagctaatagttaggatggcaagttttatattaatttttccatagtaaaaaattgggaaaaatacagcaacatacaaagaacaacaacatagtagtaaaaacacccatagactcgccacatagaattgaaggttttaacattgactcttttcttcatatatcactgttccctgggggttttgggtattaggtggaaacttgattgtttagtcctggacgccaggattgtgtggccatcttttcccttctcttacatagtcttggagaagctaccatgatgttcatgatggaaagaggcgtagctctcctctgttcccactctcctttttttttttttttttttttttgaggcggagtctcgctctgtcgcccaggctggagagcagtggcacgatcttggctcactgcaagctccgcctcccgggttcatgccattctcctgcctcagcctcccgagtagctgggactacaggagcccaccaccatgcatggctaatttttttgtatttttagtagagacggggtttcaccgtgtgagccaggatggtcttgatctcctgacctcgtgatccacccgcctcggcctctctaagtgctgggattacaggcgtgagccactgtgcccagccttacatgttcatattctgtttatttccatagtcaccacgggaagatgggaagatcctgactttgggcagagcacctgagaggaccccaggatctaggtaccttctctgcgtgcagtttctcaaacaagtggagcttcctctccatccatggccctcggaggaggaaagtgcctgcatagcttggggccagctctggctactgtgaaaggacatttgatcctctctgctgttcagttgtgctctcttctcctggtgtggtctcttgcttcagggcttactttgtggttagctgagtccagtaaggtgaagagtcttctggattatttcagtggcaaaaagccttttatttccttctttagctttcgtaataacaggccgtgcttgtcttgcctaatacccttagaacatgctgtcatgttcttcaacttgcggtcatagagacacaattccgactcttcctgtgctgaacatcagctgaaataacatgccgtattgatccagttcatgagtgagaagtttagtctacacaagccttttctgtcttgctctttgcagaaggattgcgtcagcctaaaaagcggatctttttgtctccatccgctgccacaaagctgttgacggaggctatctgcccaagttggctgccttctctagctcttatcagtaaacttatctgcctcattgtgacatatctacaacagttgcttagccttattcaatcagtattggaagacaagtggaatcatctttcttctcataggaaattttttgaatggaaacttgccctcttaaatatgtaccgccaaaatttagccctgctgtcccacgcaaaggctgtacatgacctggatatcgtcatggggcatgtcctaactataatcatcattttctcaagtggatgtacatgacagatctttgcagctgtgtgtgaagagagaagggaggagagctatatgttttgttttgttttgttttgtttgctctggagaatgttgggcatatcctgttgtcagcattccgtacatctcaggtggccgcccactagctctgtgtttctgggagcattctcctcactagagccctcgcgtgggactctggatcttgtgcttgagtcttgtctgtttccctggtttggaagattctcttttctgtcatagaaaactcacagaagttggagtccagccctggtatggggctctgggctcaagcctttctgatatttgctgttttacttaagaaaagtacttatttgatctcttcccttcccccggggcagccttgatttgttttaaatgaatcatcagtcgtctgtccaaatctcactgtatctcagcgtcttctaaagacagtagcccttagagttgatggcagtcttgggctgacattctacataagtgaaacaatttgagaaatataaaacatgatcaaaataagagcaagagaatatttttatgtcccctttacatcagtggctcgcacccttttctttttcccccagtcagccaggagatgttctctactcctttctggtgtgcggtgtaggagtctggtggcgggtagaaggagactactgaagttggaaaatgcttaataccccctttctttttggagaatcactgttctatgaatatatcctcaagggacttgctgcagagacacagtcagaatcacagagggtctgacacggtcagaatcacagagggtcattcatgactcagtagatgtttgttaagcacctgtccttggctcgggactgtgttaagaaccaagggcatataaagacagatgggaggagaccctggccggggagaggaagaagcatctacataggtactaagtaccattcgctgtaagtgtaagacaggaggtgctaagtaccacacaggggttacaaataaagaagtcctggagttcagaggaaggactgattgcttctcatagaggggattgtgtaggatttctgggtagttgtggaaccgccgcctcctcccacatgaaggagggccctgaggaccctggaaggttgggccggttgctcacaaatcaccctcctgtctcctcctcccagtgtctcttcagtgttttgccattcattctcaggctcaaaattacttctcttttgtccatttgtatccacttaagcaatttttaaaaataattaaactttttttattgtggtaaaatatatataacataaaatttgtcatgctaatcatttttaagtatacagttacacagtggtttgaagtacattcatagggttgtataaccattaccaccatctagttccagaatgtttcgtcatcccgaattgaaactctgtgcccgttcagcaataacgctcattcctcctccccctgcccagcccccagtaacctctctgctgctttctgtctctgtgaatttgctgattctaggtacctcctagaagtgagatcatgtagtatttgtcctttgcttcatccatgtcatggcatgtatccaaatttccttctttttaaaggttggataatgttccattgtatagactacattttgatccgttcatctgttgttggaaatctgggtttgaatcctgggctcttaaagcattgtgcagctgggcgcggtggctcacacctgtaatcccagcactttgggaggccaaggcgggcagatcacaaagtcgggagatcgagaccatcctggccaacacggtgaaaccccgtctctactaaaaatacaaaaaaaaaattagccaggcgtggtggcgggtgcctgaagttccagctactccggaggctgaggtgggagaatggcgtgaacccagaaggcggagcttgcagtgagccgagatcacaccactgcactccagcctgggcgacaaagtgagactctgtctcaaaaaacaaaacaaaaaaaaagcattgtgcatcgtggcttgtcattgtcagtgtcacctatgccctctgtttagacttgaacacccacgcacgactgggctgatgtgctcagctcttgaggtctgtgggctttggcttcagacccaggcactcatcctgttctcatgtggaactagggcaggacatttgactcctgtacagtttcctgatctttgagctgaaggcagtaacaaccccgtgcagtaaggactgtgacgaggacgcatttagccctgtgcgcagtcccgtagcacagcacctgacacacggcaagtgcttaagcacagtggctcctaacaaactcataactaagcccatttccccaaacatcttccttcccctttcctatcctatcctatcctatccgcttgagccctatcgtttgttccagattaatgtgcgaaagtgcgagccctgaggtcaggaggcacttctagtagccttgtctctgtccctggggcatgaaggatagctcattttcccagatgattctcatttgtcaaggaccagctcagctgtgccttctccatgcaaccctccctaagagcaaatgctccctgtcagaattcattttgcacttactgctactctgttatccactattttgtgtatacatttatgttatgtcttttaattccaagcccaatataagattcctgtcccaatataagatgaaagtgtcccaaaattctccttcagccttcctagttaagtcttaccaaggctgtcatagtatgaggtgctctcagcccctgtatttggaacagcctcggggagagagggcaccttgtcctgaaaccgtctctaccagtcctagtcatgggtccttgtacaggtcaactagctgaattagactttttctacagcaaatgtaatgctagctgggtaattatttcttagggtttcagcttacaaaggcaaatgttggttgttactgtaaaaagtgcatttaaaaatcagtttaaaaagctataaatagagtatgaggtttagttagataaatgtggacccataggacaaaatttctcctgttctaatatcattcaaatgtgttcttgtgacttgggagaattttttcactagtagcacatacatgacttcaaaaactgcttcaatttcaacaacttcagtggaagaggaaaatgtgaatgtatgccacagaaaaccattcgatgcctcaaaaagtggctgtagagatgccccaaaccctgtttgaagatgcatattcaaagaactcaaataacatattaatgaaatgtggtttatttgtttattttatttttattttttttgagacagagtctcgctctgtcgcccaggctggagtgcagtggcgcgatctcagcttactgcaagctccgcttcccaggttcacaccattctcctgcctcagcctcccaagtagctgggactacaggcgcctgccaccacgcctggctaattttttttttgtatttttagtagagatggagtttcaccgtgttagccaggatggtcttgatctcctgacctcgtgatctgcccgcctcggcctcccaaagtgctgggattacaggtgtgagccaccgcgcccggcctaatgaaatgtgaatttaaaacagtatttctaaagtaatttagttcttcatgtgatttaactggagatgtagtttaatgaatacagaaactgctataagatatttgaccctgcatcctaaaaatttatctgttcaaattcgacatattgtgtttgagatctctttattttggggggcatatatgatatttgtgaccaatgtgaatggttgaggtatggtcctcattttactggttaacagttcaaagctttgtgtctcactctttctctgataactttataaggggatgggcagggagtggtttaagtgtagaagtattcagctggacttgaatatttcaataagtcagattaataaaatcagggcatctgctttgtttcttctttttacatccttaggaaattcaattggtgatctataagatcactttaatgaaaattaagtgggtttaagatttattatacttaattgggaagaaaaagccacaaggcagtgggtgggaataactgactccctgtggaaccacttgcatgtttgttatgggatcccaaagttaccccaaatctttctcctgatgctcagagtgaggagatgggcccagagcagtgaccacagtcagggagatcagtgggatagggtttggacagcaacctctgctttcctctccagctgggagactggcatctcttttgagctgccgtacctccctctctctagggagagcctgactgctcttttggttcaaaagggaatggcttaagcaaatctaactttagggaatttgccaagccagggttaaggagcacgaatccaacaggtttggagtggtgctttgaaagagcagcaaatggcctggctgctgctctcttgttcctccctgaagcctgagctctgcccagctagtgaatgacaaagggggcgctttcagcctctgtaaatagcctattgtacaaggggaggaggcggggcacggaatggcagcatcttgccagcttgggttgctgcgttaaggaaagatgtcaggctttcttaatttgccactgcaggggcaagggtgtcatttatgtgggtttgtttgagggctgcattcctagtgaagtattccatcaaactgccattattcatcttgatgaaagcttgaggaactttagaaggagagaaacatccagaccacccggtttttggtttctaaatgacatgaagagaatacaatgttaatgtaagtaaaagtttgcagagttgcaggggcagtgtgtgtgtgtgtgtgtgtatgtttgtgtatgtgtatcttcaagagaatgatgtccttgtgagtcacctctggccctgagccactattttcatggtacaaataaaatggtgaagaggtgaacctttgtgtatagtgggccttgaactcaccacgtgttcagaggccagggtgatacaataaatgctaacgtttttgtaagacattgagcatttaggtggacctcaggagggagctgtcataatacctgggagtgtgagtactggaaggactttagaaacctgacctcatggttcctaacctgggttgggctaaaggagacttgtgatagttatgtgtgttctcaggggagagggtcagtggcttagcatagttaagaattattagcataggttggatttagagtcacattggttggtgtcccgttcttgactaacatcctggggaaggcttataagtctctggccttggtttcttcctcatcagtttgcttttgtgatgttcagataagacactggatatgaaagcctttccaaaacactaagtaaatgctaattgcatttttagttctatccaaagtttgggtagacgggtaccaggattttggtttctgacagtccgtgcagttcagtttccatcaccctgcctcgctatgcctgtctctgcccaggtctatttaaaggaatctcctgtgctggatctttacactgggcttgtgcccagatttccttggccattgttaccttccccatccttctgtggttttagactccaggtttacagaaaacccagctgagcaaacccactttctgtaagagtggggaggagggtgcacaggagtggctgtagaggaaggagaagctggctgtcagtagccttatgtgttcccagctgggaaatactggctccttaagcctttaagccaattgaattatatttttggcaaacagcggcatgatttacatgcccaggctataaatttccttagatgtttatatggaaatttgattttgaaagaataaagaaatattcaaaccagaacactactggaataagaatacaatctgtctgagttttaccatttgttagcaagtgtatgagtcttagtccttcttagagaccccttagtctaatgcttatgttcacatacagcgttgaaagactatttcttgtgcctgattttctttggatgtaggtgtacctccatttttaaataccccaagtgccttttccttaatagcagttaatagaagggaaaagatttataatgctatcagtgtctgtttaagagttgttcttcacacatatctaaatgagctattgtcttagttctttatgcatagactatagttttcctatgtatagcattaatcagtttgttcagtgaagttggcttgcagcttgttacctggctgccatttaagaggcatgaattaaactgctatagtttgtcattatcacccactaaatataggaatttggctggattcaaacccttagtattatagattagtatctaatgaaatgttcttgtacacatgctactaaatatataattttctgaagttttttttttaaagtgttctttcttagatttaataaactttcttggtgtaaagcagtctatagcatggctactgctgatgcttaaaatagacaaattaatcccctgtgtctgactgtatttgtttacagaggaattatttaagattctcactcagggatgtgatcctgttgaacagcacctgcaaattcacacaatctaggttttatgggagttactctaggagctttggggagagaagagagaaaggcatggcagtgtgtgtcggggtgagtacttcctattcaggcctggagtgctgcagggtgatgaagacaactagaggtggaaggatttgagggcaaggcaagtttgcacattatattcccaaggctgctttgaggttgtggagttgcaatactgtttctgaaatctgaacactcagtgtcaataggacatggacttgatttgtctgcttatcccgcctggtgtacatcccttcctcagaaaggccttcccccgtgccttgcagaccttgcttgtttgatttttatcttccctgctagaaggttagcccactgaaagcctagaccaggtcatcaacactgtcttcccagcgcctggccaaagcctggctcacactaggtgctcagatatgcagtgacgggagtagctcaattcctatgtattcgtctagaataaatctgctgtcagcatgctctgggcaatctgtttctttcttggtatgccttaccttggttagacataccacccggcatcctatccttcatttcagtggtttaaaaaatatatgcccgttgtctcttattgggaagctgagcagaaagaaaacagtgtctgttttcagaaccggtcctggcagcaacactcactgatgcctgtccctgcccatgggtggagcagtggggtgactttgctgctggctgcccattggcctatcctccaccctctgctctcctgagaagtcaagtgtggattttgtctgctagttacctttagcccagtgggcagcagcgtggggctcggcatgtgacttgtgccctgagagaccttggtaggctgggggagcgcagctgagccctgctaacccccgcccacttccaggctcattgccctcttctgtgtctgcagtggggtgtcacctagtagtcagctgttggtggcacagatggtgagtggttttgttaagtgctggtgccttctttccagaaccatggcctgaagaaatctgcttatctgttctttctttgctgtcatggtaaaccttgaaatttcgtgtgtgtgtttgtgtgtgtgtgtgtgagtgagtacacttacatggattcattgtagcagagattgaatgagcagagcaaatacattatgttggttctggtagtattaatggcctgtaaaacagagaccattaaatttaaaattaatttcatttaaatttaaattttagcagaaaatttctgtattttaacaaagaaaaagagatgcaaatcaaaaccacaatgcatttctctgatgaccagtgatgatgagcattttttcacgtgtctgttggtggcataaatgtcttcttttgagaagtgtctgttcatatcctttgcccacttgtttgttgtttttcttgtaaatttttgttttttttcttgtaaatttgtttgggttctttgtagattctggatattagccctttgtcagatggacagattgcaaaaattttctcccattctgtaggttgcctgttcactctgatggtagtttcttttgctgtgcagaagcttcttaattttgtctgaacactccttgtaggcagtgtttttacctgcgtgctttacttgttctgcactcaggatgaatcacagagcgttggtagaggaaataatcataaaatctaatatttttgagcactttctaacgtgtgtgagatcattcttacctctttatgtgagtcatttagcagtcagaaaagccctgcgagataaggtgctatttccgtctccatttacagatgaggaaactgaggcacagggaagggaggtcatatgtcccaaatcatacagctcatatgccagggaggcagaatttggctctagcatctagggtctttttttttttttttcttttttgagacggggtctcactttgttgcccagattggagtgcagtggcacgatcccggctcactgcaaccctctgcctcctggattcaggcgattctcctgcctcaccctcctgagtagctgggattacaggtgtccaccaccacacctggctaatttttgtattttttgaagagatggagtttcaccgtgttagccaggctgatctcaaactcttgacctcaggtgatccacccgcctcggcttcccaaagtgctgggattacaggcatgagccaccgcgtccggctgcatctaggatctcaaatactattctgtactttctttccaacactgtgctgtattccctctttagatatctggtggttggtttaaagtttatgcacaccaatttatctgtttgtttcttttggctataatgtcttggggagtgtaaaagaaactcatcttaccagatagccaactatgggtttcccagcatttatattgccactgttgtcgtgtgaggagtacagaaggtgaaatttacattggtgtgtttaaccagtttgggaacttgttctgagatctgttggaagaaatagaaactgatggcccttaggtggtttgggcttgtacttccccttcactcatattcccattagccttgacaatgagagtcgagtgtttttgattaggtggatggacgagagcagagacgtagtagcaaagaagaaaatagaaacttaaatctacttatttgagtttttatgggaagaattcttcttgagtaaaatctttttaatatggttaatgaaaggaagagaatggggttttttcaatacaaggtaatggagaaatagaatgaaaatgaaatcctaaagtgtttttagaaaaatgacacttgacagccaggaaaagccccggatcattagattgtgggtttaatgcctggactggccgagcagctacccaattagatggctggccggtggaattttggagttctggagaggggtcctgcttccctggaacgaacgtgacatttttctctcccaacagaattcagcttagagaactatcaacacaggacaatgcaagcccatgagctgttccggtattttcgaatgccagagctggttgacttccgacagtacgtgcgtactcttccgaccaacacgcttatgggcttcggagcttttgcagcactcaccaccttctggtacgccacgagacccaaacccctgaagccgccatgcgacctctccatgcagtcagtggaagtggcggtgagtggagggcccagcctgcctcgtgcgttttctccgcatttccccagatgagctgagccctgttgaatgtgatagccatcaagatcaaatatttgtttataactgcactttgtaaatggaaatgtgccaaattactgatggtggtaaatagaggtacagggcaaaatataggcacagggacagatgagagggtgtcggttgggtgtctacctctcgtcacatggaagatcattctagaaatgacattgagtttctacgctgtggtaggcactgtggtcagcctggaggattccataaggaaaaatatagcacagaacccctgttctcacagggattagattctggcaggaatgagagttttcaaacaaatgttaccaaaagaatgcactcgtggtacatctgacgcttagaacatatccctagcctgttggaagggactttgggatttcaaatagaatagggctggagtaagaacttgacggaagaacacggctgcagaattcggggcaggacatgaagaaacaaccctcaagaggcgcgtctggctgggctgctgagcgccgtggttgtgtgtgacttgggcaaactggaggctgtgctctcatgttaggaaaatgaaactggaatgcgggcaattagggcttaataggagggatggcgtaaggaaaccttaggatcctttcaggaagattcttagtgctcctgctctccctgccttccctagtgagaaaggcagggtgtggagaagatgaagaggccgcatgctcactggtgcttccactcctcacctgttctttggttttctctgtggtcgcttgctttcccctacccaagtcagtcacccttcagtgtttcccgcattcagcagatatgcagaagaacattgtgaaacacaagatccccccatttactgcttccagatgtaagagatggaaggcctcccccacccccccgggctgactgccgcagagggagtgtgtgcccttccacataaagccctggctggagtcagcatttttgttatttatgggattctaggtctttgttttattttagacaagttcttggattcattaatgtgaaactcttaaaatatataaaagattcttcagtctaattcatgccaaaatataaatatagaatgactgaactacagctgagaaaagttaactttctacttgatttctatttagaaggtcagggtaccttaatatttcacctcagctaatcacataggctggggaatgagtggaatctcccttttcctaagggattcctgtgaggttctggcattccttctctactggcagagcacctgatgtgtcacggcagcgctgccatctccatgaagagttgttggcaagtgcagtgttaagacatgtataacttagcagtaactgtaagaaatgagtaattcctattatatgagaaattgtgggggcacttacgtgtggttttaaagctttagcttagcataaaggcattgtgccttgttaaaataattacatatgttctctctagaacagtttaaaacttgagatatgcagcaagaaatgaaaatctataattttactgcccagtatagaggcttcctgatttttctctgtttatagacattgatttagctctgattttcagaatttgtggggcttagaaatagatactgagcttgctttgcctttttaaaaaagaagttaaaagtttaaatttaaaagtagctctggaattctggtgcttaataattacagatgctttgatatagctagcatcatcctgtggacacctagggcagggaaagaggaacttgattcacttcataaggtaccggtgaagagcctgtgcatctggcactgctgcggggggctggtggccggagtggaatattgttgctgtgttcctactttgaaaacaagtaagcagggtttgccagttcccaccctcattctgcacccccatctcacatgcacagtttttatcaccctccttgtccaataaagtttacacggatactaaaatgagaagaatccgcactttttggtttggccacttctcatcacaacccacgctggctgtttcccagctactgatttttaaggcagtagcacagaggttctttgtaaattataccttctgaaatttccttttaaaaatcaggattgtagagctgggtgcagtggcacatgctgtaatccctgcactttgggaggccgaggtgagaggattgcttgaggccaggagtttgagaccagcatgggcaacatagcaaggcctcatctctataaatttttttattttaattagttgggtgtggtggctcatggctgtagtcccagctactcgggagactgaagtggacgaatcatttgaacccaggagttggacactgcagtgagctatgactgtgccactgcactccagcctgggcaacagagcgagaccttgtccctaagaaaaataaaaatcagggttgtaaagaggaggttaacactcatgctggtcacctctaatgaagacctaaattagagaacaggacagacaagctgggttaggaacagaatccaaaaagtgtttcttaagtgttggagcccggactgatcagggccctgtctggagaaccacgtccttgtgtctgtagtggcagctcacagtcataactgtgatgccctgcgtgccaaggaagagcttctatcttctgaaggattttgctgctgctgctctgtgactttgagcaatggatagaagcagattttgtgggtttgctttctttttacatcactgtcacagataatgcaagatttctggtgttagccagtgttccggtttagcctggctacatgttttagcctcttctctgagattgaagccccatggccccctagtgaaaacgatcttcactggagtgactggaaaccttttcggattggtcggagcccagacacacgtggttgcagttaagcaaagtacaggagcatgttggagcggaaagggaccagggaaaagagggatggggcagatgtgggactggactccaacttagaccaggcaaccttgggcaagttcaccaggattttctgaccttcagattcctcatatggaaaaccgaagtgacagtacctttcctccttcagtgttgctaagaggactgaagagttatgcaatgtctgcttggcccacaataagtatgcagcaatgttacttttttccctttgtcttttaatcttcatattttatacacaagaaaactgagtccaaagaggtaaaattatatcatacagttagtagaaggtccagaactctgttatgctgccttcattatagtagtagaaagttgtatattataactagggctttggggaagggggcagtaaaccaggatagaaagtttggatctgtccagatcaatatgaagagtcagtggcttgagcctctaaacccaggagcaggcttgtttgtttgtttatttatttagagacagggtctcgctctgttgcccaggctggagtgcagtggtgtggtcatagctcactacagcctcaaactcctgggctcaagctgttctctcacctctaactccagagtagctaagactataggcatgcaccaccatgcctggctaattaaaaaaaatttttttagagatgaggtcttgctgtgttgcccaggctggtctcaaactcctgggctcaaacaatcctcccaccttggcctcccaaagtgctgggattacaggtgtgagccacagcacctggcctagagcaggatcttttgaaaatggatatgcaggcaaatgagtctaaaggtagtgatggaaatggaaggagcaaaagggacaggtaaaataaaaacagagtctaagttctgttgggtataggatcagaaattgtcaagaatcgggtagtgggctgggcacagtggctgacgcctgtaatcctagcactttgggaggccaaggtggatggatcacctgaggttaggagttcaagacctgcctgaccaatatagtgaaaccccgtctctactagaaatacaaaaattagccaggcgtggtggcgtgtgcctgtaatcccagctactcgggaggctgagacgggaattgcttgaacctgggaggcggaggttgcagtgacccgagattgcaccaccgcactccagcgggggcaacagagcgagactccatctcaaaaaaaaaaaaaaaaaaaagaatcaggtaatggagaggactggcatgaagggggcacaggactgtgaaaacctgagtgactctgtccttccctcatcctctatccctgaaccaggtcagacatagatggaatcagagcaggagttggtgttgatgtggtttcaggtccacctatcagagtttgagagatttaggccatgaaccattatgaatatagatgagaacctttgtaattgctgaaggaggtagtagtgcaggcaagtcctgtgtgcaagacctgctgctcccagttagtacggacccctgtgacattcacagaagttcagaatgtctgagatgctctgcaggctaccttatctccgtctgcagctacacctccagtgatcacaatcagtgctacgctggcacagccagcctggccctgctctggattggaggcatcctcaagggctgcttgctgtggaagcagtttcgctggaccgagaggagccactggaattttgggtactgggccttagggtcacccgggaatgggaatggctgctgtgtggccctgtttgccagagggggccattggtgatgagccccatgcaagtggcatctgcccttcacctgctccttctaagccagcgggatggagaccctccagagagaatatgtgagttcctctccttatgagagccgtggtatgggcattgagatgactgacttgtcaaattagttcggaaagatttttgacaactactacaagatcataatgtacttgaacaaaaacctgtgatatgtgttatttgtttgtttttagatattggagaagggaataaattttagcaagtaaaaacttttttatgccttcacgtcttttctaagacttaattttaagaatatcagaacctggattaaggtttacttctggtgactaacccagttagtctatcacagattcactgtttagattgttatcagaccttggttccagcatgggttcatatcttacaatacacagaaccagttccttgggtataactgatctcgtttcctagttggatgactaaattccacaccaaacgatctcttgacctccaggtcacatgctggccggtggcccttttgcatgagagattgaaatttgtacatccatatgttagcatatatatggttagcgacttgctttagcattttaatcctatgcttcataaagcctgccacagaggatgtggcgctttgggtttcattctccacaagtcacagagaatagttatcagatctatattcactcagcaaggacttgagtttttctggcatgatgtgcacagtaccagggcagagaaggctgctgccctcagggagctccaggccagcaggaagtaccgctcggaccccttgtccttggcagagggtgagagccatcttgagactagagcagtcaatgcaagtgacttgttttcatgccatagaactacagctgtgggttcattctcaggtaaggatttggaagaagcaaactaaaggcaacatatccaggctgtgggagccacgctcaatcaacagcatggtttacaactcaaaagtcacactccaccagaggccttctcagtgtcatggcctgcatgaacaaaccacagacctccagctcacatgcacactgcaacaaggactggcatccttcatccatgtttagagggtgtatatggagcatattaccaagtaggatttccccgtgtggctggtggaatccctcatttccacgtaaccatacttcacacatgtacgcatgtaaaggcccacttgcaaactaggagaaataatttttgcaggagaagagagcagctcgttgattcataagtttttatgaagactcacaccagacttgtggaggtaaagcaagtgtgggcctatagggatcatgccagtggaaacgctaagggcggcgagacacccttctggacttgagtggctggggcccgctgtgagcgggagctgttgttgatctgggcaggattacacgtgtctgtgaggcagacatttagagacaagccttagtggaaactgccaggagtgggcaggaagggagctgtccaggaagggcagctggggttgagttggatggtggtgtcactcgccctcactgacaccagcctgatgggtctgaagaaggtctgtcacagtcagttgcaaggcagggcaatagatgaatgattttgaaccaggtgggaggtatcaggtgaacgctgagaggcagggacaagtattaggaacagtagtagcatctggttgtttctgcagtcatttgtaaatatgacctaataaatactgtttctacagtcatttgtaaatgtaaacctaattctcatctctgggaagctttggaacagaaatcagttatccgatgtgtatttaactagaagcctgtgtgagacttcagaagaatctcctgatccaatgctctggttacatccctatccttcatccttatggaaatctgggatgtttttaggcattaacttccatttattaccatatgtgattgcagattccgggtcagtgttccccatggcctgttattccatggtcttgatagcaacataattgtgcaaatggtcaaatgaagatgggagcaaagatttccccttttaattctacccctagcaactttgctgacgttgtgctcagagaattcctgaaaagtattccagcatttgaggacatttgcggcaagcgatcctggcagttggggcagtggggtggtgtattagtcagggttctctagagggacagagctaataggatggatatataggagtttattaaggagcattaactcacaccatcaaaaggacccaaagtaggccatctgcaaactgaggagcaagaaagccagtccgagtcccaacgctgaaggacttggagtctgatgttcgagggcaggaagcatccagcacgggagaaagatgtaggctgggaggctaagccagtctagtcttttcaaattcctctgcctgcttttaattttggccatgctggcagctgattagattgtgcccacccagattaagggtgggtctgcctttcccagcccactgactcaaatgttaatctcctttggcaacaccctcaacagacacatccaggatcaatacttcatatccttcgatctaatcaagttgacactcagtattaaccagcatagctgggatggagagactatgcttagagggggtgtttttatttagaaatgttattctggcagggtgcaaacatcagcattttcatgccttgaggtaacttcagcaccttttctaaaacttaatgagcttcttaataacaagttatgaaaaaccttgctaaattacattttcttacaaatctacattacaggaaacaattgagttgctttctaagagactgtaagacctgtctgctgacttagggacgcttttaggtggctgaattaggtgggaaaagtgttagagctggtaatgagcagtggtggttgggtggggtggcctgcagggtgagaactgaaggcagagtttctgatctttatgccaagaccaggccacaggagtattaagtgcctggcttaggaatttaaagaaagaaagaggttgattgttatatttaaaaaactatttccgggctctctttacccaggaagaaaaagctaaaggtcactacagatacgtagggaatatgataaagcaggtctgaaaacacaatttgattttgtacaaatgatgtcgcttctcacaggcttcattaaacagagaacgtgtttgatgacagaaacgcataaaggacggaaatgcgtgctgtaatatttacttatgtttaaaaatagccagatggaaccaactggtgccaaatgaaaaatgaccagcgtaggctgtgtttcttgacaaaacaccttcagcacccattgtccaaaagctgaccaaaggtagtagatgggaatgtggctccctttgaactaggcagaagtgaagcagatgccttgtatattcaaatggttggcatgtaaatttctacgggcagtcctattttctggaacaatgtgtatttgtaggaatttggacattgtgacttcaaattttcttccctttcattgaggcgggtttgtggtcagctgattttttttctggtgatgagatgttttgcgaagtaccgtgtcagcctcctacccctacccccgtccctcttcagcaaatcctctgggatagtggggagccgggaagttggaaactggagatggactaggaatgaaaagaaaaaaggttctgagggttaggagcaagtgttgaaaaatcagaaaacccagccaggcacaggtgacctggaccccgcctcctcaaggatgaaggatgtctccacacacagacgaaggaggtgtgggcatgtttgggacctgcctgtgaaccgccaagcaaaccttgacgtacctggatgtctcattgagctaggttcgaagctctgctccactatgtggtggacatgggactgagaagggaagcagcccccccaagtctgagcttcctcatctggagaggggctggcctttagcaggctccatacacattcactcacctcccatctttcctgcatgccagtgtcaggatagttctgcccttctgtgctcagctgggaggaaaggatcttgggaagtcagctagttcagtagtgagtacgaatagtgagcgtgaggcctcattgttaccttgtgacatttacagttcactgtattggggggaatctgggaattttaaaaatatctgtccattgtcatttagaaattattgtggagggggagttgcccaggggctggcctttaaaagacctagtgtaatatatcaaagatgtagtctgctagatatgagaattgatggccagagttcctctctgaaaggtcactggatggaaaagtagttttgtgtctttacaaaaagaagcacatgatggagttctgagcaggctaagatgcgtgtaaaatgtaaatgctgagaaggacgcggttggcgctctgtatccgtggattaaaaatattccatggaaataaatggatggtattgtctattgaacattgccagacattttttccttgtcattattccctgaacaatacggtataacagctacttatttacatcatattaggtattgtgagtaatatagagaccatttagagtatacagaaagatgtgcataggttatatgcaaatactatgccattttatatcagggacttgagcatctggatttgggtatcctgaaggggaacagctgtatagaccacatgttaggtattagaaggaacaaaaaggaatcatttttacccccggactgtggttctacatgctcctttgcaccctagagatggatcccgcattagaacccagccacgtctttggcagtctctttagaagttacttggctctgcctctcccccttctactccttgccctcctctctctcactctcccttctcactttcgccctgcgtccacctccctatccctctcctgcataaacagtagcaacacaaggggcatttaactgctatggctggcagatgcccatttggagatggagatgaatgagtctatgagtggtaaagcttgggcttctctacccctaagaaatcctcaacggcatcatttgcttttgcacttaaataggagagtggcacaaaataactggccatcgcgttcctgttagtcaaatattggtgagagttctggcctcggaaacctttgatatgcagatgttcacggttttcctgcccttcctgcccccaagggggacttgaacttgtttcctaattcagcccttgtggggagactgacctcaggaggaacctgagcttgtagagatgttgcggaatatactcatgaccaccgatttcactgtagtgggtttgactcactatcttttttttttttttttttaactgggaacactatgtaaccacattaaagaggtctatagcaggaggaataaaagactcctaaagcctgctgactcactggctcatgactgatttcctacacattcagctggggttgtctgctttgcttgccctgtttcttgagcccaagcgacccacacacactgcctgctgatcagtaggttatgtcagaaggccgtaagggccaaatttaagctatttttcatttaaataggcgtccctagaaatagctacgtggacttacctaatatagtatttaagtccccagcttttgaagtgattctgtcttgtaaaacctacaagcatttcagactccaattgttacagctttgcttcccagcactcagcttgcaaccccttgcttgtgtagatataactaaggttgctaacacccttttttaaatatagcatttctgttcaaaaaatagcaacactgggccaggcgcagtggctcacacctgtcatcccaatactttgggaggcctaggcggaaggatcccttgagcccaggagtttgagaccagcctgggcaacatagtgagaccttgcctctacaaataataaacagattagccaagcaaggtggcacgtgtctgtggtttcagctactcaggaggctaagtgcgaggattgcttgagctcagtcagacggttgagacggcagtgagctctgataatgccactgaactctagcctgggcgacagagcctgcccctgtttcgggaaaaaaaaataattcattattagaatgtgtggtcttttcatagagccacagattttgaagcacagatcctaatgttttgtgcccttccccttcttattcaaccccctttcttgaaattacagttatgtctgacaactgagtgacagtgtgaccttttatcccgtatcatcgagccttcaattagtgtctccttttgacagatgtctcatttactgcttcattttcaagcttttctcattattctaattgctaattagggtaataataaatatcttgccccaggttacatgtcaagatgttgctttattggggatatcattcacttctttaactttgatttagcttgtttgcctccatgtttctcggattccagaagattatacaccaccaaaaacttaaacctaactaaaaaattatttagctaaaagtttgttataaaatggtcctccagagcagtggttctcaaaataaaatttgggacattgaccaaggtggttgacctgtcttgaagggatatggtctctgtatgtccaaagctaaacttcatctcttttctgaagcctacccccagtacccagtcttctatttgattaaaggggacagtttttcttctcagccctccttctttctgcttacaccccattacctgttaaatcctgttcctgagtgctgcagcacgcccagtgccttggtccttcccggctcccaactcccactgccctatccaggtctgtaggagttggtttctccccagtctcttccctccctcctgttccacacactgcttacgcttcttgtagatttctttctaacccattagcccatcctcaccacttccctgctgaaaacttccctgctggaaacctgctgtccctaggaaggtgcttctcaaactttagcatcccctggagggcttcttaaagcacagattgctggatcgcatccccagagtttcggattcagcaggtctggtgtgatttgctttcctaaccagtgccaggtgttccgcagagcacactttgagaagcttggctctagaatgagcctgtgcacctgagatttcaggcttgcttctgtctgttcatcctgactctccctgcactcttctgctcagccagggttccctggagtccctgtggtcacttagagacaagacgtgggctccttcagaacaagcttgtgtcttgttcaccttatccccatctgcccattcacagctaggggaactcctctgcagagtgcagaaagtggtgttgcttttgaagagagagcactgaaaaagaccatgaatgcatttctgttgtgtcaagaggtatagaaggcacctttgtaagcagagcatcgtgaggacctccctgtgggcggccaggccacctgcatgtctaggccatgctgagacaaccacacttcaccatcatacttggtacttttcttatctcttttcacacccactcattcttcctgttttctctcattttgtcctttccccctttctcttcctaccttagccttggtgccttcggtgtgtttggtggcttcatgggttgaaaaggcttctgatattcactacaaagccacaaaattgcttctgaatttcaggctatttgttggagtcaagactgaggtgatggaggacttgtactgtagttagagcatgttatcgggtgcacaagtaatattctacacaatcatattttacaggaaagttcctctttaacaaaaaataaccctggaagtggactcatgatgtctccattttacagaaaagaaaacagactcagcgattaagtaacaataatgcgtgacactaagcaaagatattctcccattcttatgcacacagagaataacgtttttgcttcataaagtagtgtgctgtagttagtaagcatgtttggaatcacagccataggtgttagaaagtttctgccgagagagaagacattgtgatgattaaaagatatggttaggtcatatttactccagaaaactattagcagtttgggatcaagagtgaaatacacacatgtagcacacagtagatattgacagaatgtctataaatgtataagcataaaaaaaagactgggaggaatttaccaaactactaatagtcatcatttttccttgatatacttctgtatcacttaaatgtttttaaacagtatatacattataacttaagggtggacaaaaagcaaaagagcttgtaggaagagaaatggataatcctaataaaaatagaagagtccatggaaacagatcaggcagtcatccccttctaaagggtctccctgtgagttcatcccctggcacccatccacttcctcctcagcgcggccctcctcagcctgccgccctactctgagacctagcttttccacacttctttttggtgtctcctgttttgtttcatcacaccttaagccagaaacgatctcttccacttttggacagctctctcctcttggtaccagaggttatcatatcacagtctaatttctccaagggtttccagactgttgtaaaagtgaaggcccctctctgaaattaaaaaaaaaaaaaaaggtaggctctaacgtcatagtcactgagcttttatttatcagtctctaaagactgctttttggctttctgtggatgtctggatgccttacagtgtcctttggccccagaggactcagcagctcacattggagacctgctacctgtaaagactactgctgctactgtgggaggctaggccctgccgccttatccatcattaggagttcttgcacatagcaaatatactcaggaagctaacagatgaagacgacttagagaaaggtgcacagcgatgtcaaatctgcacacctataaatgttgcacctaaaactaataaagacctgtgtctgcacatgcatatgttttgtagctgatgattttaactgttagagatgctatgcaagaaagtgaagtttctaacagatgatattgcgcttggtgaggagataaaatagtggaaatagtctcaaaaagaatataggtaacattttagaagtataaccaaatggggtttcatttccaccagagctgaacaggatcagtcctctgtgctgtggatggcagtggcttgagaactgtcaatgtgtgtagtggtggcagtttgtggctcttctcttgctctctttggccttatccggcaggaccagcacttgtaggtctgtaaacctgttttctctcttcaggcatctttctgacttagccgtggttccccgaagcctgtgtttacctccaggcgaatgattggtttacatcagcacatcttgcactgcagtctttcagcactcactcactgggcagctgttccgcaggtggccgcctagaggggtgcggataccacaggggcatattagactttatatttaatttttaagcattttattttttaatggacaaatacaaattatgtgtatttatggtgtataataggaacgagttcaggacatctatttttaataaaaatggtgaccatgttcactattagttggtgactgtagttaataacaatgtaccatatacctgaaattactaagagaatagattttaagtgttctcactacagataagtgacaagaatgtaaaggaatggatatgttaattagcttgatttagccattccacagtgcatagatgtttcactgccttctaacctgcccccctttcttttttgatagggtagtggtggtgcacgaagatccgcactacttgacagcgacgagcccttggtgtatttctatgatgatgtcacaacattatacgaaggtttccagaggggaatacaggtgtcaagtaagcattttcctgcatttgcgtggctcccgctcgccgtgtttcatgaagaacgagtggcctttcagaaatgcacatttgctcctatctttcgcctccttaggatcgctcaggcccctctgtgtccactgtaactttcccagagtcggtcccaaagctcactggaccctctagatgttccctgtggccctgggggctccatggtcaaatatgtgagtgtcacatcctgtattttatggtgagtcacatgttacaccagtgcacaataggctctgacgtttcctgcaataaagaggtctgttgaactgggcccaatccggcatttttcatgcttacttgaccatgagacccatattttgagaaagaaatactgacatcccaggatggcagtgttctgttaaagatacttgggaaatgttggctcatgggattacccttaattattaactgtagtgtaagaaaccctgtgatatccagcatacctcctttccagcctctgtccctcccaggcctcctgtatagggccctcaggtcatactgaacttcctgcagagccacgactacctctgctctctcccagccctgaggctttgtgcagttctattttgctttttagaaatggggtcttgctatgttgcccaggctggactcaaacttctgacctcaagtgagtctcctgcctcagcctcccaaagcactgggactacaggtgtgagccaccatgcccagacttgtgcacttttttttttctttggacggagttttgctcttgttgcccaggctggagtgcaatggcatgatcttggctcaccgcagcctacacctcctgggttcaagtgattctcctgcctcagcctcctgagtagctgggattacaggcatgcaccaccacgcccagctaattttgtattttttaatagagatggggtttctccatgttggtcaggctggtctcaaactcctaatctcaggtgatccacccacctcggcctcccaaagtgctggaattacaggcgcgagtcaccatgcccggccatgcacttttttttcttgatcataaagcctctttctacccccagcctgggtgcttgatgtattctttaatcttacaaaactcactgcatttcaccttttctctaaaaccttcctagtctatcattttcatcccctacctctgagtgaagcatttcttcccttttccctcccagcatgttatattccttctgcataactcctgatggcacagaggtgttcacctggcattctgcccccctagcccgagctccttgagaacagggtggttatcagtcatctcttttcacagcactgacagtgcctggcacacagtgagcgccccactaatgcatcctcagtgaaggagggagtacctctggtttctccacccctctttctattttagccacttcatttttgcttataccaggtacttgtctaaaaatggtcttggaatctgtgctttgttatttaaatcctctgatgcttagcttttatttgggccactgctagctacattgtaatctttttacggtcaggaaccatgtggtattgctggctctatccctcatgataggttgcatgtaatatgcactcaagaagtgcctattggccgggcatggtggctcacacctgtaatcccagcactttgggaggccaaggcgggcaggtcacgaggtcaggagttcgagaccagcctgaccaacatggtgaaactccgtctctactaaaaatacaaaagttagctgggcatggtggtgcatgtctgtaacccccgctactcaggaggctgaggcaggagaatcgcttgaaccggagaggtggaggttgcagtgagccaggattgcaccattgtactccagcctgggtgacacagcgagactccgtctcaaaaaaaaaaaaaaaaaaagaaagtgcctattgttttttacttgacactggtaacattggatgtctcagcttggcgagtttgtcccagtgttcccatagcacgtgcattaagccctattacaaaggaaaagcaagcttacttgtgtattatttaatttatgaacattctcaaagttggtgtcaaggtcagggtttgtctgtgatagtaaatatccatcaggtggatcagcctaacatatggcacatgaaacagtgtgtgtgtgtgtgtgtgtgtgtgtgtgtgtgtgtgtgtgctttgccaccaccacagagcacatatacggtaagtcctcagttaatgtctttgatgggttcttggaaactgtaacttgaaaaccactataatgaaaccagtttttcccataggctaattgatacgaacaggagttacattcccacagcgtatttctagtcacaaaaacatcaccaaacttctaaataaagaccacgcttcttatgttaaacatgaaataaatgtgagcgatacagacatttaggaacaattgataaaaataagatatttacctgtttattccagttaagggtcgtgggcggctggagcccatctgggcagctcaggatgtcaggtgggaactgccctggccaggacaccctcccatcgtagggagactcatactcacacccactcacactcacacactcactccgctcacccacactcactaggaccgtagagatgcaccagttcacctcacaggcacagctttgggatgtgggaggaacccagagttcccaggaaaaaccacatagatgtgaggagaacgtgcaaatgaaatgccgttatttgaggacctgctgtatacatgtaaatgtatatacattcatcgaggagcatggtgacttactttatgcttttgactctcctctgatctgaagacaagtcacataacttttctttggtcgcttgctccccctggaaaatgaaagtccttttatggatgtgtcagagaaggtgaaggaaagtatgtccagtcttcttgatctgtactcattgaagggagctgctttgcaggtctcgatttgcttccttcccccccccccccccgcccccgcccaggaggatctttttattctaagctttgattttcttaggctactgtagaattaaactgaaacaaaagagcaagacccagcacttggataaggggtcagaagtttgttgaatgatagaagcagcccgcctagagtttttaaacctagtactttaaaactgcaccaaggaagccatttataaagattgagctccctgcttctcagtggctctcatctctagctgcacttttgtgccatcggggagcttctaaaaaatactgaggcccaggccccatccctattcaactgaataaaaaattctagagcctgggtatagtagaacctggtatagtatcaagttcccctggtgagcctgcagcttaacggctagttctggagctggagctggcatatgttttctgtaaaaagcctggtagtaaatatttttggctttggtgccatatggtcttggttgcaactactcaactgcagcctcacacagaacaaaaatgaatgagtgtggctgtgtgccactatcactgtgtctacaaaaacagccagtgggcctgatttggcccttggctgcagtgcgcccgtctctgtttttgaggaataaaatcgcatcatttcatatggctaatgcaatttttttcccatctggaagcaacatctgattggactcatcttgtatggtgcttgttacagtctctgtaaatgggagagggtccgagaatagctcttcctgttttcatcaggactgtttttagggatggcaaagaagtcagtgtgtccagcctgtgtcctcctcagccacgtggctgattcctgaatctgcatgtgcagcacactgccgttgtctggggcatgatctgtgtgatggggccagccctgccttccatcctacttccttaggtcctcatgtcaaatcagagcctcctcacgaacactcagacctaatatgctaaagccagatgcactatggtccccttttgcttctttgaaacctgaataggaatcgggaaacatctcggtatttcctaacttttgcttcccagataccgcttcacgtcacctcattttgcatcttttctttgtttttgtttttctgcaatcatgacttcacccatgtaactaggattccaggtaattcttgatacctttggtcatcaaaatttggacacataaagaattatattttcctttccgtattctgaattagaatgctttagacttcttgaaaagttttgatgaatacctcttctgaaaaggtatctgtttaccactacagcaggttctctttaccactcatctgctgactcctggtctaaaccagtagggtgttaaagaggaatcacaaattaagtgcccttaagagttggatattgccttttctcccctctgtccccctctcctgccccacttaaacaaaacagaaataaacaagcaaagaaaaaatcagaccaaaactgagggagaaaacatttccaatctgaagccaccatttcttatctgaggactaaagtagagtctagctgatgtttagtattagagtgcggttgggatacaaattaaaatctaggaatatttatgtacgttcagcccatctgttgttttttctctttttttagataatggcccttgtttaggctctcggaaaccagaccaaccctatgaatggctttcatataaacaggtgagtttgtatgagacaggctctgtggactcctcttgcaagcaggggtgcttctgtatgtgcattcttggagccggaaggtttctccagagtgtatgtgctggaccagctcagagccttgccgtaagcatggggcatccaaggagaaacttgacacaaaggtttggggagaacaagttaaggaatttaacaggtggttcaaagcattgtatttcaaagctgatgtggatacattgtgaagtcaagtataatttttaagataaaattctagaaactctcccggtccccctggcggcatagcattatttctctccacttgaggggtactagaaaaactcagaagctggaacgtgggaatacatcttcatttcacagatgaggaggacctgtctcaggaaaagaggtgactcacccaaggttatagctggttagtggcagaaccaggaccagaagcaaggcctgcagcctcttgtgtaggctttcctagtgcatgctgctgaccctcaaagctgtccttggccaactcaccacctgtgtgacacttacccccaggcagctgtagggaggaacacagatgttcggggaaggcacttgtgttactgtataagcacaaaggaagctgggatctgagtatggtggcccttgtcggtctctagtccccacccatcaacggctacagctgttgaaacagcggctcatgagtggcagtagcagtgcaggaagacgttgctgtttatttttatttttatcatgattacaatgaatgtgggtgccacagctcttccccagtccacacggcaccccggaacaggcacgtgctccagacaggccagctctgctgcctgctgcttccacacagctgtccaggaaaggctcccgtccctggccccccttctcctgctctcggggcaggtaatcatgcggattcatgaatacaaatgcacttcctccttctgggttttgtgtgaagggcagcttaggagctggtgtatttggggtgcgtctgtggaagggatcgttctctgcagcctcggagccacactcctgcagtagtgcttgttggttcttctcagactgaagtgcatgatttctccccgtccgtcctctggggtcgacaggatgcagaaggctttgcttgagaggtgttcatctgtctctcaagagaaggggaagcaacttctcacacctcccctgtagaaggagctaggggcagtatctcacatgattggaaggatttcccatttttattctgtcctgtcagagccaaatagtagtttcttgcacaaatagtagtttccaggatccctcattttcacaagtgtaagaacagcctgtgtgtgttgaacatgtgtgtgttgtgtgtgatggtcctgaggcatcatggaatcctctgtgcctcctgggttacttctgttgtttagtggctggaagagagaagacacgtccattgcagataggcgttttcaaggcagattgaaaatcactggggtttctgaaggtgtgaatctatgacttgcacacttcatttggaagcaggtgaagatacaaaactgaagccaactttggatttgtacattcaaatctttttttttttttcagtcatccaatgaatatgaccttttggtggctaggaatgccttaaagggttgtttttttttttttaagaatgtatgaccgatctagaaatataaatgtgcgtgtattattcaatcatatttaccagctgtatagcatccaattgcaggcttttctcaggctctgattccttaaatgcaaccaagacttttgaactcgtctgtgaaggagagagtagtaatgagcctgtttgtgtcatcctattgtcaccttaccacgatcagtctgttccccataggcagggccaggatggtgccaaggcccagaaccagtagggttccaggccaggagtaggtatggtcttatttcctatgggtatgggtgtgctttaagagtactcttgagaatttgcgaactgagaataaagaaaataactccaggccaggcacggtatggctcacgcctataatcccagcactttgggaggccgacgggggcagatcacctgaggtcaggagttcaagaccagcctggccaacatggcaaaaccctgtctttactgaaaaatacaaaaatcagctgagtgtggtggcaggtgcctgtaatcccagctattctggaggctgaggcagggagaatttcttgaacccgtgaggaggaagttgcagtgagccaagaccatgcccttgtactccagcttgggcaacagagtgagactatgtctcaaaaagaaaaaaaaagaaagaaacaaagaaaagaaaaaggaaaagaaaataactgcaaagtttaagattttttaaaaattttagtttatttggggtaggaacagggagaggataggataaccctgctgaattttgcaaacctatcaatttttacttagttattataatatgcatttttatatttacatgtgttgcttatcattgtaatattgtcctaagtttgatagttttcataattataatatttactatgtagcattttcttagtgatttaccatcatttacttaatcatccagccatgattaggttttttaccctagagatttttgatgcaataattttgaaatatttgcatattgtttatatgtaggcttttttttttttttttttttttttgagatggagtctcgcctgtcacccaggctggagtgcggtggggtgatctcagtgcactgcagactccgcctcctgggttcaagcaattctgcctcagcctcctgagtagctgggattacagtttcacgccaccatgcctggctaattttttattttcagtagagacggggttttaccatgttggccaggctggcctcgaactccctcaagtgatctgcctgcctcggcctcccaaagtgctgggattataggcgtgaaccaccgtgcctggcctgtatgtaggcttttaaaaacctcctcctgagtttgaattgtttcctaagaatacgttctcaagaatggaactgtagaacttaaggataagagcttgctcttattttttataggtctctcaaaagttgctgtttctgtgtttataccaaataaacaagttttggctgctttataaataaaacaaatccatctctctatcatttttaaaattgtataaaactaaaatagaaaaaaatgtataaatagccctgccatataattgtctgtgacctgcagccattgggataagattaattttctttgcagaaggaaccctgcggtcagttctcttaattctgatttcttgtgaataaaaccttgtgttttaccaaaaaatctatcaataaaggaatacctgcatgttccctctccgtttctgtgtgcagcattgcttgctggctgagatacaagcctgccgtctggtcagctttgtttctggagttggggcccaatgctgcttctgactttttcctctccattttaggttgcagaattgtcggagtgcataggctcagcactgatccagaagggcttcaagactgccccagatcagttcattggcatctttgctcaaaatagacctgaggtatgaaccagtaggtacttgctatgcatgattttgagaattctcagatataagagcctaacttctgctagagaccagattttgtagtctgatttctactaaaagtatagctttacgttacaccttagaaagttacacatatgaaaacctcaaccagggccgctgggcacagtggctcacgcctgtaatcccagcactttgtgaggccaaggcgggtgggtcaccagaggtcgggagttccagaccagcctgaccaacatggagaaaccccatctctactaaaaatacaaaattagccaggcctggtggcacacatctgtaatcccagctactcgggaggctgaggcaggagaatcgcttgaatccgggaggcagaggttgcggtgagccaagattgtgccattgcactccagcctgggcaacaagagcgaaactccgtctcaaaaaaaaaaaaaaagaaaggaaaacctgaaccagggccttttaatcgcctttaagagaaaaaagaaatcacttttttggggggattattttagtttttttaaaccaggttcccaaataaaatccttagaacagataactaacaaaggagtctttttactttaagagtcacctctgtggttagaaaaatggcattaataagttatagagagactcagatacatttttgtcaatagcaggttcctttttttcctttctgaaaggtatgaggctttccctctggttggtttctagagtttaaaataccatgggtgatggggacagtactcactgctagccagccttcctttgggcagtctgtcattggtggtctaagcccagcacggtttctgtaaaccagtgtgtaaaagtgtgttagtccattttcatgctgctgataaagacatacctgagactgggaacaaaaagaggtttaattggacttgcagtttcacatggctgggggggcctcagaatcatggcaggaggtgaaaggcacttcttacatggtggcggcaagagaaaatgcggaagaagcaaaagcagaaacccctgataaacccatcagatctcatgaaacttactatcacaaaaatagcatgggaaagaccagcccccatgattcaattacctcccccagggtccctcccacaacacgtgggaattctgggagatacaattcaagttgagatttgggtggggacacagccaaaacatatcagaaactgagtttaaatgagcagctcttttggaagtattgcttatggtatgactcaatagattagtagatctagctggcttagaaaaatggaagcatctggcttgaagaaatcgaatttattcttatacctgcttgtgtccagaagacatgctgactcaatccctgtgctactgacttttttttttttatataaataaagatggcttcttagagttttgtggtctttcaaggggaaaacagcattctccacagctggactgtgactgggcttgtagaatttagtttttttcatcccaaatgaacacatcaaaatgtttgttttgatggaattttatcatgaatctagaactgcaaaacaaataagaaataggttccttcctgtatttatgagttcattcaacaaatgtttgctgagcacccactatatgtcagacactgtgttggggtgccaaagcacagtgactcggcctctcttcctgaggtaccacgtaaggcaagacagacctaaacaccggtgctttctctgtcaagtggtaagtgtgggcgcagggcagaaggattatgggagctcagtcaaggagggctccctggaggtggcacctgagtagaatcttgaaggaaataggggcggggaggccaagggaatgcccacgttcacacctgtgtctgggagtggagcattttcatgtggtggagtggcaggaaagacagccttcctcatgcgtcacatgtgcctaaggagctgggacctgatttctatgttgttggctgaaaattccttctgggaaaaaaccgaaactcagaagcctagttccaggccaagtggatgtgagtgggttgtgcccccttcccccggctgtgcctttttctgtcctgtgtgtcagagttctgcagatgatttcattagaaaggtgcagccggaggcagtggggtacccctgggtatggtagtgaaagagtgatctttcacctttgtccagtaggtagggcagtggctatgtggccagtgccttcagacacatcttactgcatcttgcatgtggcagtgtggccagttattgtctcacttctttcctgcacttttctagagggattttatcaaaacagttttgctgctagacaaggtacttcttcccctattccagggcatacagtgccctgctgccagaggggtcttccttgagccccacagccgctgttttgctgagaaactctcagtggctgctccgtgctctccagccagaaccatctgtgccagtcagatcgctctcactacccctgcttttgatcctgccatcccctctgttagcatctccctgcctccctctgtctctgtctctctctctctctttctttctctttccaaaggcaatctcagttacaccctcccagtagcatctgtagctaccttggccgatggtgggctttcttatctctgggtcagtccctgtctgataattattgctaattatcttttaacatatttgcctcaattcttcaggcggattttaatttatctttctttctctctttctctcctttcctttccttccttttttcttttctttctcaatctctcctctttctctctctgtcctctcatctttctttctctctctctctttccttccttccctccctccctccctctctttgtacatgcatacatacatacatacaggatctcactctgtcacccaggctggagtgcactggtgtgatcacagctcactgcagcctcaacctcctgggttcaagcaatcctcccgcctcagcctctcaagtagctgcgacatggtgtgtgccaccatgtccagataacttttgtagaggcagggttttgccatgtttcccaggctggtcttgaactcctgggctcaactgattcccccaaccttggcctcccaaagtgctgggatcactggtgtgagtcagtgtgcctggccttaatttctttttaagaagggggcatgtgttttgttctcattctgaatcccttatagcacctggcacagagtagtagctaacacagatgttaattttgctgcgtcaaatgttttcactttgaatctctcttgagtattgttctccttattgattacatgatgacatcctgttttctctccctgacctttactgtttgtttagtgggtgattattgaacaaggatgctttgcttattcgatggtgatcgttccactttatgatacccttggaaatgaagccatcacgtacatagtcaacaaaggtacgtctgtgatctttgcctggattattggcatagttattggttaggttcagtgactttacatttgcttacatttgatttgacaaagattttacatgtaaatatatatctacctttttattcaaagaatgtagtacttcaagtatccttgtgctggatatgacagagtgaatcttttaacatcccagagcttattcttcattgtatctcttcatttacagctgaactctctctggtttttgttgacaagccagagaaggccaaactcttattagagggtgtagaaaataagttaataccaggccttaaaatcatagttgtcatggatgcctacggcagtgaactggtggaacgaggccagaggtgtggggtggaagtcaccagcatgaaggcgatggaggtgagtgccctgcctccttcccttctctgaaggctttccctggggccgtgttggctcacacgtgctatccagtgctatctagtgctatggtgcagtcccagcgctggccggttgcctccgcaacccatgaaagagagcagaaacttctgtctcattgctggaaaaaggattctacatgtgtgcccagtgttaacacctcacaccttacccaagtgctttcagcactccaatatttattccagagcactgacaagctgtgcccggaaatgccagaaatgggaattacagcttcaggcaggtggaactttcagtttctgtgtctcctttgggctttaatgccttttacttactaatttgtctctaatgccaagccaagtatagaaatcagcctcatcgttcttttccctggatggctcgtggagagtcttggtgaatttccaacatgcatgtttgatttggtttgttttcatattgactcttaagagtcataccaatcacaagtttaaaggcagccattccaggagaatgagcgtggtggtccatgctcagcttgggtgcttgatgtcagatgatataagaagttgatccccgtcagttggacttggattagagttccatccaaggaacatggccggaggaagatcttttcatatacatatcataacaagtcataggaaaacagagtcagtccttctctttctgaaggtgttagaaatatttttctgaaactgttatagataggattttaaatttttatgtgtagttttcctcctcctacaaagaatttgaggctataagtaaggatctgtagaacctttcctgaggaacccagtaggcacagggaagcgcgggtgttctaacagaaccttctctcttgtgcatgtgtgcgcccctgcccaactctctctctcagtagcatcgaacgtgattccgcaagtgctgacccgggtgcttccttgttgaattggggttttatagcttcttacctagtgtttccccacttctgtttttttacttttaaccctcttttactataatgtaatctctttttcccttaccttcccacagatgcaagaatttttctggtgttttttgactgctgtatgataaagaagtaatgttgaaatttaaaaattatttagttgattgaagattataatataaagtttatattaaaatattaatttatagaagacattgttttacacttacctgtttaatatgatctgtacttagtttttaaaaatattctgagcaaaaggtgaagagatcgccccactgcactgcagcctgggtgacagagcgagactccatctcaaaaaataataataattgcagtatttttcctaagtgatactgtaagagagatgtaaggctgtgaaacttttgcggcaacagtgcactaatttggataatgtttgttcccaataaattaagagccaaattgtatgtaactggtgctttattttatttaacatcagtttttgaagaattgggcatctccagaagttatgtaagaatttttaatagacaaatagaaatctggagctaataaaggttattttgaaaaaaatgtacagaattattgctttagcttttggctgacctctaattggatatattagttcctgttcttaatcggtggtctgtcactacatcatttaaaatgtaattaagattgaaaacttaatgtatgctgggcagaaactcactaagccctgagcacacccatctaatttccacgtgaattgaacatgttcaatggcgtgttcaatggcatgttcattccatatcctcattcaagctgttccatttgaataggaaaagaatataaatagttcatttgttaaaattaatagatattaaagtggccaccaagactgccctaatgcagtaaaccgaaccccatcagtggtagtgactggaagcctgccgctgggaaatgctgtccccgcgcaatgcttctgtcattcttaaccttcaagtccattcaggaaggagtcttagagggtctgctgtggcctgttttataattgggggctcccaaatcctatctccactctacgaggggagatatttgagcagatatttgagcctctccaaaatgcctagcatttcaatcgagcagagattgatttttcttcttcccagattgcagatgtcagttgtgcagaatgtgggggtgaggtagtgctgtgctctgatttgaggaacctacgaagtatctgcagtatctcgttatggttaagaacagggctttattaaaggccctaataagaagtggaagtggggaccagaaatgcatggtaaagactttggctgctgtttttttaatacatcctatttcaaagaccagtcctaataccgtttatgtagttttatgtaagagaagaggtaactggaaaatggcttctcagaacaatgaataaatattttggttctggttaattaaaactgccatagtttctttaattagaaaattatgctgttttcgagccaggtgtgaatgaaccccacagtaaagccagctttaagtgactcgatgtgaccttatcctttacagttagaaaacgtttccatttaagactttttttctcttctaattaaggacctgggaagagccaacagacggaagcccaaggtaagcacaccgtgtcagaccctgctctgtcctctttgtagttttcaatatctagcctggtaccttgtggcttatagttctcttttctgttctgatttataccagctttttttttttttaatctttagcctccagcacctgaagatcttgcagtaatttgtttcacaagtggaactacaggtgagttttgagatagaattgcttctacatatggcagccattggtctggactctcccctacctcttttggatgacttatcagctaacagtagacggaccaaaagcagaagagaaggaagcggttcaagtgctgtcttcttgttgctctgtaagatcttctcagagtccaagagtgccggataattcctcaaacatttattgagggtgatattagattcacctgtcttcctaggacagactatatcggtggctcccaggaagaaaatttctggtttttcttctcttatgactacgtatataccctttaaaatgtgcccatattaataaaggtttttaaagataagtcagtgtaaggattgcaggttgcttaggaatttagtgttcaacatttggttttcacgatatatctaacagtagaggtgtctgaagccctaattatgtgaggtttctgggcctccttcatttctgtcattctttaactttgttctgcttcatatgtgctccacaggcaaccccaaaggagcaatggtcactcaccgaaacatagtgagcgattgttcagcttttgtgaaagcaacagaggtaactttttgggatgtcgtcatctttcctcattgattgacattagtccttgagaatgaaagtgctgaaggtgggcaccagtgtgttaggtccatgtggcatttagaaacgatgtgacatatgggtaaggtcagaactttaggcccaagtccaccttctctcttttttcactttgaacctaatcgccaacccttgccttatgataattaaggtgaattgacagatgaagttcactgcaacatttatatagagaaactctatttggatattgccctagaaacatgtccaagaaaggacagagaagagatggactctcttgtgtttttatccagcgtccctgtatttgggaaataatttattttaaattggcaatgatatgttaaaagtttttgaatgattattatctgttgtggtcagtgtgacttccattgcactagaagtagtaaagccttgcacttcagctaatttcccatgcttttaaagtttactatccagtgtcttagtctatccagtcacagcagggccccatctacattgggagttaggatgttgacatacgaatttagaagggggtgatgtgattcagtccataacaccaacagcctattccaaacttgccttttaaaaaggtgcttattgaaccatatgccttttccttatactcttttttacatttaacataattggcttttgcagtctctttggaagtattctgtagctctgatttttgtagcaggagcctgagcttaatggctttggggaatggacatgtttggtggctgcagaaaactgatctttgagggatcttgccacttactttacttggctcacactttccaaatgccctttttaaagatgtatactttctaaacagagttcaacatttagtaccttaccaaagtgaaattttaatttcctaattggccttcaaacaaaacttaaaatgcattggtggctcattgaggcaaatgattacagaactttgtttaaagtcagttacaatatcaaatcaattacaatatcagtatcttctcagctttgtaagatgtctaatcatgataatggacaatatttttgttctgagtcagaaagttgaaaagtatagatagaatggagtccgatttctcattatattaatataacaatttcatcctgagaagtactacttgggatgcctgtcagacttgaataaaatccagctgagattatagcatgctcagcccacatccagtgcttctggggctgctgtgtttgctcaggattgatgctttcatccattgtcacattattattaagggtgacccagctttaggaaaggaaggggcatggctcagaacttggtatatcatcccctaggtaacgacaatgccctcatttcttagttggtatgacagcagctgctcttgcacaccccctgttttggccagaattctttatgttaataacatgaatattctatacaaaccctcactgtgcctgccctaagtaaggcccattctgagggaaaccagatgtccaaacttaatctgtctgtggacccatcatgatcagcattttataggagagcaaattcctgggtgccagatctgaggttgcattaaacaaattgtgatatgtaaagtagggctttaaggtattaaaaatattgatcaaactcaaaatactctaaggaccttggaaatccaccttcttttatcttctttcctcctttcccttaacaacataaaatgcaattttatgttgaaatgggtcctgtatttcttaaggtaaaattgaacttgctgggtactaggatactgtagtgatgaaatactaactgattagagcatataatcccttaaccttccaatttgagcaaaattttccttgttttgattaaagccctgaagtggatttactttgtcatggggagtgacttccactttgtttgaataattaaagtattgcttttttttttgattcagagtctcactctgttgcccaggctggagtgcagtggtgcaatctcggcttactgcagcctccgcctccctgattcaagcaattctgctgcctcagcctcctgagtagctggaattacaggcatgtgccaccatgtctggctaatttttgtatttttagtagggatggggttttaccatgttggccaggctggtcttgaactcctgacctcaagtgatctgcctgccttggcctcccaaagtgctgggattacaggcgtgagccaccatgccccttgtttttcattttattctttggtgagaagaaattgcagaccataagcaaaagccgtttctcctcagtgttgaggtactatgtgctcagaaataaaatggaagtttactcggagtcttttttttttaattttattattattatactttaagttttagggtgcatgtgcacaacgtgcaggtgtgttacatatgtgtacatgtgccatgctggtgtgctgcacccataaacttgtcatttagcattaggtatatctcctaatgctatccctcccccctccccctaccccacaaccgtccctggtgtgcgatgttccccttcactgggagtcttaatgcttttctgccttgctggtgtctttgcttacagaatacagtcaatccttgcccagatgatactttgatatctttcttgcctctcgcccatatgtttgagagagttgtagaggtaggcatttaattttgttttccttgcttgtttgtgtatgttctgctaagttgttgtgttttacagaaagcacttcccttgagtgccagtgacacacacatttcatatttaccacttgctcacatttatgaacagttattgaaggtaagtgtggcgtgcggactgtcatccctatagagaattctctgctcagccccgttttagaaatggtgcagattatttgaaagaatataaattctttttctgagtatgaacaggatactggaatttaatcactcattttaaaattaggagttcagacttttgaaggatactaatgtggacatgagtccagaaaaaccaactataaaggtaaagtcattattaattcagttctacaaagcccagcgaggcttccgttctgtgagaagtctctatttttgattgtgcttgttcctaatgcacaagttggcttgcgactaattttttcagcaatattctaagtgcccttggagaaagaggatgatccttgagttgacctttgcctaggctccctgtaatcaactgtgtgactaattttaaaactgaccaagaaccaccttttttccttctttgacaattttggattttatgctgtaggaaaaaacaatgagcaccattcattcatttagtgagtagttactgagctctagctgtgtgccctctgctgtgttggagacagaggtgactatcagccgatgctttggatgacagctgccctgtcggatttgctcatcccaaaggatcgaaggcgattagatcccatctgccatctgttccttctacttcctgcacacctcagagtcttctgggtttataaagcaatctcacatgagttgctgtacctaacgagttttagaggtgtgcctagaaggcaggccacgctgaacaaaagctttctgagctgtaattgttaaacagtgaaccatggtgtacctttctcgtggtttctgcttctaagacagagaacatttgtacttcccttgtgtcatcttttgaatcttttctttttaaattttaaaataggcaaactgtcaggtccatatggcttgccagcatggtttgtactagacaggaaaaaaatcatgcagtgtattctagctgaatggcaagccactctggtattagataccctggtgtcacaaattcatcatacttggtggcctttcagaaacttctagttagattcaaacaaaagaaagtgagactttaacaaacttggactctaggcaagaagttaagtttttattttgagaataaattaaatgtaaagtttctggaaggctatatatatatatatatatatatatttgagacagagtctccctccgtggcccaggctggagagcagtggcacaatctcagcccactgcaatctccgcctcctgggttcaagcgattctccagcctcagcctcctgagtcgctgggactatgggcacccgccaccaagcccggctaatttttgttttagtagagatggggtttcaccgtaacgtggccaggctcgactggaactcctgacctcaagtgatccacctgcctcggcctcccaaagtgctgggattataggtgtaagccaccgcgcccagccactaaaaatatttagaatatgtaataccatgtcattcattgaacagatacttaccaccgcactaaaagagtagaacctctgtggtcatcactaaaaacaacatagcctggttttttactgagtcccatatcttcaggataaccaagagaaataccacatttccatgttgtacaatgactagtaaatgcacattttttttaagttacctatatttaggaaatttaagatttctggaaactggcctgaaatgctaaaactgaaatgttggatgttgtccatatgttgtgtaacccctgctgtggtgataaaatgtttgttttttccattacccctatagtgtgtaatgctgtgtcatggagctaaaatcggatttttccaaggagatatcaggctgctcatggatgacctcaaggtgcttcaacccactgtcttccccgtggttccaagactgctgaaccggatgtttgaccgagtaagttccaagcagcgaagtcccaggactgagcactgacttggacgcaggggcttgggcttgaattgggctgtgccatgtgccatctgtatgaccctggacaatcctcccaatcttacagaacttcagtttactcatctgtaaagttagaatgcgtttacctctcagagtggctgataaggattataagagaaaatgcatgaacacactttgtaaaccatggtcacaacacaagcataatgtgggaggtcattttatttttacaataaacactttgagcctctgcttcctcatgtgtaacacggactgtttacctcttctctcctactgtttgtctccaaaagttgctaatgggatcacgtaagaatagtaactatgaaatggttttcttcattgtaaagctccttgcatggacatgtaaaacattacttaattggccacactgaaagaagtgactaagccacagcagagcccaagagaacaccagcccctctgcggtgggtatcattgcgtggaccgcacagccagggccaggcgcgaggggcatgagcaatctccagaaagagtgttcacttactctttattttgaggcaggacttttgttatctctcagaacgttcttatgtttttaatggttctttttaaaaggacaactttatcaacatataatactctgtataatttgctgatttaaagtgtgtaattcaaaggttttgagtactttcacagttctccagccatcactacaatcaattttagaacattttcatgacctccaagagaaacccttacctattctttatcagctccccgaccccctccacccttcagcatccgctcatctgtgtatttctctattctggacttttctgtggatggaatcatgccatatgtgctcctttgtgactggcgtctttcacaagcatccatgtagcacgtattagcacttcattccttttaacggccaaatagtattccactgtatgggtataacgcattttatttatccattccttttttttttttttttttgagacagggtctctctctctgtcatccaggctagagtgcagtggtgttatcatggctcactgcagcctccacctccagggctcaagcagtcctcccaccttagcctcctgagtagctgggaccgcaggcatgtgccaccatgcccggctaatttctgtattttttgtagagatggggtcttaccatgttggccacactggactcaaactcctgagctcaggagatctgcccacctcagcctcccaaagtgctgggaatacaagcgtgggccaccgcacctggcctacacattcctactcgatgggcatttggggatgtatgtgtccattgctcctgggtgtataccgaggtgtggaattgctgtcctgtgctgaccatgtggggccgttagaggaccggccaggctgtcagagcagctgtgccattttgtgttccccagctgtgtgtgagggttctgatttctccacactctttgactctggccatcctagtaggtgtgaaaactttctcatgtcttgcctcattagattttcggacaagcaaacaccacgctgaagcgatggctcttggactttgcctccaagaggaaagaagcagagcttcgcagcggcatcatcagaaacaacagcctgtgggaccggctgatcttccacaaagtacaggtaacacgtgactcacagccactgctcccatggaaaccgacttcgcttttcagagttctgggagggccttttttgtgagagggagagatgaaggtaagggagagaataacatgtttttgttaattctggcacacatttaaaaactaaggcaaagccattaaggaggcctcagtttctaagatcaatagtattgcagccatctagggggaaaaggagtcagggtagtggagcctttctcattctccattttgttgcgtttttccggaacaagcgtgtcactcttgaggtaatttttcaagcatgagtgataacgtgtaacaatatcatgccccccagaaggccagaattgtggtagttgccacagatctgcccagttgtgttctaattccctgaaatagcttctgcagaggtggggctgacttccatccccattgggagggaacagggcagtcacgggtggaaacaaaccgtagccctgtgctgccatcatgagggctgtgagttctccgtgtggcctccgtgtggtctgcagctatgggttagggaacggggtcccaagcaggcccccttggcggagaggccgccgacttccaggtgtgtaaccctcaccttctcccactctccctccctgaaagtcgagcctgggcggaagagtccggctgatggtgacaggagccgccccggtgtctgccactgtgctgacgttcctcagagcagccctgggctgtcaggtgaggtggatgtcacggcgcctgattctcccacactaggatgcccagtcctcttctgcaccaaaagtcatctgtactgtgtgtgtgtgtgtgtgttctttcttaattgacaagcgtatctatatttatggcgtaacaacatgatgttttgatgtatgtaatatgtaaacattgtggaatggctaaatgaagctaattaacatgtgtcttaccacccatacttttttttcccacgtggtgagaacacttggaatctaccctctgggcagttttcaagtatatgatacattgttgttagctctagtcaccacgtggtgctatggagctcttgaaccagttcctcctgatggagactttgtgtcctttcaccaacatcacccctatccttcccaccccctactttgtgtgtgtgtgttatgtttgtttggaagatatgttattattaggttgcttggagaagcaaccatatgtatattttttaccctaggcaggggaatgtgtgtgtctgccatttgttgaattttctctaggatcaggtgcaagacaacctttagaagcaggtatgcagctgtggaatgggtcacaggtgatgagcctacccgcacaccatgctgacaacctgtagtaaagggagaaaggaggatttggtggcagacggggcatgtgtggggtacatgtcctgtgaattggccaagggagttcactgctgctgggtggtgaccagtcacataggggttctccctcgcttggccactggaagttaaatagaaggtgtacctgggtgacggctggtgttggcgtaaagcacactggaccattgaatgaacttactgaacagaccatttgaaatgagatttcaccagtcagccatgacttgggagttagtgagacttcattgcttgtgcacttccagtaaaggtgtgattgtgctctccttaataatgttgcatctcttggtgccccagttttatgaaggatacggacagacagagtgcactgccgggtgctgcctgaccatgcctggagactggaccgcaggtatggctgtaggaggctcctttttggaattttgttattcatactgggttattggtatgtctggaattgggttaatcactgactggttcattaaccatcttaaacaaaagtgctatgtttctgatcattaggctctgggggcaaacactcttgtaagtcagggcactgtggggagaacacctcctgcaactgaggggtggcgctggggatctgactgtaaagctggtggcagcagagacttgcctagactctactagtgacatctgagaggggccctgtgttccagattgagagtgtctggcccaacagagcttcctagtaattgagtagggtctcgttatttgctggtcattttaaacaacaaatagttattgaatttgtactgtgtgctgtgctaggtgttgggactaccaataggaataaatacaagtcctttttctcaaaaagtcatttctcaaaaggaaaaaggaggaggacaaacaaaaataattgagcatctgtcatgggtaagcctctgtgatgggtgcttaggatgtacctaatgtcagtgtaaccccaacagtgtccctgtgagataagttctggtacttctcagaggaaattatagattgttgcttaagtaacacataaatgatgtatgagaatttacgcggcattatgctttggagccaggatttcaaccccggcctgactgcagagcttctgtgcttcctctgtgtcacctgagtagtaaattctacactgtgataaataaacttcccagcttatttggagtattataagtattagcaccatttagtaacatatattctagaacctagcactgtccactaacatcattgtcctggaattaacgcagacagtctgtgaatcttctttatggtatttgtttaatttttaacctcagtttccttaacagagaatttggaatactgatctctagaagctcaaattattaaaacataggaagaattatttgtgatatctaatgtgatatctaacatatctaatgtctgttgttgctgcttttggaaaagacagcccagtcttaacagcctttggcaagagagttaagttagctgtagaaataagcactgtcccgtcttagtaaaaactgtaagacatgcttcttcatacgcaaggaaataaaggccgtgttgatcagaaccaggtggtgcgtgaggtttgccaaagctgcatatgttctctcttcttacagagaacaggatgctaagaattctgtgtaagatgagtgcaagtaatgggtgggggcgatcggagggtggaagccgagtgaaggtttgagagaggctgcttccaggtgtttgtaggaaccttcacatagaggccaaattactcataaataactcagagcatcacacttggaaaaggtcctgaagacactaaatatgttcttccctagtctaagaatagactctcttaaattatactaggaagagaatggctgtaattgcagaaatcagaagtttatcccagccgtttttcttatgtggaatcctgtttgctatcaaaataatttgacctgaggttatgagtagttcccttaggaatgaccatttgcttatttaatatacaggccatgttggggccccgatgccgtgcaatttgataaaacttgttgatgtggaagaaatgaattacatggctgccgagggcgagggcgaggtgagtgaaaaccgtcagtcattttccctcgctgccatttcctgtgatcgctggcctttgcgaatgctgtggtatttcccaacagctcaataaagccattgaacttgacttcattggtgatcctggagtctgccaggcttctttctgagggtacatttatgttcagctctcggggagtgggcaggagggacactgatgcctgtcttcctctgccaggcctcatagggatttgggctggagagcctgcaaagaaaggcccggtggcctcagttcctgggacgaaggtcctgcctgttgattgccctgggtacctattagtgagctgctggctgctggatgggaagcctaattacttaaaagtgatttcatcccctgcggggctttccaacagctttgagccagaacctagggcaagcatttgccctacaaatcggccagagctgaggtaattcaggaagggaagtaggggcactggagatctctcgcagaccctggtggggctctggtaactccctctgcatcctggagtttagggcttccagctaaaggttggggcagacacacacgtacacacatgcacacaccagttttctctggaaaaaccccagtaaatgctgttcactgatgatcttcttttctttaggtgtgtgtgaaagggccaaatgtatttcagggctacttgaaggacccagcgaaaacagcagaagctttggacaaagacggctggttacacacaggggacattggaaaatggttaccagtaagttgccgcctcctcaggtcacaaacagttcagttccactgtggggaagaaaatgtcttatctactgtgcagctgccatgtggcagtggcaccctgaattttctctttcccttcctccttggtgagtggtatgatgtagactgttccatttcctgcaggggacagggttacacttagcatccttggttggattttcactttcacttcagcgaatatgttttgttctgatgcttttttgtttctttgttgtgtttttggggttttttttttttgagacggaatcatgttcttgtcacccaggctggctggagtgcaatggcgtgatctcggctcactgcaacctccacctctcgggttcaagtgattctcctgcctcagcctcccaagtatctaggattacaggtgcccaccaccacacctggctgatttttatatttttagtagagacggggtttcaccatgttggccaggctggtctcaaactcctgacctcaggtgatccacccgcctcagcctcccaaagtgctgggattacaggcgtgagccaccaccgcgcctggcccgttttgatgcttaacatcaattctggttgttgcttctcaaccggaatacaaagagacagtggcttttttacaatatccgtactgagccgtgatgttgaggcctcagttaaataagatctgggggaagttgtggtagacttccagcaatgtaggatgggtaaggatttgggaataaatgtgtttcttaggtttgtcatctcattaaaaatagggtgtttcacagattaggcgaactccttgaatttagttgaatgtagtctcagaaccatttactgtagagaaattctgaagagtctatcttaagagtgagaagcttgtgcaagaagcctgacctgtcctacctgttggtttgaccagtaatctgctgtttcgaagttattatgatgctgattgcaagccctaaaattacaaatataatttttattactgtgtattggcagattcttgtagattttaggtgcttatttctttggaatttgtattgattagaaaaatacctcccaaaattacttcagattttgcaatacccaaactatttagagctaaattaagtccccctcttccggttcaagagagattaaatgtcagttccaattctactgtggcactcacgaacacatcccatagtctctctggaccttggtttgctccttttgaaaatggagaactggtgtggaacaaaagaaccctagacactttctacagatgacttttggaggcatgagagtggccccggggtggggatggggtaaaagtgggactagggttttgcttacggcactactgggatgtggctggtctggtccagagatgctagagcacttccacagttgactcactcttcccaaagggccaagagcacccctccagacatcgaggaagaaaacaggaatttggcctttgtgtaggaaacatttcttgaactcttactctgtgcagagcactttggaaggaaaagttgtgttcctgctattaaggaacttgagtcacttggtgagccagatgtgtatgcgcctaattcagacaggaggctaaatgagccagcaaagccttgctagtgttgaccagtcagtggtgccaagtggtgacgctgaataagcacgggctctaggaccccttctctgtctctgcacttggccaaatagccttggacaagttcctcagtctctctaagcctttgttttcctctctgtaaaatgggatcataactgacctctgtgggatgttattagaattaatcaatagtgtgtattaaatacctttcagtgttgtactgggatccatcctggttggaaaccagccatcagcccattcataaccccctcccctctgatcaacagaatggcaccttgaaaattatcgaccggaaaaagcacatatttaagctggcacaaggagaatacatagcccctgaaaagattgaaaatatctacatgcgaagtgagcctgttgctcaggtgtttgtccacggagaaagcctgcaggtatgtgctttctgggtcttgaatcttgctgcatacacattgccattgcctggtactccaggggctttaaatgtgattggaagtttgagacgcctatcacttggctttcatgtctaatctgctagaatatcattgacctgttactgatttttgttgcttggcatttcctgctcaggaaaatttgttctctttaatttccacatttttattttacttagagaggtctgatgtaccaaggggaggttggataaacatactgggggacaggggcatgggtaatatatgtttccaattatgaaagaaaatattgacatgggttataagaaagtttacaattttcaaacatattaaacccagcctattgatgatatgcttcctaatcatttttgagcaaacggtggttgtgaaccaagaatactcaaagttgaaaatcaaaatcagtattgcagtgaaacatgtatggtatttgccaaaatgttggacagatgatgccaaggaagagaggatctggtttcctgaaaattaaccttttggaaagttgggtcaaatggtatttctagttctagatccctgaggaatcgccacactgacttccacaatggttgaactagtttacagtcccaccaacagtgtaaaagcgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctctacccactttttgatggggttgtttttttcttgtaaatttgtttcagttcattgtagattctggatattagccctttgtcagatgagtaggttgcaaaaattttctcccgttctgtaggttgcctgttcgctctgatggtagtttcttttgctgtgcagaagctgtttagtttaattagatcccatttgtcaattttggcttttgttgccactgcttttgatgttttagacatttgacccagcaatcccattactgggtatatacccaagagatttataaatcatgctgctattaaagacacatgcacacgtatgtttattgcagcactattcacaatagcaaagacttggaaccaacccaaatatacaacaatgatagactggattaagaaaatgtgtcacatatacaccatggaatactatgcagccataaaaaatgatgagttcatgtcctttgcagggacatggatgaagctggaaaccatcattctcagcaaactatcacaaggacaaaaaacaaacactgcatgttgtcactcataggtgggaactgaacaatgagaacacatggacacaggaaggggaacatcacacacgagggcctgttgtggggtggggggagggagggagggatagcattaggagatatacctaatgttaaatgacgagttaacaggtgcagcacaccaacatggcactaacctgcacgttgtgcacatgtaccctaaaacttaaagtataatttaaaaaaaaaagaaaaagttgttagattttaaaattattttaggatattttcttataagagaatgcacttatttttctttgagattgcagctattttcgtttgatctagaatcttctcattcttttgatttttaattttattgttagtagattataaagaatgggatattagagatttttctttaaaaatgaacctatatacattttatttatttattttcttaaagatagggtctcactctgttgtccagctggagtgtaatggcagtcatagctcattacagcttcaaattgctgggttccaggggatcctcctacctcagcctcctgagtagctgggattacaggtgcaagccaccacacccagctgattttcaattttttggtagagatggagtctcactatattgcccagactggtctcgaactcctggcctcaagtgatccccattggcttcccaacgtgctaggattacaagcatgagacaggcttcctttttttccttttttttttaaaagcagttatctgatatccatcaccttgtttacttgaccctgcttttaaaaaaataagtatataaaagtaaatacgaattagagatttgttagattggtattcccagtggttttttaaaaacattaattgcaaaattcctgatgcttaccacattttagagccaggagttcttaatctgggctgagtgaactcctgggggaggggggtagtatgttctgaatagatgagccataactttcatcatattctcccagggggccacaagatggaaaaataaagaaccactattttagagcatttggatcaagctatgtaataactcatttgtctgtgttaaaggcatttctcattgcaattgtggtaccagatgttgagacattatgttcctgggcccaaaagagaggatttgaagggtcgtttgaggaactgtgcagaaataaggtaaggttctgaagggtccagtctgtcctcatcataacttggcattaaatgtacctgtagatattcagggacctctaacagaggaagtaatttatttttcttacccttttaggatgtcaaaaaagctatcctcgaagatatggtgagacttgggaaggattctggtctgaaaccatttgaacaggtatgaccttcatctgagtgggtgaattcctgtaaaacaaattttccattaagatttttttacaggtagattatataaacatatggggtgacctaaagacatacatgaggaataaataatggagtagtttgacaggggaaaggtttttaaatcaaaagcatttattctcttttcctggatatcagaatatgatcccgaatcctatcctaagaataggatgcctgtcctttgttgagaaggtgcagcttggctgaaatgagaggatggattggatggctggagagtgttgatcccctccaaggcttacgtgcttttgagactggtggcccgtgtcctttttcctcttttaactgccttgtttattggcaggtcaaaggcatcacattgcaccctgaattattttctatcgacaatggccttctgactccaacaatgaaggcgaaaaggccagagctgcggaactatttcaggtcgcagatagatgacctctattccactatcaaggtttagtgtgaagaagaaagctcagaggaaatggcacagttccacaatctcttctcctgctgatggccttcatgttgttaattttgaatacagcaagtgtagggaaggaagcgttcgtgtttgacttgtccattcggggttcttctcataggaatgctagaggaaagagaacactgccttacagtcacctcatgttgcagaccatgtttatggtaatacacactttccaaaatgagccttaaaaattgtaaaggggatactataaatgtgctaagttatttgagacttcctcagtttaaaaagtgggttttaaatcttctgtctccctgtttctctaatcaaggggttaggactttgctatctctgagatgtctgctacttgctgcaaattctgcagctgtctgctgctctaaagagtacagtgcactagagggaagtgttccctttaaaaataagaacaactgtcctggctggagaatctcacaagcggaccagagatctttttaaatccctgctactgtcccttctcacaggcattcacagaacccttctgattcgtaagggttacgaaactcatgttcttctccagtcccctgtggtttctgttggagcataaggtttccagtaagcgggagggcagatccaactcagaaccatgcagataaggagcctctggcaaatgggtgctcatcagaacgcgtggattctctttcatggcagaatgctcttggactcggttctccaggcctgattccccgactccatcctttttcaggggttatttaaaaatctgccttagattctatagtgaagacaagcatttcaagaaagagttacctggatcagccatgctcagctgtgacgcctgaataactgtctactttatcttcactgaaccactcactctgtgtaaaggccaacagatttttaatgtggttttcatatcaaaagatcatgttgggattaacttgcctttttccccaaaaaataaactctcaggcaagcatttctttaaagctattaagggagtatatacttgagtacttattgaaatggacagtaataagcaaatgttcttataatgctacctgatttctatgaaatgtgtttgacaagccaaaattctaggatgtagaaatctggaaagttcatttcctgggattcacttctccagggattttttaaagttaatttgggaaattaacagcagttcactttattgtgagtctttgccacatttgactgaattgagctgtcatttgtacatttaaagcagctgttttggggtctgtgagagtacatgtattatatacaagcacaacagggcttgcactaaagaattgtcattgtaataacactacttggtagcctaacttcatatatgtattcttaattgcacaaaaagtcaataatttgtcaccttggggttttgaatgtttgctttaagtgttggctatttctatgttttataaaccaaaacaaaatttccaaaaacaatgaaggaaaccaaaataaatatttctgcatttcaggtg

SEQ ID NO: 36034 - DNA, 66968 bp, Homo sapiens
cctttcccctcccgccggacctgccaggaggtgggctggcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccaccatggtgaagatcgtgacagttaagacccaggcgtaccaggaccagaagccgggcacgagcgggctgcggaagcgggtgaaggtgttccagagcagcgccaactacgcggagaacttcatccagagtatcatctccaccgtggagccggcgcagcggcaggaggccacgctggtggtgggcggggacggccggttctacatgaaggaggccatccagctcatcgctcgcatcgctgccgccaacggggtaagggatgcgcggccccgcgccgctgtgcaccctggcgcgtgtgcgacgtgcggcccgcggcgccctccctcgctcggggccggccgcttccgcgcgctgccgcctcggtttccacctcccgctcctccctctccttcgcgctcgctcttctggcctggaggcccgacggaggtcgccgggctggggaaagtggccacgggacccggcagacctgctcgcctgactcccggggcgccgggaggtgcgggcgcggagcctcccaaggtcacgcccgactctccgtctctagccgctgccttccctctccccgtcccccgcccctcccgaggcgtctgacatttgccctaaccttgcagccttggaagatacgattacggcgcagagtgctgtcgccttaagcaggaaaggttagactgccgccgcctcgcccagagccccctcgcatcccgcccgctcctctgctattctcggctaggactggcgcttcccgctggctcggagcccgacactgtggggcaagggtggcgagagcacccatccccctggggcgtcaggttggcagatctcagcaggcgggtgccaatcttttctccccgccccctagtttgccttggttccgaactcctgccctttgcgcggcctgcttgctggggggcaggcgtttgaaacatctagtctctgcccagtggtgcccgggatctgttccaccgacggggctggagctgaattttcattagaatggcaacatacccaaagacgcccttacgcaagcaagcagtcgtggcaggccaggaaattaccgcaacaccttggttccgcccccggccaaggaaagttaactgacttgattgggcgggtccactcggataggggaaattaaaaaaaaaaagtttttcagtaaatctgatatatggaaatgtggggccgggcatggtggctcacgcctgtaatcccagcactttgggaggctgagggtggtggatcacctgaggtcaggagatcgagaccattctggctaacacggtgaaaccacgtctctactaaaaaatacaaaaaaaaaaaaaaaaaaaaaaattagccaggcgtggtggcgggcgcctgtagtctcagctactcgggaggctgaggcaggagaatggcgtgaacccgggaggcggagcttgcagtgagctgagatcccgccactgcactctagcctcggcgacagagcgagactccgtctcaaaaaaaaaaaaaaagaaaaaaaaagtggattgataagttggggctaattattcacttacttttgtaaaacatttctaaggagttctgaggaccaagttttctttctatattttaagtgagatttgacttatgcccaattcttctggaacgcatcccctgaaatggatatttttattcattttaatagtactttatttatcttattttgttgacattgagtactatttgccaagcactatggtaagcgcttcatttctgggtctcatttatcctcctgcagccctataaggtagatgctattatgggtatcttcaagttgccaacgaggacgctgaagcttaggtaggttaaataatttacaaaaactataatggcagcactaagagtccaatatagatctgccaatcccaagaacttgaacagctcctgagaatgaagaatgaacagcccttgatcttgaagatctgttttccaggctccaaaatctaaactgggctctatctacatctgccttcctgggccaaacatttataagcatcagtgagagaagattgcctggatttgtttactttgtggtcctgaattttcagacaagcgcaaattcccatgaaagaagaacagacaatagctgtatcccagtagatcatttccctgttaccacctgtgctgaatttgcatttcattcattcattcatttattcagtcagtcattcaacagatcctgttgaataccatgttcagagaaatgtgtggactaaaaggatgatgcagacccaagagttgtccttaaggagcttacagcagagtgggaattttaggtgcccagatggaaatttgtccatttgggagtagtgtggggtgggaaggaaagaattagttaagactaaaaaaaaaagttcttaaaacttcatcaccctttagccattgccctattgctcttctctcagccaacctttgtaaaagctttctgcattcactatttctcattctcacctccggtttactcgccatttcactgcttctgccccctccactactccagtagaattgctcttgccaaagttactagggacttgccagttgctaaattcatggaatacactctggtctaatcttatttggcctttctgctgcatttggcagtgctgattttgtactcttgtaaagttcttcctcccttggccttgcttactctcctgattctactcacactttttggaagttccttcatgggctgcacattgactatcccctaggtttctttcttctttctttctttcttttttcttcttcttttttttttttttttttttttgagacggagtcttactctgtcgcctaggctggagtgcagtggcgcaatcagctcactgcaacctctgcctcccaggttcaagcaattcgcctgccttagcctcctgagtagctgggatgacaggcatgcaccaccacacctggctaatttttatatttttagtagagatgaggtttcaccatcttggccaggctggtctcgaacttctgatctcaggtgatccaccctcctcggcctcccaaggtgctgggattacaggcgtgagccactgcgcctggcctattccctaggtttctacgctcaggttgttctctgattttgttcactctctctactcactcgggatttaaatatgctactctttctcttgtgatatgattcagtccagatggcatcttcagaaacctttcttgacaccccatccctaccactcttctccacctattaagtgctcctttcccatagataattctagaatatatatattaaattctagtgaaattttccgtttacatgtcaacggcctccaactagagagtaagcttctttaagtcagacctgtgttttacctgtatctgcaatgcctaggactatgtagcattcaatgaattcttgtttatttgctctgaactgtgagtcacttttgtattctagcacttgatttaaagccagcatgtagctggtgaccaataaatttattcacatcaaacatttattatgtgcttgctttgcctcagacattgtacttgagatacaaaatatttttgcccttgggaaagacatagtctgggaggggtggtatacaggagtaagcagacagcacaatgtgtcaggtgttgtgatggagggatgtgcaggtgtctttaacctgaggggctgtacttgggaggggaagatgaagggagggaggctccatagaggggtggtagccgaattgagtcttaaagaatgacttggagttcccagagtgggtttgtctggtaggaggaattcttagcagaatgaatacaaattgagggagtttagattagatacaaatacaaatttctagtccttttttgtttcatccacaaaggttgggaataatacatacctgaagagcctgttgtgaggattagatgaaacaacatatttacaagtacctcacttggaaactgttcgaatgataggtgtgttatcaatgttttgttggtattaggacacaatccaacgtgatgcagatatgagccacccagatggtctcccaccttcctctaatcctcaacagcctcaaccaatatagaggggttccgtgttagtcagagcccaattgggtacaaatgacaaaaaccttacttggattactccaagtgaaaaaggaattttattggcccatgttactgaaaagtccaagagaatcccaacgaattctttagttgaaactattcctggtctctaaaaatcacttctgggtctaatgatctgcaaatgaccagcatcagaaattgaggagagtttaagctcacaaatgaatgtgtgcatgttttgaaggatgatttatcaccaccctaagcaaaataaaataaatacctttgtgggaacttatgagcaaggagggtatttgttgttgttgttgttgtcaagttacagggattcttttgtcacggctcctttgctactcatttgtgcaaactgtggagccccttctcagaatatatatttttaaaaatttgagacatggtcttactctgttgcccagactgcagcacagtagcgcgatcgtggcttactgcagcctcagtctccccaggttcagttgattctcccacctcagcctcctaagtagctggggtctacaggtgcatgccaccatgcctggctaattgttttatattttttgtagagatggggtttcaccaagttgcccaggctgatctcgaactcatgggctcaagcgatctgcctgcctcggccttgcctcccaaagtgctgggattacaagtgtgagccatcgtgccgggcagagtatttttatttttaagtgaataaaacaaaatacaaaccattacaaaggaagcaaaattatattgaagtataatcaaaatattaaaaaaccagatttgtgatatatcaagataatgcttctttactgacataggaagatttgtggaggatttaatactgccttacttcaaagtagtggtgagtataaatgatgttttgagacgtctgcaatctcagtattttgagataactataataggatatgaaaatataatttttattgatgataaattcctaggtagtagtagtaatagtagcagtagtagtaataatactgtggtttgcttcctacatttataataaaaggaggtgctaaatttcagttagatgttagtgaaaataaagattgttttgtttattttgtcattcatattcatggatcccattgaattctacccaaggacctcttgaggtaggggaaggggatgtaagcatcccaagttaagaaccccacactaaacaatgatccttttttagcatcaggtgatgcctgcaccaaaatggacctcaaacacatgacccagaggttaagggtctcatgttctcagagcaaactagtgggactttgcaaacttcgccttatagtggaggaactccactgtctcccgcttgaagtgaaccacccttttctgaactttcatgagatccatctgcaaacactgctgaaggaacatgtttctggctatagcagttcacatttcttgaaaaggaaataaaagaacactgagcaggaaggggaaggttttgagactcttgggtagttggagttaggtggagacaccttgctactttaactttaaaccttatatccctggggcagggatgacttggcagagaaacaccttcaagtcacttttttttttgagacactgtcttgctctgttgccctaggctggagtgcagttgcaggatcttggctcactgtaacctccgcctcctgggttcaagtgattcttctgcctcagcctcctgagtaggtgggactacaggcgtgcaccaccatacccagctaatttttgtatttttagtagaaacgaggtttcaccatgttggccaggatggtctggatctcttgacctcatcatccgcccgcctcggcctcacaaagtgctgggattacaggcgtgagccaccacacccggcccaagtcactttttaacatgctgtaacccccactttaaaaaaaaaaaaaaccactttttaattatggtggggccgggcatggtggcttaccgcacttgagtgggtcacttgagcccaggagttccaaaccagcttggacaacatggtgaaaccccttgtctacaaaaaataaaaaaacttaatctggtgtggtttcgggcgcctgtggtctcggctacttgagacactgaggtaggaggatcacattcaccctgtgaggtcaaggcttcagtgagctgtgattgcaccactgcactccagccttggcgatggcaagaccctgtctcaaaaataaataaataaataaatataaaatgaattatggtgggctttgaacaattgttctccccttgtttacactttctgattttgaatcagcactgaatgccagtatggataacctattgtcctttccatccaggagcatacaatcttttgggggagataagacagaagaaacacatagacatacaaagaacagaattagaaaacatgctgagctcagcgagagagagaacattttggattgggaaagaagaggtgcctgcacctaaaaccaattatgtcttgaagagcggatagtgtgcgatagaagatggggctacccttcaggaaggggacctgccgagagaagtgagaaagagagaataggcaggactcttttttagagccggacacttagtcactaaacaatctttgttacataaaatacttaaatcagcttgcttgggactttttctttcttggcttcactaatgctcttggtgaaacatctttttcctttttcttttttaatcaaatctaatgctcatgaaattttgtagaagaaaaagaaaaacgttctccctttctgagatagagggtttgttttgtttttgtaaacaagataacagggaagagtgctctactgttttggaaagagtgactcattcaataaatatttattgagcacctattaggttctcggtactacggatacaacagtgaattgaacaaagtttctgctctacagagctgtggggttctcgttgagcctgacagatgataaacgtgtcaaatgaagataagttctctgaagaaaaataaaacccagtaaaggggacagcattagaggatgggctgctctttttagtgcagcaattgggatgtctgataaacctcatgagagcagagacctgaatgaagtgaaggagtgagccatgcagatatccgtgaaaagacttccagacagaggaagagttagatggaaaggataaacacatataatcatttaatgttataaaattatgcctcaggtaaataaatgtagcatacattttatcgtacaaagggtcccaatatactatgacattttgcatatagattataagtattattctattataaatttatcttgggataataagatgtgtaatcaacattgatcaaatatttaacaataatttttttctctcttggactctagggtagggaaaacttttcatctaccctcctaggttatatactgggggcttgcaaattaaatgtaaaagacaaatgagcaacaaaaagacatttgtgggagtttacagaaaaatgtgacaggaggcagttagacttgggggcctatacatcatctcagtaggggaaggcggaagaggagaagagcatttgctggaaaccacgactttaggagagataaatcagcccttaagagactagataggagatgtggtagttttatgccagtgtctatttagttatggtaatgagtcgatcttccctggttgtgaaactccagagttcctttggggcacactgcttttaagacagatgaaggagtttagtaaaaagcctatttttaaatgactggctcaaaataatttttatgtcacagtggtgtagtctggacccctttagactttagaagagctttcagcagattgatttgagtgagctacacttctaagaaagtgaagcaggaaagtttgaactgatccctttattctcctccaagttcccttgaggcccacacagacatagccagttattctgctgactttgaagctgtgctcacagttgggatccacctttgaaaaatggctcctgagtgtgttaagtaagtaatggctagccgagggcttcagttgggaggactgcggagaagacttttctcccctggggtcctcaaaggggaaagaaatcacaagggggcagcatagggagttgtttggaaagggtgagaaggctgtgcttagtgttgggatacgcggatggatgtaagctgggttttgttttgtttagttttttaaacttcagctgttggaagtcctccttcccatagcttctccaaatcaccactgagctgattccccaaggcataaagacagccctgaattaacacagtggggaatgctaattaagtcatgccaataaagatttaatcatgaatcagaaacacttggaaaattatgttttcatattggaaagatgttctttttttctctatgagtaccccaaagtgtttttgaaggatgaaatgcgataggtggtaggacagaaatatttggttgacttgtccagtatgctaatggtgttggaacagggactccagtcttctgatatttcatctggttggtcttttccataaataaatatatcccagagcaagtagttctggggattgttataatatgctggttaatagcatggagaaactggcttgggcaatgttaagtaggagtttcagagcttttaatatatgagtactgagagtttgtaaaaggaccccaaacagaagaattttgggaaataccaatctataccatgctgggttgataggaccatctatattatacaagaatcttctcagatttaagtttcttctttttaaactgccattaagggcatgcagggaaggtgaaattttgttttaatatccatgtataccatatggcttattttggcaactaatatatgaatttgttcttggctgctttgagtgtgattgattcagcccaataagtattttctaaccaggtcaccacatgtagagttatgaggtaagtgacaaaagtccttctgaccaaatattagtcctgtatgttgtactccaatgtgctcacaagtgaattgaaatgttgctcaagagtgaattgaaatggctactacattgtgtgagtccggagggcttaatctgcatggtgtcatagccatttgggggctaaaccgacaagtgtgaggattgtaaactggcagggagctcaaaatgagctgattggtgaaacttcatggtgatctcgtaggttgcagcagagaacaatacaggcccagtcctcacatgcttgggacttaaggtgaaggtttgtgttggaggctaggtgggttacggacaagcagagaactgccacaaggtgctgtcagcactgggatggaggtgagcaaaggaggctaggaaagcataaaggaggcgtgcctggttccagcagagggagtagggaagtgacaactaaaaccagacctgaaggtgaagagcagagaggaatgttccaggcagaaccataggtgagagaatttggcatgtttaagagaaagctcccctcactgccccccaactccgtatttttgtttcatactctgcaaggagcaactgcactaaaaatgtacctcatgttttctattttacaagttactgccacatgcatggccttatttcctgtctacaacaaacctttcaggtgtcccaggtcacaaagtcaggaaaagagcctgggaactgcccccactcttcctagaatgtaaggggtgttgggccatgttccaaataccaggttcccactgagagtggctgaggataatgctaatctgggcagttttaagcaggaaatgagtatgtggagtagggaagtgcggagatcttgctatgtaagtcagagctatttttctcactactgggttgaattaaaaccagtttctggaatcacaatgtaaaacaagaggcaaaatccacctcgaggcacattggtttttattccttaaatgttccacataaaaaatgaaaactgagtcagtagaacagaatcgtaagaccagatggcttcccaggatcaatgggggcaagccattaactatcatctagttaatagaggaaattgcattttacagtgggatgggttctagagttcgagtggaagatgaaacttcagtcaaaatcatccttaaagtcccataggaaagtaccacattggagaacaacatgtaacacaacaggtatgtctttaaatagcagaagtgcactcaagatacccatactttgagaagcacgtggggactaagactgagcaggggcctgtggtcactgggtgaaatggtggcagaattgcccatgctgtttaaatttcactcttgtcttctttgtctccctggaagttctatatacaacagttacatttgtgcaagataaatacttgtatgatgtgactacactgcacattcttgatgctactcagagtgcacatatgagaatcatctcaatcatgattcatcacctgcaacttggagcacttatgccctgtgcctttctaccgggcttatatttgaaatctcagatttccctgtcaaggcttgatcttaccgctgcagatctgtttggaccactctgaaagagtatactttgaggtgccttccaaagtgaatttgatgtacaccacgtagcctataaggaatttttacgattttataggttcaatcagctgttgtaacagacactcaaaacaacagtggattaaacaagatgtttttctgtcttgtggaatattgtgggtcagcaggccaagactagcatgatggatccatgatgttgggacccagcctctttaatcctgttgctctgccatcttgaaggtgttgcccttgcccatctggttgcagatggcttctactaccacatccatgtttcatctagtgggcacaggggagagatggggcagagtgtcttccccctttaaaatcaggaaattgtgtacctgactattgctcacaatccactgggaagatctaacatgcaggccacatttacttgcaagaagggctgaaaatgtagactctatattgagaggcatatggccccctgaaaatgagtggttctgttaccttaaagaagagaaggaacactagaaatatgtgccatggtccacctctttggccatgaagacagccatgcccattgttcttcctgcccattgaaacacagcactcctttccagtggaggcaccccagattccttccagttacccagtcagtactcagtgttcatagttctctccatcaagcccatgtgtggctccttgtgtaaagttaaagacaaattatcaggccccctgtccccactacataactatgtataactatatatatagggagggagttacataactctgtgtgtgtgtgtgtgtgtgtgtgtgtgtgtgtgtgtgtgtgtaaagagaggggatatagttgtatatttacatatgtagaccagtcactagccataggagtgttcacattgtcgcattgtcctggctgggaatgcacactcctgtcctggcagtggagtaggtccacagggaaccctggttccaccctcagggaggaactctatccacctgctcatgtaaatatatttattgagtaagagtggacattggagaaggccctaaaagtccttttggggctgtacagcttatgtaacctgcttcctgctgatgaaagttggaggaaaagaggcaggggtgacttttgcaggccaggctcctggctctttcactgtacagtaccttcacaaatttagtagtcttctggcctatcctgatcagttccatgtgctggtaatcacagtgaaagttctcacctagatagttttgaaacctaaaaactttgacttgtatttattggatgctttgtgcctcccttgatttctctattactgatggctaccttgagacaggtggaaaagataggctagtacgaaggcagtatccttaatctgattttgctggtgggctagttcccattgtctgacagagaatcctggggaatattttatttattattatttattatttttatttttttgagacagggtctcactctgccatccaggctgagtgcagtggtgtgatcatggctcactggagcctcgaattctcaggctcaagtgatcctcccacctgagcctcagcctgggactacaggcatgcaccactacacctggctaattttttgtatttttgtaaagatgaggttttgccatgttgcccaagctggtctccagcttctgagctcaagcaatccacccaccttggcttctcaaagtgtcagaattacaggtgtgagccaccgcacctagccctgggaaagattttagacacagccttctctgctaagcctgctgcttactgtatagctgatttaacttggtttcacaaatagttgtcatctcaactctgtgatggcacaaattcctggacttggacggtatcatttgcaggccacagtaaaaacaaaaaacaaaacttcccttagcagaacccaacctgcctttatttctctctgcagaatggccagcccttgcctgagctcccgtctttattgtagcaagaggtagttgacaagcactcatgttctgaattctgccaaccatttgtctcaagctacaaatttggttggccagtggtctgccttccatgctatcagaggcaacaaatttttccatgccataaaaagcatgctgatgccaatgttttagattctgttttggtacagaataccaacttttttgttaaaatgtaggtttggctgctgttagcagagtttccaaataaagtacttaaaagttgatagtaatggaacccttcctttcatatcctgggtgtgggcagtccagggctgatgtgtggctccattatacacagggacccatgccccttttcttctgttgtgcagccttccctggagtgttgctcttatctaggtccgggatggctgcccaccaccttaccttcatgccagctaacatgccaacaggggagaaagatggaggaaggcacacctttctcagagattgaacatatctgttgcactcatgtcgcattaatcaaaacttagctaagcctacctctagcagcaaggagggctgtgaaatatcagtcttattctgggtgtcatctgtcaagctaaacattggggatttgacaaaccaaatgaaacagagaattgatgttgggaaacaaccaatagtttatactgtcctaagcattccctccaaatctggtgaaaatcactgtcattttcaagtggtagtgttacagagagaagacagaacttaattttatatgggcagctagatttttggaagagaccttggccgtcaattattccaaccccactttagaaaggaaccaaggcacaaacattgccattgtacgagtcttaaactactttattgaggtatgattcacatactatataatttacccacttaaagtgaatcattcaatattttttagtctattcacagaactgtacaaccatcaccacaatctaacttcagaatatttccatgatcctaaaagaaaccccttacattagcagccaatctcccttgcttccctaccccttcagccttaagcagccgttagtctactttcagtctctacgtttgtgtgggtagactttacatggaccaaatgtccagttttggttgccaggcaggggaagttccatttaccaagtgaaaccacaggatcatgagaagcaaagtaagggctgtgtcaggagcagtggaattagtatcccatgcttctgtgtgccttgtcctgagcatgggagggttaaagatgtcctcattcgcaaggagctgccagttgaatggggaagattgacacatgcaaaaccagacagtaaccattaggtattataaaagctaacacagaaggaaaaagagatggtcatgggagctcagggccagcctgggataggcgagtgtgcctgggatgggtggtgtgcccagcgaaggcgttctgcagaagataagtgtgtctttcttggcagactctctgtccacagcagaccaggctgtcaaaaaaaggaggcgacatttctccagaatagcttcttcattttcgtgagggtaagcaatcagatttctttttttataaacatatttgaacttatatatccaaattagtatcgtaccctgccaaatcgccactctgggaaccatgcacgcactccagtgatgcgtgtagtgctcaaagcatttgaaactcctctatgggaattatctttcagccagtcagtttatgggtcacctaggaaaaccagtcacattattttatagtcatgcctcatttttcacctaaagcgatgtaacaagatttgatcacccactttattcattagacatggctccagccaatttttgtctttttccaaagttcaaatctattctcaaaggatgagatttgtcatgactgaggactttcaaagaaagtgccgcagacagtaaaaacagttacccactaaaagagttagagaggtgtcagcattgtttgaataaatatgttgtttcccaaggtgattgttttgaaagagataatgctaattgagatgaatgtactcaactggcataactgtttaaagggagttactgtattttatactgttcaagcacattgacctgtagagaggagcttaagagacagttcttgctgaggcagagtctggcattctgctttctgcagcctaccgcagtggcctggggatacagttctcttccattctggtaaacgtttaaacctgctttggtgaggcatttaggagctgtacaaaatgggaaggtttgttaaaatataaaccgacaaaatggccaaatacccggccctgaccgaggaagagagtcctgtcagctctaaaccatagaacttgaaacccaaatgctaagccagtgcccacctcgactgtgtgaaattgtcccctgacttcagaggccagaaaatggatctgggatggtataactgggtggggacagggaaaggccttttgatttagcaataaaactattaggttataccacctccatggggactttgaaaaatgcattctgtggaacaagatgaagtgctttttaaaggaagattttgaaatgaagcaaaagggaaatcagtgtagaaaactcagatggaatcagggataagactggcacctgtcatgaaagcccagcttcctctctgggctgggccacacagttcactctaaccgctttgtggtcaaatccatgagaaaatcacttaccccacagtttgccatagacagctcctccatatgtagaagtggtattcgaaagagtaatcgtaatatctgccttgaaagattcttgtgaggatgaaataaaatttgtgaagcacttgttatagggcctgacattgtaactggttagtaaagagaagattctgatgattctatgattattatgattattccaaatactgaggccattggaaggcagagggaggggataagaagatgggcctagggagggtctttgtgcctcttaccaccctcactttttggctgtcctatcctgcctctgtccacacattatcccttggactttttctgtcaggcagaggttcacagttgctctaaatctcagccacaggcccatcaatctgagatcttcacctgttttgagtcaccagctagcagtggctagctaaggatggatatttcaggatggatctgtggaatggttactgggcccaggccaatgtcttgctgcagatgggaagctgcaagaaatgtatgctggcatttctggaaacctcctgggacatgtgaatgtgttcatttgacaagcattgcggaacacttttgtatgccaggcactgtgcacagtggttgggggtacaggatgagtaagacaaagtccttgtgcttagggtgctcatgctggtgggggagacaggcactccatgggtagttacaacagggtgcgaattctattacagtcagtccttgacttaccatggaatgatgaattacagttgtccaactttacagtggtgtaaaagtgatacacattcagtagaaaccatactttggattttggattttgatcttttctcaggctagcaaaatgcaggatgatactctaggagtgagccacacctcccagtccaccacgcggtcccgagggtaaacgaccaataatgtacaatacagggtactgtatttaataaattacacgagatcttccaacattttattataaattaggctttgtgttcaatgattttccctaactttaggctaaggtaagtgttgtgggcccatttaaggtaggctaggccaggccatgatgtttggtaggttaggtggatcagatgcatttttgactgatgatattttcaacttacaatgggttccaaatggaagtcagaccacttggtggctacctaattttaccacataacctcagttcatagtagtgggttggaagtgaagactttgagattttgcttcaaatttcagtttcataattaattgtacaatatcatgtatactgcttaacttatctaaaactgttttctcaccagtaaagtgggattaattccaatatatgctatatcagagaattttatgaggatagaatgaaataatgtacatacaaaggttttgtgaattctaaggtgccactcaaatatgaattatttggttgtttttgaaactgtaatgttgcttcaggaaagtcattccactggactaatgtaagcctcttgccaaaaacaaatctctacacacagtttcgtctagttctctcaaagtccaaaattcagatgtgctaaagaataataaaaaaaaaagttacaggcgttttgccattttgagaatcttagtggaatatcaaaattacatcttttatgttaaaatttatgttaaaagtatatataatctttggtgtgagatctgagtttgattcctggacatggtagttattagctgtttaatcttgggcaaattgcttgagctgcttctttactcatttgtgaaattaatatgttgggggttttgatgggaaatacagacactttaaacttcttgcaaaaggtttcccggccattaccccctcattttaacttctcttcttcccagatttgccaatgacctgtcaagatgctctacacctattagcttataaatttcagaacagaaatatctttcttacagagagtgtttcatgcacagagcctggggggagggagaactgttctgtataactttaggttttcagtaatatgtcgtcagcctgatacttaagttttctcaaaagaacacagcagccagccccaaagtaagcaaaattgatcctgagtagcttaagtactggttacggtgtttggtgtttgtatgccaggtctaccccttatggttttaggatagtggttctggtgaatagttgattaggtccacttgctccagaaatctccgtgaataagatttgatggggtgctttccatccctgaaacatttactgaatgttttcttattgcttaatacagtgctgtgtatttggggcatgcagtagtgcataaaacggtctccgcaagtgggcattgcaatatagtgtgagaagtgcctcgttagggtgtattgggggccctagggaggggaacacgcaggggtggtcagaggaagcttcccaggggagatgtgtttaagccaagtcctgaaggatgataaagaggaagccaggaaaaagtgtagacatgggggtatgaagaagacattctgtgtagtgggagcagcccttgcaaaacaaggagatccttgtagaaagtaaaagcacagccttagactgtaaagtaggactcatcctaactccagcattgcaggaagggaagagggaggccgccggtgactcagctgccttaacccctgaggtcacacaggtccttaacccctgaggctttcttttatacacaggccaacataagacccagtctgggaattatcctaaggcccagcctgggaattctcttatggccctgagggaagggaggattttggagacaggatcaaaaacctaaaaagctatctgtaggccgggcgcagtggctctcacctgtaatcccagcactttgggaggccaaggcaggcagatcacaaggtcaagagatcaagaccatcctgggcaacatggtgaaaccctgtctttactaaaaatacaaaaattagctgggtgtggtggcacatgcctgtagtcccagctattcgggaggctgaggcaggagaatcgcttgaaccaggggaggtggaggttgcagtgagccgagattgcaccactgcactccaacctggcaacagagcgagactccttctcagaaaatgctatttgtaaggaggattgggttgaagtatttgcccagtaacatattaaggctatcaggagctggacgtggtggctcacgcctggcctgtaatcctagcactttgggaagccaaggtgggtggatcactttaggtcagaagttcgagaccagcctggccaacatggtgaagccccatctctactaaaaatacaaaaattagccgggcatggtggcgcgtgcctgtaatcccagctacttgggaggctgaggcaggagaatcgtttgaacctgggaggcagaggttgcagtgagccgagatcacaccattgcactccagcctggggaacaagagcgaaactctgtctcaaaaaaaaaaaggctctatcagtttgctctgactctctttctttaaccagcaggttacgtgacacgtgacaccatctgcatgtgacctactgtcttcactgggacaggccttctaacttgggtcaactggcctgaacccatacgtagaatgattgatatatagttcactaagttaaattatacatttatagacgcaaaaaaaattttgacatacagtgtggttgtgttgtatcctactgctctaatattaggaaaggggctgggatgctaggtcagctgggaccctctttttctcgcttgcattcatctctttttctctcttactctcaccacttttctacctcatgttgagtagcgccatgaagacccctccttcatcactctgcctgcagttatcctgggaagcaattataagctttcagcctcaaccatgcagactaactggctctacttccttcactattgcagtttctagttctgttcgtaattgttgcacaagactttgtgctattgcaactacttggaatgccagttccaggcagagtgccctctgttgtagacaccttgtgctttgggaagttgtctgtgattaggggagtaattttctatttgaggttggtctcaggaagggaaaccactcctgactcctgcctgaaaactcgcctccttgctcagaaacactaattacaggggtcgtttgatgctctcacttaaatattttagtcactcacacatttattgactatctgtatgtgcccaaccccattccaggtactgaggttaaaaatgagtgagatgcagtctctccataccacagagcaaaggaggaagcttgtttgtgtatatggagcatggcccatgcagggttacttaatgctagaaaccaaacactctgaggcaaagaaaaggtgtagggggttggggggcagggtagaggaatagtctacccagactgcctgtcactcagaccagccactctgctgcaaaaggagttggcttatcttttttttttttttttttttttaagcacttagcagtttcctagggctgctatctgctgtaacaaactgtgtggcttaaaacaatggatatttattctcttgcacttctggcagcttagaagtctgaaatcgaggtgacagcaggaccatgctccctctgaaggctctaggggagactctttccttgcctcttcctagcttctggtggtggctagcaatccctggtgcagtgtaacttcaatctctacctctgtcttcacgtggcattcttccctatgtatctcttctgtctctgtctccaaatttccctctcctaaatcctgtcattgaatttagggccaccctaatccagtatgctctcattgtaacttgattacatctgcaaagaccctatttccaaataaggtcacatccccaggttcctgggttaagacttcaatgtatctttttttttttttttttttggagggggcgggagtagtgcaccattcaaccatgacatctatactctgtccaccaaatgcaggtgggttttgtacagacaccaaagcacatatactttgcacttgggcagtagccctttgggagtcacttgggatctatttcctcttaattttcttcaagtttaaacaaatttgatcatccaaaggagccatacatagcccaatgatgagaaacgtgagctttggctttaaaactggtgttgaagcctgcctttccaatttattgtgagtcctggagcaactcgtgtaacttctttaatcctcagtttccttatcagtaaaatgggaatagtgagaatacctacaccactgagttgttattaagcctgcatgaaaacctacatgtaatgatattcactgtgctgagcactttacatgatctcatatagtcttttcaacaactcttaattgattggtatttagacttctgttttacagatgcagaaatagaagctaagtgattcgcccaagatctccaagatactaaaaagtatcaagagttggaatttgaacctggatttccactgtgctctattcctcaagaccctttttaatagttatgtagcgctacagtctaggggttcctaaactttttaaggaaagtccaactttttatatccctaaagccttgctctcactgaagccttgattgaggccaagagagaatgccttgctgctgcccccatgagccactgcccatctaaggaattcccacagatgcccacatttacccacatgctttaaaagctcttgtttattgagtctttgctgttcacctggctgcatattacattacaaggcaaggtagcatgatagttacatgtctgggctctggagacagactgcgtatgacctggtgtcttcttagagcaagccttctaacttgggttggctgaatcaaatctatatgtaaaatgaatgatatacagacagttcactaaatcaaagcccatctccacaatctacctgacctcggacagatgacataatctctgtatcccccattttccttatccctaggataagggctgagaataataagcccctatacagttgttgtgaagattaaataagttaatgcttgtaatgcatttgaaacatgacccagcacattgtggcctactgaatttatcttctactacctttgagcaggcatcattgtccttactattttacaaataaagaaactgaggccagaaaggccatataccactagaaggttcgagcaaagcaaggattcaggctcaggcctgtttgactccagagcccagtggttacagcagggactgtacttgattctttaaatcctccttctgctacctgtcccattcctccagtgcctggaccattggagatgtttaatcagtatttatccacagataaacccattgcatctatgccctcctacctaggcttacctgctttcgagatcaggggatgtgttagaaggatgtgatcagtccttatcaataccctttctgtttttagtagtttggataacatttattgagtgtctactatatggccaggcattgtgagaagcatttcacacatacctttcctcatttactttcagaaccttctaaaggaggcttcactctctgcattttatggaaactctggcttacaaggaccccatcgaaaaggatgttccctctttgtggccaccttctttcatgtcctttacagccggacatcctattttggccagaccatataattgaaaatgatcttaataatgagacagacagaaaataacctcaccatttctctcctcttcttcttcttcttttttttttttttttttttttttttttttgagacagagccttactctgttgcccaggctggagtgcagtggcgcgatctcgactcactgcaatctccgcctcccgggttccagcgattctcctgcctcagcctcctgagtagctgggattataggccctgccaccatgcctggctaattttgtatttttagtagagacggggttttaccatgttggccaggcggatcacttgaggtcaggagttctctcctcttcttaaaagccccagagtcccaccatattttaattatttgatggagggccaaccactgcctgccacaaaacttaaaggggcacaatttcccttgtgatcttggtgaagggagcccatagagttgtgcaaggctgctctgggcagaggtgagtgaagcactgccccttacgaggctgctggcaatcttgcttgtttttccattttccaccacaagagggcaacatatgaccatgaatgatttgaaaataaagcgattccttaactggttctctttttaccaaagaattttaataattgtgctcctggtaagttagaatggggaaagttcttctgttagcgccaagtgaatattcttaagggattgaaattcaaattgtcttgagaattctccaaaaaggaaataaaagacatagaaaaatgttatatgaaccacataaatggctgtttttataggtcaaaatgtttgaatatgggtcatttctgataaaacaggagactccttcacacgtgccttacttatgaaaaggggttcctaagccttgcacatcttcaaattgaggagattgttttcagacgtaaccacatgggttcagaatggcaattatgcagatggagaatgccttccatggcttcttgtctgccctgtgagtgctcatagctctcttgtaggctcccagatgagtactttttactccattttaaaatgatttgttggcttatctatctctccttctgcaccaaaagtttcttggcaacttgagtcttcctgaggtgtacagtgcctggtgaaatgaatacaacacatcggtctatataggacatattgggtagatggatgggtgaacagatggacagccaactgacgcgtgctaaaggttgtacactctctgaggcagaggcagctgttatgtttgtttttattttcaaaatctacttcaggagtctctgtgaacatgggattctgtagagctctaagccatctggcccttgtaattcttctgaccttgtaccttcttccaattttaatgtaatttctccttttctttagagaacatttcctaactctactaaaatgcacatagccaatggcccgtcccaattgttgggtatgaaacacgcctgcttgttttcagattcagagcagtgctaaaggctaatacttacgcagggcttgcaaagcactagaaccagctggtgctaagctctttacatttgtaaactcctgtctcttaatacaacaaatctatgcagtagctaccactttcaatccctgtttcaaaggtgagaaaatagaggcacaaagagcctacatcccttgcccacggtcccctagtcagaaaatggtactcggcctgtctccttgctgtggactgagggagctcaaaggagaaggggaggaagtgttctctcttccttttcttgcctgtactggacagcaggtgaggcctggctcacagctggcaaacaggacccaggtactacggagccctggtcagccctgtaaagagatgtaagcagctataagtagcagaagcccaattagggttcagtgagcccctatgaggcctgacacacaaggactgcacacagagagaggggcgtctcctgcagccacaggcagtggtggggcagatggacttcaagaccctgagacacattttgggaggccaggcgggcagatcgcttgagatgaggagttcgagaccagcctgtccaacacagtgaaaccctgtctctattaaaattaccaaaattagcagggcatggtggcacacacctgtaatcccagctcaggtgggattgaggctgaggcacgagaactcaggaggctgaggcacgagaattgcttgaacctggaaggcagaggttgcagagattgcacaactgcactccagcctgggagacagagtgactctgcctccccacaaaaaaaaaaaaaaaaaaaaaaaaaaaaagaccctgaaacaagaggaacccaggcagcgtctcctggttgtctcagcacatctgtttcattttcctctctctctgctgacccatttgtcaatggaaattaggtttctcagtgtgtgtggttttttttttacaaactcatttaatcaagcacctatgaatatttcaaatttttaagtcaaatatttgttttcttttaaaattccttgtctaataaggaaaacttttcaagtattcaagttgttctcatgtaatcaaataataacagcagatccttgtacagggcatactatagccaccctggtttcagaactatctgtaaattgcttcattcaaacttgactacaacaagtaaagtagagctgctatcattatctccatcttgacagatgaggaaatggaagcacaaagaggttaagtaacttgtccaagatcatattactagtaactggtagaataagggttcagaccctgtcactttggctttagaggccattccctcaagtactatagtatactgtctgcatgtgatgacttaaacttataaatataatacagtccaagttttctggaatgttccactaatgtttataattttgataaaattcttctcataaaattcttctcatacctccttaaacttaaaatcctgtctaaataagtaacacaacctgcacttaattataaactggaaccacaaggctaatctttagataaactaatatcccacatttcttaaatgtatttcaaatgccaaatatacctagttttcccccccttactccaaaaatattaatactatgttcattttattatttgtatcctatgtgatatatttcatcatctgtacacttaattttaagagagtatgttttaaaatgcctacttaaaaaaccattctctcacctcaagtgatgaggggttacctttccagttgaattggggtgacaccagctgggtgaggtgtggctcggccaagggtctggatgtggaggcaccgagtccagaataccagcgccaaaagggattctccagtggcttgtgttcccagcccctgttcccgattctcaggtctgatgaatctgcaagccctacctacgtgagaagattcatctaacctattttctgcttgatactatttcgaattcttttctgattcttcccgtacatcagatccacaactcttagagatgtatgaatgatcccgagttggatcctgcatagctgtcacggactctcacatattgtcaggctgtcagcagcagttctgtggatattctcatgcctcaactgttcttgccccacagctcataagtttacctgtctttctggttcaagggctaacctaatctggctagtacacttttgagtcccaattctagattccaaggagagaaaacatgagtggtccagctttagtcaggggtctaccccatttgctcatggcctggagtcagggtcctggagtagacacctggcctcaggccttcactctcatggaatagttgggggacagttctcagagaagagaggagatgagtagaaagcacagtatggaaaaagggtcagaggaaagaggttgttcaaggagtatcttcacagtaggagaggaaaaaaacaaaagcagtgctcaaactgggccaagaactcagagttgaagttgtgtgtagaaagctggcagaggaacagtgctggacaagatcacattgactgggaccctcaaagccaccccagctaaggatgggaccctttttgcaagccttggttaatctttttccactcttatttctccaagccattcaaggcatcactgccagccagtcaactttccaaaaacatattggtttatattctttttgcttacaaatttccatagttccccagcactttcaaaataaagtttagcacggttcacaaggctccatagacttgccccaactatttctccagtctcatccctgtcactgcaacctcttcagagccgcagctctgtaaacacaccttcaggatagcaccaaggccatcccgctatgatggctcctttctgatgtgaacttttttgagaacagaggcccatccacctttgtttctatctccaaccccactcagaatgtgagaaaaaaaattgtatctttacatcattttccagttcataaaggctttcctagacattaactgaggcaatcttcgcaaaaaccttgggagagaggtattatttcatgaagaaattgaggctcagaaggacaagggggctgacaatgaccgataatctaccttataccaggcacagtactgggtgttttcacatgtgacctgttttcagttttctgaacaaacttcagagctatccccattttataggctcagatgagttaagtaacttgctctagattgtacctctcatacattttacagtgaaagatttgagccctagttgtatctggctgctgaacctgtgcccttcccgttagaatgtagtgccttgcctggggctgagcatttactacctgcttagttactggtggctggagaaatgaataaccgttttccactcttggggacaaacacttcaagccctctggaacaggcacctgcagccatcacaagcatagggccttgggctggagtgtctgattaaccctgctgctttaagccaaatttctgcctttctttctagtgcttatgcctggaaatagggttatcaggctcatcccttatgcccactcctgggacattagctaagaaagaattcttggtgtgaagaggtgaacccattcaggccagccctcacatggggcctgggacaccattattaactgtccattaaatattttttaaagaaacatagaaaagaaagagtgaataaaggattggtaagtctacggtttctgctatgctctactgggaaggtatcactgctgatgcaaatggaagctggagtctttgcaaggctgggagcgaaggggttcataactctgccattgtgaaattgattggacccaagaccagtatgaaagttccttgtctgaagggagtaatccttaaatcccccatatggtttaaatgtaatttgtgtcattgtgaaggagtactggcaatgcaggcgaattcattaggccaaattgggttcgctatgctcgacagtaacgtttctgaagatgaagttcaacctttgctggagagctaaaacaaatgagtttcttaatagctgccccacttagtctgagtgtcttaggaagcttaatgtttttaatgtctcttcttttttactatacttcacagtccatctaacattgctgcttctggtaatatttttatatggggttgagttctatagtgttcataaaattatgatcaggcccatttttagaatagaagcttttctagggcaaggattatgttcttttggtatagttttgcatattgacaaacaccatgcctggcatgtgtcgttgcttaaaatgttgctctcgtaattctgccctcagaaagaacttcaccgagagactgggaggctgccagcagagactatgctggagtgtggtgtattatgtgggcagagaggctttggtatgggatgtgggaatatccttgtgcccaagtacccccaaatttaccctgggatttcaagatctcattaagaaaactaccaattatgtggttggctgctctgttattccaatgaaaagattattggaatgatattttataaatctggatctattatcggatatgtcaagacacacatgccagcctaattcacaagcccatataaaaccagggaaaacttggcacagaacttacaaaataggaatttaaaaaatcatttatagtacgttgaaaaacagtggttatgtaaactgttaataaagcatgcttgctttttcaattaatttctaaagaatttgacttttaaaaacaaattaagagcccaaaataagctataaaaagtagtcgtcttttggctgactggttttcaacataatagatgtgttttgtgaattgtgttaatgttatgtctcgaggtatttcctgcacatgggccaggcccatttgtcatttgaaggggctcccttgccagtggcctactttctgcttgtgagcctgttattcctgctggtcttgtgcagagcagccccggaacacagcggcattcttgacagagggcagttggcagctaccagtgcctgtctactttcggatgctacttgacaagttagtataaaaagactcagattttgttgctcaagggatgattcacttttcccttcaaaaccttaattcctcagtgcatgtttggtctgttgtccaggctggaatacaatggcacgatcttagctcactgcaatctcagcctcccaggttcaagcaattctcctgcctcagcctcccaagtagctgtgactacgggtgcacgccaccatgcctggctaatttttgtatttttagcagagacagggtttcaccatgttgaacagactggtctcgaactcctgacctcaggtgatctgcccactttggcctcccaaagtgctgggattacaggtgtgagccaccatgcctggctgagaacacacatgtatgtatttaaatagatcattaataaaatctcagggatcaaatggaattagatatgaaatttatttaggtaaaatatttttaaacatcctagtttcttcaaatacaaaggacttaaactgcttccctaaaaacattttattaaaagtcaagtatgcttaaaactgagaaaatgttaaaaacgaatctcatgttcatattatttttctaaataaaaactcgatccaaccctgtgtactcagaaaaacatatgtatattttttccgtgttttgcttacatttttaaggacttggtgcatcctcacgcctgtttttttgtatattcaaaggaatgaccaagctgttggttattcagggcaactttggaggtatctgttcttctagaactgaacactgttttcttaaatctttggtggccaatgaataaatctgttagataatttttttcctgatagattgcatgtgtgaagtaaaaataatttcttaggtttcaaaatgacagtgatgtaagaaaaccaggggtaaattaagctccctcacttccattttaagattgacctttaacttgctaggtggcatggggcaactttagctgcagatggccttctcagagatgaatgcccagagaggctctggtttaagggatggcaggagcagtgagagccacaccagggtgtcttgttcacaaatctgcttcgtgggactgcatttgccctctttgcctgggctctgagagtggagcctgtcagccacctggtgtttacagctgaagttggctgcatgcagcactccttggagctatctctaccctaacggggaaatgagacaaaaataattgaagggtatttggcttggttaagtgggcagaagtgtcctcatcaaaacaactttgaagacctgctttgtgtgtgggtgcgagtgggtgtgtggcccttaacttgttcacaagggacaacaacaacaaggaattaaccaagctttctcattgagagtgatcgtccatgcaaaccctctattttagttactcatacgacactgttgcagcttcaggttggacagacctattttggagtcccttgactgctttctggacaccctcactgagccagtcggtggaagtgaaggatgagtgattttgaagaatggatttctgggacatatagaaaaatggaagaaggtcctctccctctgttgacttttgctacagctccctaccacgatcagaaaccaggaacaagtggattacggaagaaaacctattattttgaggaaaagccatgctatctggagaatttcatccagagtatattcttttccatagacctaaaagatcgccagggatcatcactggtggttggtggagatgggcggtactttaataaatcagcaatagaaacaatagtgcagatggcagctgccaatggggtgggtatatgataagtattgttatgtttctggctctccaaataaccttaattttacagaagtatacaaacgtacaaggatttatatgtggtatacacttcaattctactaacatccagctaagtttcattgtaacttcagtgattgtatattgtgaaaatacttcagaaattacattagccacactgggatacaggaatgttaagttcagcttcttaggtattatgctgtgttctgttgcttgacaaagtacctgttgctttttagacatttaaagcacactcccggtcttaagctgttttatctacattctaactagcttcaaggggcaccctgtcctgtgtaagagggctctactgaatggtggagagaagaggattttgttttctttcaatggctttcttgttgaagttcagtcacttgtcaaacaggaaaacaaaagccagggcatgctgttgtttatggatcctggtagtcacgcagaaatgctaggaggggttggaaaatgttaggtgtgagccttttgaggggacctgttacaggggcacctgcttataatgaccttggacacaaagaagccgtgcgcatggtgaatttgtgcagcagggtagagataataactcctgtaagactatagtatgaggcggctctgctaaacctctgcatcgtgaaaaaccgtgttggctggattaagcaaatgagaaggaatattgtaccagaacgcattgatcttgataatctaacaattcgtgcagcccactggtttccaggaaggtgggcatcaggacattgatgtttttgctctgcaaattcctcagtgggaccagaaatacatttttagtgttttagataatgattagcaattagttggagcacatagtccttcagtacctgcaaattttaaaatctggtgtatttcttttctggaagagattctgattcttggtagataaaatgtagtattgcaactaagtgtgttagacattcattttcagtgtattttcaaaatatgctgagcaggtatgtttgcagaagcaaaattaaagcaaaacaaaataaaatgtaccaccacactaaattttaaagtgtttgtagatcctgttgtttataattagagttttcctgatactcagtttcagaatctgaatgcctctcatgtaaaagttgctgataaagcactcaaatatgaaattattatgaagcatacacatttttaagataaaatgtgacatgccataaattttttctttgaggagagctgcaaagggaacagtattaagatgcttttaatcttttgagagggaacgaatggaacattatttctccacatatatctagactgttgagtggatctggtacactgtcccctttgctgtgatatatttggctccatttcatttttgtgtggagctgaagaatgtggaagaagtggtaggaatgtgtaattcaggcacaccctacagactttctcagatttgccctctgaaggtttgctaaataatacatttaagtgataattgactaaatatggtagctgcctatttgttagagctgttggcagcccaagcaatattttcaagtcttttcaaggtaagcttagaggtgagagccaccttattaaaaatagcactgcatttaaaacagtcatgctaaccaactgaattgcttaaaatattagtggactggataaagcacttcaatcggatgcgctttaaacctgtgaaattctaaagggtttgatttcttctctttctaacatatcctaaattctgactgttttaacatgcctttgattgtgggtgggactgcagggaggaaatctaaaggaaggataattattaccacagattttgacaaaagtcagtgctcctttctcattttctttaatacccactgtgcccataagctgattcttggagggcttttcagcccactgagctaaatggagatcattttattttttttccctttaccatactttatctggtgcatttatgggttataagtttctcttcattttttatttacatagagctctctgcttttaaaggacgttttattgcacaaaataagatattgacgggccccttttagaatattgatatctcattcagtccccagagctctaaactgagaggtaagtttagaggtaagagcaggacccatgtgcatgattacaggacaaagaaaatggaacttgttttttaaataacctaagaaaataccaagccctgttttcaattaaaaggaatatttaaagtttactccctgccatgtttgactattagatgtttggagaacaatgagatacccattttggtggggaggcgtgagttttaaggaaggaagtcgtgggaaaggaaggcaggcaggggaggccatttgaggatggactcttagtgcctggctgagggggttatctctaacttgggagccaggaaaggtaaaatgtacataacatcagatttaccattttaaccattttcagtgtatggttccctggcattaattacactcacaatgttttacaaccatcaccactatccatctccagagccttttttaaaaatcatcccatacagaaactctgtacccgttacacaatcattccccatttccactcccaccagcctctggtaacctctgtactactttctgtcttgatgaatttgcctattctagttacctcatagaagcagaatcagacaatccttgtccttttgcatctggcttatttcacttagcatgatgttttccagccttatccgggctgtagaatgtgtcagaattttattccctttttttaagttaaaaaatatttatccttatgacctggcagtcacatgagaaaaaaaaagaaaaaaaaaattatcctatatatgtccttccaatcacatccatatctatagattgcaatgtcatctttgagtacagtgacaaattctttaaaaagttttagttgtggtaaaaacatgtaataaaatttaccaccgtaaccatttttaggtgtatggttcagtgatggtaacaaaacattgttgtgcagcatatctctagaaagttttcatcttgccaaactgaaagtctgtgtccattgaacaactccccatctttccctcttctgagcccctgccaaccaccattgtattttgtgtttctatggtgttgacttctttaaatacctcatgtaagtggaatcatacagcatttgtcttttgtgacaaatgctgtatgacaaatttcacttagcataatgtcctcaaggttcatccatcttgtggcatatggcaggacccccccccccccacacacacacacacttttaaggctgaataatattccactgtatgtatacacaatattttgtttatccattcacttgatgatagacgttagcgttctttccaccctttgacttttgtgagtaatactgctgtgaaatttggtgcttaagtgtctgtctgcgtcctgctttcaattcttcaggtatatacctagaagtggaatttctgggagggttttggagtcagaaaagggacacagaattatgatttagaaagataaactagatgggtttgagtaggtcagatggatccagccagggtcgagtaagagagaatcatgtgggacagaggcaggggagattgagttaggagctgttgcagtggtccaggcatctttaagggaaggagggtaatagagcagtgtctctcctgtatcagatcgagagcaatattcctgagggtgattcccaagaaagagcctgatctggaaggggagttcttccaccagatgtacctcttcttgggctcaagagagaagctaccttgcttctatctctcaactttccttcttactcttacccctggcataatcccctcagcctggaaccattgcaaatctcaccataaggaatggtagaattaaggggtgacatgggtggtgtagcttaatatcaccagcctctccttccacaccaaatacaatctatataaaaattggtatgcttggtgtgtaaatacaactcgacaagccacccctaaacccctcctatggacattctggaactgcccgaacataggcttttattctcatcacaaccacacctggaaactgctggaaggtgaaatgtcactgtgttgagtcaggacgtttcaatactttcccccaccatggccgctaatgtgctgtgtggccttgtcgtgtcatctacgccagtgtctgccatagtacctttccattaatgcttgttattattgctgctggatggaggcaagaatgaatgaatgggcaggatcatgataactctggacctcagcttcttcatgtttgcagtggtacttgggaagagcaaatgtgggaatggatcaaaagtaccatgggatgtagaaagcactctgtagctcagtaacaatcatcggttttgatttcacactatctgcaggttcctgtagtctaaaaagcagcctactgacagcatccaccctggtggttaccatttcctggggaaggcaggatataaccaatatattaggggagctacaacaaaaattgttcggagattgacatatgagagccaagaggtaactgaagggaaccaggtgctccttgggaggtggttggtagtggagtggttgacggttttcaatgggctatggaagggtggcagagccaacagtcccagagaaactctccccagggaatccaggtatctcacggacattttcaacactagaaacacatcttccaccatcaagttgtttcttcaatcatgtttatcttgggtgaagcaaaaagaaataacaaatggaaaatgtaaaaaaatccctgttttttaagaggaactgacagcacctcaaccttcttttccaacttgagtcatgttgaaacagatataaattactgtcattttagcaaaaaagatttaggagcagtactgataccatctgtaagagatatgggaaggtaagttaagaatgcaacagaagtcccatctgtcgccctttcatgtaggtcattctgactggtttactcaggaataactccagcattcttgtcttaggcccaggaggtaacccaggtacactgtaacagaagtaggtgtgtcttgctttgaggaaacccactatatgaaaaagccaagcttgactggaaagataaattgatgagtcatttttcaataatcttgatataaaatttgccctttttactttaaaaaagccttctctttgggtagaatccctttaattagctaaaccttttcttttctcccgttgtggattgaaagtatgattgaattggataaaaatgtgggttttctcatattctttcaatgcatccaaattgtggccccgatctggaaaggctctttttaatatgctgtgttttcatgctggagccttacagtgcacacagaccacacacttctaaaactacaaagtcccgaaaaccatctgaaggaatttgttcaacattgctgattctatttcagtaatatggtggagacatccaagctgcagatttttattaaataaaatcttttcttgtccaacagattattactattatttttttgtccatctgcctgttgtcttggtgttgtttctgagcggtgactctggatgtattgatgttaaagagtgtgttctggatttcttctcctagatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtgagtttgctgtcattttgaggacaggtaagtttacattcagtaggacaaatcaatacctggagccttgggagaccagggttttggttctgatcctttgcagggggtagggaggtgctctttgcttcctttcagtgacagtgaaatgcttctcatttgactgtacctgaatatgaagagccatgcgcaaatcttccttaacatgatattttcttttagaaaaatcctgctactttgctgactgaatgatgaaatggtagatgtgctagtgaagaggaactgatgagctttggattctttgtatttccatgtgagctgcacgaagtaacccactgtttgctgtttggtttccaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacaggcatgtttactttcctcctctttctgcccactcctatttccaagttgagcgattttcctttcaacgttttagtagagggtcttcagctttggaaagatttccgtgagtgctctgtaagctttgcaagtgttagttaattaacaagtctggaattaggtttgggagaccagagacctgggctccctgggccctgccagggatcagctgcatgacatcgagtaagtcatttccagcactctaggcctcagttttcatgccttgactagaagacctgcaggattacattcatagttaacttttattgacctcttgctacatgccaaggtctttacacgtgttaatccattttattctcacagtagatctgtcagggcagcactgtcagcattcactattatagatgaggaaacaaaggctgagagagattaagtaacaggctcaaggtcacagtcagtgaatggcaaaacgaagatttcaactcaggtttgaatgattcgcaagactacactttccattttagttttcctcattcagtaaaatcaatcagactattttggggggaccaaattgcaactccctacataggcagctgtggctaacattttgttgttgaattattgtaataattgacagaataaatatttataaaagtattcagattaataaaatgaggatgagatgattggcaatgaacttgcattttgactttgccctaacatgttttctttcttctggattgcaactttatggaatgcattttattagtcatttagttcctggctaaaggatggattgcatttttttgtttgaacctactcagggagagctgacaattgcatcctaacaaagataaagtgacactttggtcatctcgaagacattcttgaggttcagaagattccagtagggagtttcttaaattcttcatattttgaaaatgttcagaacccctgaatatccagcagttttgaaaatgttcagaagccttgaacatccaacaagaacaacaatactaagttcttatatttatataagttttatttttgttttattccttaagcagtacctgtgaaaagtgattcattaaaaaatttcattttccacttagtaccattaagtcttgatgacaatggacttggaaaaagaaaaggaaagaaaagtggggattacattttctactctctataacaccaaaacacacctctcaagatgacgaatggggaagcactgtggtggcatagcagaatttatacaacctctgttgaaaatcccctgtgtgcctcatccaagctgtgtgggcaagtttcttaacccttcacacgtcgagtttcctcatctatcaaataggactaataacatttacctctcaggaaaattgttagtattgggtaaggattggtagtattagatagtatcggatatcacttaacagccgtattattggagctgttcaataattgtccttttaaaatagcaatagcaggtttacagcaatatagtcacatcagaatataatatttctaaatgtgtttaatccttccatcttttgatgttgcttgttctcacagtggaaattgtggattcggtagaagcttatgctacaatgctgagaagcatctttgatttcagtgcactgaaagaactactttctgggccaaaccgactgaagatccgtattgatgctatgcatggaggtatacaatcatttcttttcaattcccatctcttgaggataggaagttgccctcttctgtgtgtatcatgatgcttcaacaagccttttctcaagtctctctgatggtttttaaatagagttattttgcaaccagagcaatattcacacagataaaaatctaattgtatgtagcaaaaatagtagagacactcctcgtggtaagctcgtgtgaaggtcagtgtttccaccttaagcatcaggttctgagtaacatgcaactgctgttgtggactctccctccccctcagaagataccttacattcttgctgcatgcccccatgtatttctgagaggacggtcatttgggagatgtgataaacatactcctgagccccacacccccactcacctgcccccaaatgctcgttttcttagaagagggcaagagcaagctgaggattaaattcaggagcaacatgatgtgtacagccctctcttcttcctccgtgggttgtgtggtcaggtccatagagagggcagctatcactgtgaaccagaaccacgagggttttctcagacatgtaggtatatgagaatccctgaaacctatacacatacatctgcctggttggagaagcctttctgcctgcaactgaacccttttagtgatgcaattcggggattcctgtgacactgcaaaccacagaaagtcttctgctggtgaactaaaaccttccatccttgaaacttctccccttgggtcctagctggcctctggactcccatagaatggatctacttccttactcagacaaaagcgattctgtcattttaaaccattcaacagatgtgtattgcatacctgcaaaatgcatgcctggggaataggcaggaactgggcagattactttcttcaaagaatgtgcaatgtttggggagacgaagtgggtaaaaaactaaccccggggtcgggcgcggtggctcacacctgtaatcccaacactttgagaggccaaggcaggtggatcatggggtcaggagttcaagaccagcctgaccaacatggtgaaaccccatctctataaaagtctctataaaaatacaaaaaattagtcgggtgtggtggcacatgcctgtaatcgcagctactcaggaggctgaggcaggagactagcttgaatccggaaggcggaagttgtagtgagcggagatcacaccactgccccccagcctgggcgacaaagcaagactccgtctcaaaaaaacaaaaaatccctaaaaaactaactcctgccaggccaacaaaatgagagttggaatttcaagtattctctttggggttggaagaaggcataatttgactaggtataaagaaaggtttcctggaagaagtggcatccaactcagttcttatgaaagaaagatctagagtgatgaaaaatcaagcaatggtcattctcatggagtcggtggctgtggcaaaggcatgaaggcttaaaaatggatgtcacattagggaaacgagaggcctgggctggctggataatggggcatgtgaggagggcattgggtaagaggagcttctccggaagaagactacttttctccaggtcttttggctgttcctctaatgctttcgtttctatatccctcacagccctggctgccttgacctcattctgtggtgtgtcagtaacctgcttaataggtgatgcctcataggacacatttattctacagtgttatgacctctggggcatgtactgtattgggattagtaccatccttgatgaaaatactctctcagcatttcagagatgcgtgttcttggtagttatataaaatgtcactgtaaacatatgtaactggcttctcctgttgtttgtttttggtggtgggttttttattttcttttttttttgagacggagtcttgccctgttgcccaggctggagtgcagtggtgcaatctcagctcactgtaacctccgcctccgaagttcaagcgattctcctgcctcagcctcctgagtagctgggattacaggcgcccgccaccaggcctggcaaatctttgtgtatgcatgtgtgtgtctgtgtctctgtgtgtgtgtgtgtgtgtgtgtgtgtgtgtgtgtgtgtgtgtgtgtgtgtgtatatatatatatatttttttttttttttttttttttttttttagtagagacagggtctcaccatgttggctgggctggtctcaaactcctgacctcatgtgatctgtctgcctcagcctcccaaagtactgaaattacaggtgtgagccaccgtacctggcctgtttgtgtttttttaatcagtttgtcagctagcttgtcataatataaagataacagctctgaatcccaattcccacttttcctagccatgtaagtttgggcaaatgtctttacctcagaacaccaacattccaatgtatctgtaaactgcaggtgataatcataatataaacatttataacatatctgccaggtactattctcagtacttcatagctattaactcatttaatccttacatcaatcctgttaagtagttagcattactaccctcattttgcagatggaagagactgaggcacagagagtttaaataactttcccaaaattattatacagccaatgactggcagagctgggatttgaacccagacactctgattccagagtccaggctcttaagctctaagctgtacaaccttctgagcttttctgaaggactgaatgggaaagcacaggtataccgcagggcctttataatggttggtttcctttcctttccccactctgcccttcatgaactggccccaccttttccaacataatctctcattgttcctttttagagaacattcttctccagtcaggcgtatctctccactagtccctgaacacatttcacacattcctgttgtttctcatgccattcttctccccagaatgcatccacctcacccctgaatcctcacatactttaaggagttttattttctgattctgcatacatttattccatgctgtatatagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggtgggtataagtgcatttaagtgaactctggtgcaggccaggcctgatcctgcagatggggaaaaaagtgggctgcttctgccagacccagggaataactgttaaggatccctcattctgacccgaggtcagaactaaattattagaagcccctcttgaacaggaataggagtcattgaaatgaaacccacacatttaatttcagacatccatacttgctaacaatggcacgatgattaggttctgattatgatagaatgactggtatttcctgagctgggtgagttctagatgcctgtcttaaggtgggtttctgctctcaaccagcagctggctacttatttaatctctggacaagattttggtcttataatacacccattcattcattcacatgagctgaatattgaagctgtaatttcattgcctatatgaagatgatattgagagaattaacattttaatcattctctaccattaaaatgtttagaaataagctgttttatttacaagggtgactatgtaccagacaaggaagagatgtgtcttaggtttatatccctggtatctcactgatggtaggcactgtatacatttacttagttgaaaatatatttttgttgttgctagtgttaccattagctagaatccactgtttcctgaaaaatgatttttcccttatcaaaatgttgggaaattaaaggggttccagcagacattattctgtagtacatctttgtgatgagtgcattctgggagtgttttttggccaccctcccagttactgtggtacacagactgtggtacacagtttacccagtagacctaccaaactatgtaaacagccaatatttcttctctcattgcattttcccctcccctgggaaaaagatgattggttccagagtctgaaaaaagtctaggaggttaaagttagctggcctctggagggagaacagaggactcagctcaaaaggaggttgtgcttggactttaattgaaaacagttttaactttttggcatggaggtgccttcggcccaatggtactgtataaactcattgaaaataaaacccagtgttaaaaatgcagtatggaaaggagatcaatttcaaattttatagttttacattttataaaacccccatgaaagatagtttgatttcttatagtttgattaaaaggtctttctttgatcctctcttctccccaaggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccggtaggtgtctccattcccttggccttcctgtcttaggtcgtcccagtcttcaccatacccttcactgtgcctggaacacgtgtccttccctttcagcatgggcatctgatgcatagagtgtgctgagcgattcttgtgtgaggggatggttggctttttctggattcaatgcccctctccgcactcccttggcaccctgggcctcctcctcctggcacttaccacactgtgttctagtagctgttttcttgatgggctgccctgctagactgtatacttctgcagagaaaggactgttttgttcaccatctggactctgcctgaccatagcgtgcctggcacatagtaggacaaacacacacacacacatacacgtataattttttaaagttaatgaatagttgagtgttaatgaataacaatggaagtactcaagacatcattctggaggatcacttttcttttgcagtgtgcacagagtgtgggtgaaagagcagtttgaagtaattttagagtttcaacgactggatcgctcttgcccacacaaacacagtgaatgtttatatatcacttcattgtacaaaggctttgaggtggcttgttagatcacacttaaaaagttgaaaaatgaaagtcataacagatgaggaccagggaaaacattagttagaatatgtcaggtgtgcaggaaatgtttgatgaataaaaggtaaagaatgaatgaatgaataaaaggtcaaggccagggaggaaagtaggctgtaatatatctctaggctcttataataatagctgatatttattgaacattactttgttgtagacactaaatattttgcatgttttaattcatttacttctcagatgaaccccatgaggtaaatgctgtatttaacaccatttttctggtgggaaaaccaaaggacgaagaagtaacttacctgaggtcacccagctggtaaatggctgactcaggatttgaacccagagcctttgctcccactcactgggccatgcagttgttttctgtagaggggagatggttatagaattggtgctgactttgcttcagctaacaagaaaatagccactaatatccatatagtggtttgtagtttgtatagtgtttttttacattcaccatctcaattgatcctcacagcagacctcattttaaggaagaggaaatggaaagtcagggaagttagcagtcttgtccaagatctcaccaccaaattagagctagcatttgagcccagcacgtctaccatcaggtcctgcatttgaaattatgagctggtttgaggtcacactatcatatgttaggcctgtcaggtcctggaataccttctatgtcatccaagaacagtgtaattccaatttttggaaaaattgataatccacatatagaatcacaattgaagtacctcattacccagataaaagtttattgtactttcatagttttcaaaatcatagatttgatttttcctcaaatatcagaatgcaaagctgacattgctttcctggaaataaggcaaacattctgggaagcaaatctcgctcaaacagtgaatggaacttatcaggtaacttttcatgttcaaagggaaaggaatttttttttaagtcactcagaggttttaaatagtttaaagatacctagagagaaataaaagacgtgttagaagggaaggggaaccactaatcagtgtgggtgaagccagtacttaggggagaccccactgggcgtttcccctggggagacttctgatgagacaaaagcagcactgaccagagagctgaatactgggcggtcggtcatcctggctttgtgacctttgtctgatcacataacattctgggccctgtttccttctctgtaaaatgctaactgcccagacccagtatgtcatgattctgtgattacaggtgcatcaaaacatcattcttctcttctttatagattgattatagatgcagtctgtatccaaaatgtggatttaaatagcttaaacagcagccctgaacattttactacggatgcttcttctaaaatattaaactccatgatctgaattaattctttcttcttccgccttctctgaatccacatataatagcccattgtgcacaaggtttctcttatgattttccaccaatcttagaattatgtatgactctgagcaatgctaaatgggacccttgattacaataacgattgcccttttccgtccctcacatggccacgctaacagtcctgctgtgatgtaactttgatttcatgcctttgaagggtggctagtgctacaaagattgctttgtatgagaccccaactggctggaagttttttgggaatttgatggacgcgagcaaactgtccctttgtggggaggagagcttcgggaccggtaagtcacactcctgtgctagcattttcctccctgtaaccactatttccagtaaaagcttagactgctaaggtagcactgaaataccaacggtagccgatgtgtcctaaatcaaggcacaaattatttataacaaccctgatgaaatgtgcacatttgaaaaggggtgagcacattcagccagaaaggctaattttactttcagaggatcatatcgactcagacaggaagttggggggcctcctcagcagcgtggtcattgagtctgcagggattaaacagagcgataaacagatttttcttccttcggtggtcaaagaaacctttataaatgttttcatttctgagaagaaatacggtggagcaagtcggttttttgtttttatttaagaagaggtttcagcacagcattaaatctttctcttttataggcccaagttttctatagcagagtaatcaaggctaaatgaaggaagaccatgagggtggaactaagttgctaggtgatcaagaaattaaaaatacatcgttgtgcctgaggatgtttgtgtaattgtattaatattagagtgaaagaagggtacatagtattctcaggggatgaccccagacctatagacctcactctctgcgctctccttcctcctctctgcttgtccaaatattgacccgaactcccacctccttcacgaccttctctgctacctcatgctgcctgtatcagtctctctttcctaaaagtctgttcaggtgtgtggccctgtcccatgtatcagtctccggccaggttataaggtagttaagtgactgcatctcttctccttttattccctctacccaatatttttaagtaaatgtgctgatcttggtcctatagtactctactgtcaccctttagtgaagaaaagaagatcaaaatcaagcattctctcagctttgcaattgagttgcaattcatgccaggttaaacagaacagaatactgacttcatttcctttcctataagtctggaggtagagcaggtagaatgagctgctaaattggaggcacatatttacagagttctaagcaacttgatattttcgagagtggtaatattccttggcaatgaactgccttgatagaattggaaggtatgaagaaggctggatgagtcttggggttgaacaacttccacaacaaaggctagacagtttcccaaagttgtgggtgtttaaatcagagattacaaggccactgcttagtccttttctacttcatataatgggcatggtgccatgctattctgagggatactacatgagtgcccaatgagcctatgaggtggtcttctcccatgaaactccccacagggtcatctagttcaggcctggcttcagtcattctttatgaatgaagatgtctttgaaggcagcaactgtgtcaaaacctttgttttcctgttctcctgtaccagtatcagtgttgagcctagtgaaaagataaaagtctagagtcaggtttcccagagcatgtgagtatgtggaagaatactagttccatgagagggttctaggggtcaagaaaaattggaaaaattggaccacacttctctgttttggatattcacaatgatattagcatttgaagattccagaacattctgccataaagaatcctgttagtacagttttgcctaaatatagtttaccactatatataataattatgatgatatgatacaatatcatcaccacaataatgattattattattatcatttcgtagtatgtacagtaacttctttttccacagacccatgtgggaagccttggtcaagagggatcagagccccagagccaagtaggaatccctggtgctgacccacagggaacaggcctgaagacaggatagcacaagctgctcctcttacacaacaggccttcaaatacaagaagcagctctcaggtccttccttcttcaggccgtccatctttgtttcctccagtcattcctcatttcacattgtttatagactcagtgccagactctaggtgcttctgagtttgccagtgccactcttagaaggtgatgcccagaactgagcccaaatcttccagggttggcctggcaagtgaagagtggggtgggatgattatttctagtgattaggacactgtatttttcttgacataactttcctttatgttagtttttaggaagttgcataatactgtttagcccacataaggttgtgggtaattaaacccttaaagtttttacctagaactatttgccaagggaagtctctcatgttatgtttgtggaattgatttctttgaaccaaagtattagactttagactattgttaaagtttgttctcatttattaacacattcaacaaatacctagtaccaatcatggttttagcttctccttggtatatttcatgtccaaagagagaatgctcttcattatcatgaggataatcacaagctctttctctctctctctcttcaaaaaaagaaaatttttgtgtaatatttctgagataaacatttaaacagccaggctgcatagccatagatcgctgttgtgaacgagtgcagctgggcttatttaactgaactcctgatcttcttatttatagaggagttaatttttagcaaccacgccccttgctagtgaatgtttccaacagttctttcatagagtttctcagggtagacattagtgactctatgaactttgaaacatttgaattctatagcttaattgagcacagagtgctttatttctgtatttttccaggcgataggagagacaatttctcaaaaacgtttccttgacctttcagagtgggccaaatcccctgattattggctcttgtggcaccatgtacctcttctttgttgtacttgttgcagctgtgattttacaattacttatggttatttgattaatgtctgttggctgtatatgccatgaggacagagatcttatgtgtcttatcctgcattgtgtccctcgagcctcccgtagagcccagcatagaacaggtgctcagtaaacgcttgttgaatgagttcatgaacactattcacttggcaccttccatttagacagattcctgctattggaaaagaaagaactttaaaaggtatctgatgtaaattcctgtatgatgctggaaccatagtgactggtcactgctttctggctgaaccacccacctcaatggagaatccacacctcacctcttgccgtagtctgggacccttgtaatgactcaacaccacttccactccacagtccagggttgggaaccccagggtctttgcgggaagaaatgcacttttacaaaagaaaagaagtttgcttgcaaagaggtgcaaaggagtctaacttcaggactggtccaccgagtaaaacaaaccactagcatctgcagaacaatcttggaatattactaacattatacattagtctgtttgtatacattatacattagtctgtttgtgctggaggagcagcagctttctcacctggatatggtaaccacagaagctaggtcacttacttcttcagaggtcagcattacaaacaccagggataaatggggaccagaactggacaggataagcctgttgttgtttgttgatctcatggtacaaagctgttttttcttcctaaccgtggatgattatgtacatgtttatacacaatggtagagggcagactgtcagttccatcccaccttagaattgttgggactttgaaagtgaagtcactgaatagtatacaataccatgcatttgaacccttcctcaggaaaatagggggcttgggaaagagcgatgggaaaccaggttgatgatgaacttggtatcacttagagatatgtaagttatgatctggtcaggtctagaggctagcaatattttttccctgtcctgtctttaaaggttctagtgctaatgtatcatacaggagtgataacttaaagaaatacagcattaacactttgcaaatttcttttaatttttagtttcatatgaaaagtccttcatgtttgcacattttgcattgattcattcctcaaatatttattgaactttgattttatcctggatactgagttagactctgggacacatggtgaacaaggccttctcatagagggctccatgaattacaggtgtgcaaagcaatagaaggtgaagtacaggggtacttcgggagctttattctcagggtgcctaacttggttctgtggtgtaggagatcagattttctttctggctttctgcccattctaatttgcatagctactgagtacatttccctgtaggcaaagcccacaggggaagattgtagcaccccatgtctggggatagcctagacagaatacgccagtagaactaggcttataccctaattataactcactcatttaaagtgttacctgcctgtctgtctccctcacctgtatgtctgtgctcatctgtgagggcaggggatacgccttgtgcatcttggtatcttcttatgtgcttggtacatgctggcactgattcacatttgttgagtgtaaagtgaagtttgtgttaggacagagttcctgcttatcaggcacttaaactaccttcttccaaaggcaccttatggaaaggaaaccaagttccaggggcagtaatgaggcaggtcaggcctcattgctaagtggaaggcctgacagttcctggggccagcctcctggggactggagtggtctggagaaggctttctgaggagctcaccttcctttccaagtgaagttgtttgtgcagtggaagaccaagaggacaggactgcagacacagcaggtcagctgagcctcccagccagtcaactggggcccggccattctttgggcagactgtcttaacaactgactttgggccaacccctgtttggggagtacaactcatagtctaggatacggcgtgatcacagggagtggtagaagcacagagggcatggggagggcatcctggataagactgaagttgaaagtaattgcaggacatgttagccaggctagtaggtgtatgtggaatgggctttccaggcagtgagaactgtatgttcagggggctggaggagagagagaaattgacagaaaaagaaagagacagacagacactggtactttcagggaactccatgcagctgtttttcagctgtcatgcccccatcctcaggcctgtcacctggcaggggcagaagccaggacagctcctgagatgcccatactggtaaatgtaacccaatccctaaactgttagctcttggctccctcaggaatggttgacatttttcttggctgagacccaggatgtgccctggctgagccgagtatgtgcttatcacaaggtgctgattaggccgaagtaaagtgacaggtgtttgaagatgctgaaagggtagaattcctgtccctgagcggagcaagggtgaagagacccagtgcaaaacccaccactgtcttttgtgccagctgggactagaagtccttgcccagagtgttttacctttctcacagttaaatgagcttggcttcattctctttctaaaattaaaacataatgaaacaagtaatttatgttcattatgagaaataaggaaggaggaaaaaaacactaatcccagtgcccagaggaaagagcatattaggttatattcttccattttcttctccaatatgtacaatcaaggagcattatttttaaaagcataataaagtcagtggaaaatgtaataattttccataaaagccttttatttttccctttattcgaaacagtatctagtagttacattacacctcacaatgtataaactatttctacttgctttttcgtagtaatttctcacagttatgagagagaagttagcattatttctgttttgcagttgaagaaactgaggctcagaaaatgtgatttgtccaaattcaagtagtttacaagtaacagagcctcaaattcaggtttatctgattcttaagtatcaagctttatctgctgagccacagaaaatgtgatttgtccaaattcaagtagtttacaagtaacagagcctcaaattcaggtttatctgattcttaagtatcaagctttatctactgagccacaactgcaaaaagaatagctttagaaacacgtacctgcaccattggtattttccactggaaacttggcatcattcatcagaaccctgaagaaaatgaaatttgctccaacttcctgagtattaattgaattacctggaatttttgatacatccaaggtgattagtgatgaaccagaatatccaaagaggctgaggattatgcaattggaattggatatttgtttatgttacccagggcaggtattttgtttatagtattaggtgtatgatttagttatctccaagtaacttggccagagttgggtaagatttttagattttattttcatttccacataaaagaaaaaatcaaattccttgcttagggcaggaaaagccacaaggaacactgccttctatgctttcagtctagccaaaagagaaaaaagaaaaaaaaattaaggagaaaaagaaggaagaaaaaaacccagtggggcacagacaaataattccaagctgtatatgctgtcatgaattcccaatatattagggaagctgccagaatcttgcttctcaggatgaactgttgccaaaacatatcatttgcaaaagccgtaagagccagagagctttttgctccttaaaatagcagtaagggcaaataaaagtctaaagatagtaaaattaggtaaacatttttaaaatatgttatataaagcactaaaaatattgcctactctctagttttgcctgcatccgggttttgaggactgttaacttctaaaagtagtatcctattgaagagaaaagtcttttgaaagaaaaagtcatgtttttttaagaaccaaaaatagaaagagaaagtgttggagtaaattgattggttgattcattcacacagtctttcataattagttatttaccgtattccttgtgctatgctagtcaccagacttaattacaaggataaataagagatgcccgtaagaagcacacagttagtggggagaaaggctcacaaacagatggttgagactcgaggaggctgatgccaccccagatgttttgtgcaggttgctacaggagaagaaagagaagggagttcatgactgcctagggaagttgggagctagtcttaaaaaagagaggacatttgagctgggtctgaaaagatgaagagaggaaggaaaaacaccacgtgcctcctgcatacccagcatggtgctagatactctaacaattccaagaagaataagaccagcgggaagtgcagtagggcaggcacataaagaattcaacataggataatgtgagagcatgattatagagcaattgtgtacagttctattcagaaatcagaaaataaggctccatgtagactgctttctttcagaataaagagtttaaaggcaaaaaaatgagagttgtgttccatatcaggctcttggaaaagggtgtccatgcatataagcacatcctcccgagaagcccattttaaaattttgttaaagattttagcaaggaccttagcaggagacagatgtctcctttaagagacatcattaaggtttgtttaaccaaaccttaatggttaaagaacagtgtcttggagttgctggatccatgagtaggtccaatttgaaggctttgatccttttttgccaaattgatgtccagaaggattgtgccagcgtccactcccaccagctctttggtggaatcccgtttcccttttattctcctggcactggctgttcggatttttacacttgtggatttttacaccttttgtcaagcaagtagcagtttctcattgtggttttaactttaatttttcttcttaaaaataacaccagctttttattatactaattggttgggtgtatgtgtctatgtgtattgtttggcaaatcgcctattgatatccttggcctgtttttctattgaaattcttttttcttattcatacataagaattttttctatattgaatgtattaaacatctgccttaaaatatatcaaatgtggccgggcatggtggctcacgcctgtaatcctagcactttgggaggccgaggcggatggatcacctgaggtcaggagttcgagaccagcctggccaacatggcgaaaccctgtctctactaaaactacaaaaattagctgagcatggtggcgggcacctataatcccagctactcgggaggctgagacaggagaatcgcttgagcctggggggcagaggttgcagtgagccaagatcatgccactttactccagcctgggcgaaagagcgaaactccgtctcaaaaaataaaattttacatatatatatatatatatatatatatatatatatatatatatatatatagtattaaacatctaccttaagtgctatccacttttaaacaaccagatctctttaattttttaaagtttgtcaatgggcttttaattttgtccatagtagttttacactatagaaatgctgatttttaagtagataaatacatcagtgttttcttttatgaataccgaatttacattatttatcacccctaagatttatatatataaatatataaaaagacatgtatattaatataatatatactagtatttaaaagctttcaggttttacattcgaatttttagttcaactggaattatttttgttatggtgttttatagggaagaaaacaattttttaaagctatttatccagttatccaaacgccatttaaaaagtaatctactcttttcccacagccttgcagtgagacctttgtcatactcaagcctcttgtgtgcttggatctctttccagatgcactcttgttctattaagctaccagactatttgaattattgaaattttgtaatggtcatgttcttctgctgtttgttcatttaagatctattgtgttttctcttcacattaatactttataactgatatatcaaattccacctaattatctcactgacatttttattgacttatgccttacatttctaaatcactttgggaagcatcaatttcttttcagtatcatgttgcctacttaatatgtgattcctcctgtatacccaagtcctcagtcaggcagtgtgactcttttatttgggtctgcacacctactgttgagtactgtattagtctgttctcacactgctataaagaactacctgagactgggtaatttatgaagaaaagaggtttaattgactcacagttctgcaggctgtacaggaaccatggctgggaggcctcaggaaatgtacaatcatggcagaacaatgaagaggcagccggcaccttcttcacatggctgcaggagagagagagtgaagggggaagtgctatatacttttaaacaaccagatctcatgagaactcacttactatcaccagaacagcaagggggaactttgtcccccatgatccaatcacttcccatcacgtccctccctcaacatgagatttgggtggggatgcagagccaaaccatatcaagtaccttctcaggtactgggagaaagcacgtttcttacagcagcttgctgtcccccctccaggttctgaccacatccgtgagaaagatggactgtgggctgtccttgcctggctctccatcctagccacccgcaagcagagtgtggaggacattctcaaagatcattggcaaaagtatggccggaatttcttcaccaggtgagccacagcccagctggggtacaaggtaaggtggggaagtgggcagagagaattcttgcgcatccacagcctctcctgtcttaagtgctaataaaaccctaggtcatccagcctctctcaattggagactttaaaaataatctggtcagggatgaaatgaagtcaatttttatgtcagccataaagagtgaggctttaaaagtttagctaacataatcaaaagaataaatgctttataagcattttaaatgtgtccattgggtggacatgatcataacattggatttggattcagagaaatggattagaattttatttcttccccttactagattggggagccatttagcttttctctgtactcagttttgtcatctgtagaaatgggaataacagtccagctgttgagaggattaaatgaataatgagtctgaaaatgttttgttaactttggggcactgaaagcctagaaactttttttcataaattatagaaacagttatgcttagtccacatcgacttttctgccttgtgaaataggtccccaagggctatatacttgtcaataatttttttaatttattcaacagatatttactgtatacccgatttccatcgggtacttggaattcagcagtgaacaaaatacttagaatacttagtaattattccttatcatgcgtacttctatttttaaaaagcattaaaaaatttttgacagtagtacttttcactaattccaatttgcctttcccccagttagtgtaaaaatctaacaagaatttttctggacctcagtattccaattatagagagaaaatatggtaaaaaggatattagatgaattgtttatgtataagaaatgaataggtgtaatttctctggacctcagttgcctgttctataaaatgggtgagttagactagagaatttaaaaaatatatcccagattttatagtccgtgatctctggatagtcaagaaagaattcaactaagtaaattaagctccttaatcagaattattttattaactttggacggattcattgatctctttctctctcacgttactgttttgtggaaggaataagtaataactacctgacaccacacagtagccctgggaaccaaggcaaaaaaatccctactttataacagacagaaaaacctggtcattcagaacagcagtcatgaactgtctagaacctagagtatcataaaaacaaggccatgtctgtttttgtgccctaagcacccaactcatagtagagactgcataaatacgttttgaaccgataaatgaatgagttaacaggtgaacaatagccagagtagaataaggttaggaggggttgttcagagaaagggtcacacccttgaattagtcacaatcctccatataaaaactattttaacatgattttattaattatcaaatataattgctaaccaagtattacaaatcaaatccttagtacctgcatttatgattagttaaaactccattataccttccacttactgaacaaaagcgctaggcacttttgcatgcattgtctcactttagcctcaaaacagttattgataaggtagctgagattctgagagatagggcagctggccctgtagtcacacaattaatagccaatagaggctggattcatagctcatctgtctgattgcaaaacccagactcttctattccacccctctgtgcctagggtttagaaaacatttctctggagtacccagaggtcaaaaatgtaaagcacaaacacctggttgtaatttcttgttgtttatcatgttaactaggggaaagagctgactttaagattaaggggactgtttggcccttgattcatagaatcctggagccagaataggctggccttaattcctcagcatttctcatgtctcagaggtgtcatcttgcatatatgatatctatttcacgattacaaataaatatagactctgctatcttgagcttctaaaaaataactctctcaagagggtgtatgccactaggtcaagaaaagccacctgtacaagtctttaacatcataagaaagaagtcaaaaagaattcttgaaggaaaactcatctttatagaatttcatttgtgatgcacttttttccttggccctttttcatccgcactgggcctcttctgtcagggtgaacccaaaggaccttggaccaaaatccactgccactgaaaggagggaggcagaacttaaaataaaacaaaatttaaaaaaaaaaattgggagagcatcaggataaacagctaatgcatttggggcttaattcctaggtgatgggttgataggtgcggcaaatcaccatggcacatttacctatataacaaacctgcacgttctgcacatgtatcttgaaacttactaaaattaatgaaaaaaaaaaaggcattttagatgtaaagagtcagtgtttggcgtcttcatctggtcggtgaaaacttggccctgctttaggaagctcctgtggagctggaactctgcttagtcaaaatctcagcagcctcaggcaggtctcaggctgggagcaggcccagcattcaccccagagaagcccagggagcttggaggagaagtgcctgagtcacgtgctcctttcaagagagttctccagagataacattgcttttcattttacctcctcaggatgtggtgactaaatgttagatagcatctttcaaaagcctttgaaacatcttagagctttattctgtagaaatgccaagatgggtgttttctgcttattcagaagctcataacccttccctgaaatcctccaaacccttcctttcatccctggcctgttccatccccagtgactgacaggcctgtattttttttgccagcttcttctgaagttagatagttttgcgggagggccaaacaaatgatgaagaaagtgctgactgataggccttggtgtgatctgcagtcagcccgtgggcctcaacttcgtgacttcttccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcaggtagaaacagaccggtgtgtaagtgagagagagacctcagagcttcatctctgacatctcaagggaaaaattaaaaagttcctgttggctatttttcttttgctgctgtgtttttctagggtagctgttcttacctggttttctgctgtcccacgtgactctcacatgcactcgttgggacagtggtttatgcccttgttctgtgcactgtccagtaccctcattctgggattcttaacctggactccagagggatttttgcactctctggaatgatatgcaagatgatgtgtccattgtacatgcagaaaggagccccagaatctaagaaagagggagaactgtgggaacttagatgtcaactcctctcttttctgtcagcagattatagcagagtgacagcatgtaagtggcattatacttatacgtttctctcgtatgttctaatttctaaaggagagaaaaatagatgaggcattcccagacttagaaacgttgaccatcgtcattcgcagcacatgagtggcaccccacctaacacagcagtacctggcaagacgccacagtttaggacctggagcatctctagatgtggacagaattgttagtgcttcccttactgtgtgccgggtaccctaggctgcaggctgggtcaggctttctcctggcttctcatgaacacttacgcaccagggttctctcacctctgcttctgttgcctgttgtcacagagtaaactcatctctcacaattcataatagaataaagagcaggatgaagattctgttacaacctcccagtttacttttttccaattgacccagatttttggcctggtccttgtcaaggcatctcatagggtttggaagggccgggccgtgggatttactggaggcttccctctggggagcaggcagtgaatggatggatgggccacagcaaccctcagtgcctggagtctcccctcctcaacttctagcacaagtggtttctcatccttgtgcctgtttgccatttgtgagaacttggggtccagtttggatgattgtaaattatgcctgagataattagaagagagacctgtggttgaggaagaaaggggtgtagaaaaggagtggagctgagggatggcagagtgggacagaagtttgtgtcattaagccttcagagacagaagggaagtcaaggaaaagtaaatcccagctctgcagtgcctctggcatctgccaggagggagaagaggtgtaaaggtgtgtataggagacagtggcctaagctcgagagctgccctctgtgctgtaaagaaagcagctgccccactttctgtaatcagaaaatccaagcattttgatgtgagaccagataggagggaaaaatatgatccaacatatatagatagaacatctgcaatctagtgaaaagaattttagaggcttcaagttgaagctgtgaagaaaggagaccaaccctggtgtgttcctagaaagcaagaaatggtcagtgaaaatggaccgtatccttcccatagtgactaactgtggcatatcctctgtgtatttcatctactgtcttcactaatcagtgctaatgaatggcaccattaaacaccagatggggattggtgacgaacagcaggtgaagagcagcatctttttggtcagtctttggtgttatgcaaggttctcctttttacagaggatggatagactcataaagactgaagagtcctcaggcaacttctgtcccagccttcttccctcaggttgggaaatatctaccccagagttcccacacatttttccccaagtgagaagataattgatgtccagagataccgctggggaggaaaaagagagggcagcagagagaaggatgggcttggcacttcacacggacctcgctttgggtccatcagggattggcaggagattggccactggctcctgcttgttaggttgggaatagccagtctctgccatttgggacctctgacttcctgttctcttttgaggacctttgctagtggtttgtaagagtccttcccctcatctgcctgaaacctcttcagctctggtttcagcccctttggtccatgtttccctcttgatctgggggctgaatttttgcatctagcagctttatgtgcttcattattaagcttcaaactggaatggttagtccataaatcacagggaagtggggagaggagggaagccctcacatcacccagcatcactgaggtcaggtctcccctgaccctggaaatgcttctcccaccgtagctaagcccccatcagctggatgcagagagggtgacggaaggcaggctcacaaggtgcagctgctgccatttatcaaggatttaaccctccaatgaacaagtatggatgaaattacatccccaaatagacccctcataatttgccagccttcagtctcccagcatttggggaaaaaaatctctgcttatcttttccagggcttgcgcctcattttcacagatggttctcgaatcgtcttccgactgagcggcactgggagtgccggggccaccattcggctgtacatcgatagctatgagaaggacgttgccaagattaaccaggacccccaggtaacgcccagccctgtgccctggttagttctttctgttcaagggaatgatagtttcccattgagcctgtgtttcaatgcccatttctcaaatgactcaacaaggtaccagctgtgcttactttcttccatgtttctttctccatgtcaacattatagataataattataataataaaaatagggaggctgaggtgggaggatcacctgagcccaggaggtcaagcctgcagtgagccaagatcacaccactgcacttcagcctgagcaagagtgagaccttatatcaaaaattaattaattaattaattaaaaataaaaaattttctgagcatttatggtttgccaggctgtgttgtaagcccattatgaaaatatactcatttaattctcaaataacttagactgttattctccctgctacagataaggaaactgaggcacagaaaagttaagcaacagttaataggtttacatgcctagtaaggataatgaatctctctttttttttttttttttttgagacagggtctcactctgttgcccaggctggagtgcaatggcacaatctcagctcactgcaacatccaccttctgggctcaagcaatcctcctacctcagctacctgagtagctcggattacaggcacgtgccaccatgctctgctcatttccttttttttttttttctttttgtagggaggaggtcttagtacattgcctaggctggtcttgaattcctagcctcaagtaatcctcctacctcagcctcccaaagtgctgggattatatgtgtgagccactgcacccaacccaggataattggtctttaaatcagcccctcatctggtgttctgctctgtctgcagcattttgttgctttgtttggtctgatcacctgcttgggcagaacacaccactgggtcttagatttggtgggggcagggagaggcagtttcatgtgtcttcacagaacagtctgcagacctgcagcttggtaagctgggttcctcagccattcccccaaaagtcttcagaagtatatcagagtaaggagggactctgggagcaaagggtgggacagtgaacttgaaggacaacccccaaaaatggaggagccaaggggaagcagtgaaggacaggacagtttctttaagtgtttttcacaatccttatctcaaccagagctccatagcttaaaaaaaagttggggaagtgttgtggtatattagccccttcttggtgattcacagcatacaatgcaatgcaccataaaggctccaagatttcggacatggtggcctgcacctgtggtcccagctactcaggaagctgaggcaggaagatcacttgagcgtaggagttctgggctatagtgtgctatgcctgtcgggtgtctgcactaagtttggcatcaatatggtacctcccgagaggggaaccaccaggttgcataaggaggggtgaaccggcccaagttggaaacagagcaggtcaaaactcccatgccgatgagtagtgggattgcacctgtgaatacccactgcgcttcagcctggtgacatagcaagaccccatctctaaaaaaagaaaaggaaagaaaaaaagagggtgctgagaagacttgcagtaaaggtgcctgtttacatagcatttgctgaaggacatttctccaaagaaaacatacaaatggccaacaggcgtatgaaaaggtggtccacatcactaatcatcagggaaatgaaaatcaaaaccacaatgagctgtcacctcacacctgttaggatggctgttctcaaaaagacaaaagataacaagtgttgggaaggatgtggagaaaagggaaccatcagacactattggtgggaatataaattggtatagctattttggaataaccaaaatatggaggttcctcaaaaagttaaaaatattttagtactaatatacgatccagtaatccctcttctgggtatatattcagaggaactgaaataaatatgtcaaagagatatctgttctctcttgttcattcaatattattcacaatagtcaagatatggaaccagcctaagtgcccatctacagatgaatgaagacattgtggtgtgtgtgtgtgtgtgtgtgtgtgtgtgtgtgtgtataccacaatggaaaattattctgccttaaaacaacaaaaaccaaaatcttgccaatcttgccatttgcaataacatggatgaacctggaggacattatgctaagtgaaataagccagacacagaaaggcaaatactgcatgatttcacttgtatgtgggatctaaaaaaagtgaatctcatagaaacagagcagaaaggggcttactagggggtagtgaatggggaaaatggagagatattggtccaaagggtacaaaatttcagttatgtaggatgtagcagttctagagatggaatgtacaacatgatggctataatgaataacacttgaaatgtactaggagaatagatcttaattgttctcactatcaccaccacaacaaaaaaggtaagtaggtgacaagattgataatgttagttggcttgactctagtaatcagttcactatgtatttgtatatcaagacatcatattatataccttaaacataaacaatttttattaaaaaattgaaagtaaaataaaataaatagcatttgccatgcttatttttccacaaaggcttttttcttttaacacctaattaaaatcctgtgaaactcatttggaaacccctggcatagtggttttgagcaaagttaaagagatcttgttttaaattctattcctgccacttaataactgtgtgtccctgggtaagttgttacaattttatgaatcttggtttccttgtctgtcaaatggcagagtaatacctacttcatctagttgttaccggggtttaaggagataataaatgtaaaatgtttaaacactgtggctggcatataggattaacttttcagaataagcagcactcttagtttttttagtctaactttaagtgtaacataatgctattataaccatttttaagtatatagtttagtaatgttgtacatattcatattgttgtccaacgtatctctaaaacttttttcccccaaaactaaaactctgtacccattgaacagcacctccctgcttctcccttttcacaatccctggtaccacctttctccttcctgtgtctgtgaatttgaccattgtaggtacctcacatgagtagtatagttgcttttattacagaaagtgggagatgagagaatgcttcacttttacattttttccagtggccaggccccagtttcagtcatcaccagtaccttgttgtgttgtaggcatccctaaaacttcaaccaaaggcaatggggtctgcattatagacacttaatagcacaagagaaaaggaagaaggaaattgtgtttgtcttttgatcatcaagataaatgcctggcacgtggtagattcaaagagtgaatgaaatttgtttcctctgaaccatagtcctcagcaggtggaatggcagtggatggtgtgaggttcccacaatgcccaggtgtatcaccatctagccggggagctgcctttccttattctgcagctgctaggccatcagcactttgtggggactgcccaagccctaaggggaaatgtggtagtttcagcaggtggagttgattctccttttccaggtataatggatcggtggagatttagataagaaaaagtagcattcagcagtagaaaatgtactactcctggctctgctattgagtcatttagtcaaatcacttcatctctttgggtatcagttttctcatctgtaaaatgggcagttcaaccagattagtagtttttttttttttttaatattgaaagcatttattaagcaacagaattctctcttttttttttttttctttaagcgagaagtagatgtggggaggggttgttgcatttttaaagattcctgtattaggccgggtgcggtggctcacgcctgtaatcccaacactttgggaggccaaggcaggcagatcacctgaggtcgggagttcaagaccagcctgaccaacatggagaaaccccatctctactaaaaatacaaaattagccgggcgtggtggcgcatgcctgtaatcccagtcactagagaggctgaggcaggagaattgcttgaacctgggagccagagattgtggtgagccaagatcgcagcattgcactccagcctgggcaacaagagtgaaactccatctcaaaaaaaaaaaaaaaagattcctgtattagtctgttttcacactgctgataaagacatacctgagactgggcaatttacaaaagaaagaggtttaattggacttacacttcacgtggctggggaagcctcacaatcatggtggaaggcaagaaagagcaagtcatgtcttacatgaatggcagcaggcaaaagagagaaattgtgcagggaaactcctgtttttaaaaccattagatctcatgagacccattcactatcatgagaacagcacagaaaagacccacccccatgattcaatcatctcccaccgggtccctcccacaacacttgggaattatgggagctacaagatgagatttgagtggggacacagagccaaaccacatcagtcccattgggaacagtgtgggaaagaaattggaagatgcacaagtggatgtggaggcactcactgctccaggtaagagacaggacattgacttagcaagacttaacagcaggagagtggagagaaaagggggccatggagagagatttagcggggaaaagtcattgaggcctgctcatggactgggcatggggaaaatgcagaggaagatgtcaggagcaactcctagttgttcactttacatgaaagactgtagtgttgatccactgaaatagaaactgctggaactaggtattgggggaaataacatgtgtttgtttttggatttgtggagtttgaggagccttggagacctggaagtaggcagtcagacgtacgggtttggagctaagcatctgtgtttagaggaagtgatggaaaagcttctctctatgtcttcctcaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctac

SEQ ID NO: 36035 - DNA, 64994 bp, Homo sapiens
gacagcctctgggtcctcggtcggtacagtctctgcacctcgcgccccagcaggtgagcggcgaccggtaactggcgagtggtggggatagagggggtggaaggaggcagaggaaggagagaagggagagtgtgaacggcgacttttctgcctgaggcttcctccccgctgtcaccctgcaccggcaaggagctcatttctccttaacccccgctcccccaagtgtggtcgttcccgctacttggggattcagatgtccacctttcccagggttggaagtgagtgcggccattatggttccctactcagagcctttggggcttcgggtagcagattgtttcagccatttcacagggtctgcagtagacattaggtcccattccttaaagcccattctttggcaaaggtcctcactgtccttaccctcagctcagggctgaggagcggggaggtagcaaaaaccctggaggcagaggcgtctccggtgagacaggcttgggagggactgtcactgatacggccctcactgcagagtcactgtgaagcttccctccgaatgtgctttctcagtgattctaaggattttatctgacatacctgcagggaaggttccgtagatgttcacgtgcttcggatgggactagaaaagtaaaagaagggcttttactttttcttctctgcagagaggacagttgaaggaatactgtcttcaaaacaggaggtgttagtaatgcgacagtctcgattgaatgaggaggcgttgaaagatggtattgtggtgttgtggtgtgcaggaggcccaggctggtttagggaagagtgagtagggttccctgaaaccgaaataagaaactgattgggttggaaatagttaaaccaaattgatttggccatatgcttaaaggtagaatcaagtcgagatgttgctgtctgcacatgttttctgccgtcaatccttccctttttgtcattttcccctaaaatactactgaattggcactcccaatctattccttgatcggctttgtggtaaatttaggttaagtagcatttgtatccctctttagctttccccatttgtaaaactcccggtgccctcttcagattttgatgaatagtattttgtgaaaatacagaaattgttgtccaattgaaaatacaggtgttgtccaacccaagtactcccattccgtccataatgtattattaccaatgttttgatcccaaacaatgtgctttagggaagaatgtttttcagtttgtggttaaactcttttatttatactgcaaactcagaaaattccatgctgcttttcaattgaaggtcttacgaatattacaaatttgatttttaaaatttaaattacacctttcttaatatgaaaaattatatgctcagttaaatcttgtagttttctaactaaggtaattaaagaagactgctggaaaatgaggaagatggaatcatctttggtggatgtgactgatttatttttgtttttctgtgtcttccaaattctatacaataaacggtcttattttgttaaggagaataaaaagttaaaattctacaatagcagcagtttaacaaagtatttttatagtaagtgcaaaatacataacctagcttattgatgctccttagtagaaaacataacctcggagatgttgctttccccaagtaatgaagattactactatctcttgtggatttaccattttagcatttcgtacttacgacccatactggacaatagactaatgtattgatatatttatgtcatcatgcctgctgtagatatatatatgtagttttatccattaattttctccataataaggttccttgatctctagaggagaggggaagaaaaaaaggaagtgttacttcagtgaccaggtgacattgcaccacgtaaggagaattccttatgtggtctggaagtcctaactagtcctgtctggctgagaccaaaatgtgaaagagaaaaccagctagaagcattgactactagaggggaaaatgtcagtatgaaagtggttggatgagtctgcagttttacttcacaattcccccagttttagggaactcgtgaaagcaataacttagaccactgatgaaatgtagattagtagtgggaattggtgattacattgctagtaaggttaaatgtgaaaaaaagctttgacattatacacagatcacacacacacacacacacacacacacacacacacacacacacgattggaagcctggaaaacatttctgagactagccttatcagtttatgagtgttacatgtagaaatcttaacatttattagggaattgtgctatagtccactattaaataaagcataagggtttggttttattttagggcccttggcacttctggttttcttttcctgagttcttgttttcagtgcctttatagatttttgccaccactaagaatgctttcttccccatgggcagaggtagccactcagtcctatagactactactaatcatcatcatcatcttttctattcttctacttgcacttctagcattgtatttaattcctgttccctgggctcttcctcagcaaatcataaagctctcaggactgtgaactataatactattgtgtcttcagcaccagaatactgaagtacctgataggtactcaataaattatttattgaatgaatgttgggcaattagacaaagaaattaaaccactttaatttttgcagatcatagctcttcctaaagttgtgcactaaatgttagcttttaaatataaactggtaataaccttccaaattcatggtcaatacaatagataaaaacctcagatggactttattaatgctgagaccaacttattttcacagcatgtttgtttactaataagtatggttatcatcaaaatatgggagagaagggaagaggaatgaatcgtactaaatgaaaaagtggctctgcgtgatctataagtggactagcactagactaaaagtcagaggatcttcattcagctctgccactttagttatatgtccttttacgtaatgctggggaggggttcaggtttgatacttaggaaccttcctatgacataaaccctaggtaatctatgtgaaaatatcttaaaaactaagtggtgtctgtaatcccagtgctttgggaggccaaggcgggcagatcacaacgtcaggagatcgagaccatcctggctaacacggtgaaaccctgtctttacttaaaaaaattaaaaaaattagccaggcatggcggcacgcgcctgtagtgccagctactcaggaggctgaggcaggagaatcacttgaacccgacaggtggaggttgcagtgagccaagatcacaccactgcgctccagcctgggcaacagagtgagactccatctcaaaaaaaacaaaaacaaaaacaaaaaaaactaagtggtgtgtaaaatggtaaagcagtgtagctcagactttacatgaattgatttcccagtcatagagacctagttgaagttctggccctaccacttaataactgtgtgactttggacagtgtacttaagtaaggttaagttttctcacgtttaaatctatagatggtgctattaagttagatcatgaatgtaaaatgcctagaacatattttgtaaaaaaaatttttaattaattttactgataactactttgattttatatactgaatttctaaagacttaagacaacccacagaattgactgatgtccctgtgagcagcaggtttggggcatgaagaagagagtagaatttgaaaagaagctattacccaaaaaatgggggaacaagaaaagtgtacttgtagcaaagattctaaaacagatttattaattttatctgaaaaatatcaagataaagtcccttatttgggcaactgcagtgtcttaatattttctatataaagattttccaaagcttgtaatcattaatgtatggaataaatttaaggaggcagttcttcaattttgaagtttttattcctgcaatggattatagaagtatattaaaattgtacagattgtagagcagggacttttgagttaatgcttataagcttaaaaattttgtctttttaaaaaaattaagtgtttttatatcttatttttatccttatatgaaatagacaaagaaatgtagagaacataatggagacataaactagagtaaaattcttcccttcttaaattcatgattcacaagggttagtagttttgcaatggaaaatatcagcaaattaaacagtaagtatagctatcatgagtttatgaatcactttattcctgaaaaaaaaaattactcatttgtcttaaggaaagattttattaagtttattgacttttccttaatgttgattgtctattataacaaatggatttattgatttaggaatgaatttattctttatactaagtaactttattttaaataaatgaaatgtgagcaataaaaatgttttccatataatttctgaagagaatattagttttgctattctcttttttccctatggtgaaatgatagcgactttggtttttataagtgtattcatttatatttagtatatacatattatgtatatactatatatagagtaaatatttgtagtatataaagtacgcaatgtgtgtgtatgtatatataaagacagctgaagtggttgtgtatcttcgtagtaacatatttatttttacctgaaactactgaagtgatctttagaataatgatttatttacatttgaaactcctctttctgtatatttctttgtagttagctctagttaataaatttacaactgtgattagctgtttttaaaaattaatggtatatcataagtattttcagatttaaattttagaaggaaacactttcttatatcttaaggttttaaaaatcactattatttttggtattattatgactaacaacaaaaatttcagttttggatcttaatgctatctgttgaaactgttctcttggtaagcctttaaaaaaattttatctgcaacatgccacattttgtttcttttctgaaaaataattaagcttatttcactgaaaataaaatgggtggtatatgatatgatatagaagagtttcagatgtgcttgagcaatgaaaagcaaccagactttataagtttttagttcttagtttaatttttttaatgtttaaaggtacaatagagaagactaattgaattggaaaatacctttaaaattgaaaaaagagcatatgtataataataatagtatatacatatggaaaaagttgtaaggaaatgcatcaaaataagtaattatctctagattgatgcattaaagaaaaaattaaaatttattactataccttctgtatatttgaattcataatgtcagtaggcattgcaaaatatttcttaatttgatatggaaaattaaggcacctaaataattctttcatcttaactacttggatatcttaagtgaaaatgttttgtctcatccaggtagctgagtaagttatttaattttataggtgtgtaaatatatttttaattttaagtatataagtgcagcagaattttaaaaagcagagtaaatctcagtatataagataatttaccacatttcaaagggataattcaatccaatggtgaaaaagggcacatatatatcataaatgttaactgatacaacttgctcatctagaagaaaatataattgatccaatacattgcaacagatgcaaaaactgatttcagatggattagaggcttaaatgtaaacaataaaatatttaagatattaatctcctaaatttcctttatacaaacaatccagatgtagttttttaaaccaagataggaaacctaaaagtcataaaagtatggatagacacatgagactgcatggaaacgaaggattctttagtggcaaaaataaaggaccaaagacaaaatcaggcggaaaaaaaggcttgagatatatgtaacagatgagttaaccattgaaagaactctttccaattaagaaaaagttcacccagtaaaaatatggataaaacatgtcaccagaagttcacagaagagaaatccaaacattcaacaaacagtaaaggatgtgtaaccttactagtaatcaatatactaacaatgaaatattatttctctgacaagcaaaaattaagtggtaaacctactgctagcagggatatgtggagaaggattatctcataaaatgctagcggagatgtgaagtgttagagtttttcctagtaaacaatcaagcaacatcagttaatactgagaatacatgtattttccacccatcagtctaactccatgtaatcttttccttagaaataaaagcaccagtaagagtttacaggagtgttagctgcaacagtgtttcaattttcaatgttagtagtggcaaaaaacgtggaaacaaagggaatgcctgttaataggggtattgttatgtaaattatggccgaggcattttatggaatgttgtgaagtgattaaatggtaggagttaaatctactggtgattagaaaggatttccaagtacattctgaaaggatttctatcatgtgtctttttttttttttttttcctgagacaggatcttgctctgttacccagattggagtgtactggtgctgtcttggctcactgcaacttcctcctcttaggtttaagctatcctcccgcctcagcctccagagtagctggggctacaggtgtgcaccaccacacctggctaattttttgtatatttggtagagacggggtttcaccttattgcccaggccatcatgtatcttaagaaaaaaaaatacaaagtacagagaaacatttgtaatgataactcattttttataaaaccagttgaaaaacaccatgagttttgtatatttttacctggttgtcaccgttggaaagaggaaataagcagaaaaggaaagagacagaatatccatagtaacatatttatataaaactacatgtttgtacatgtctgtgtatatgatggattatgggaaacaatgggcactaagatgatttactttcttccttacactttacattatatgtttttatttttacagtggacatgaagtgtttctgtaattaggaaaaacaggctgggcatggtggctcacgcctgtaatcccagcactttgggaggctgaggcaggtagatcgcttgagcccggtgttggagaccatcctgggcaacatggcaagacccccctctaccagtaaaaactaaaaattaaaaaaattatttgggcacgatggcatgcacctgtagtcccagctactcaagaggctgaggtgggaggatcacttgatcccggggcattcaaggtttcagtgaactgcgaatgtgccactgcactccagcctgggcgtcagagcgacaccctgtctcaaaagtaagaaaaaaaaaaagaaaagaaaaatgtaccaaaaaatgatagggactactagataggattacaaatttggcatgttatttttggtatggatagtcagtgctatcgacacgctttctgccttagagtgtagagcacattgcacaagtgtgggatctgtcacctgacttaatcatatgacagaatcataagaaaagtccctatttgggttttggcatataaactggattacaagattaacttgccttaagaaaactttaaacaagaacttctttaaagaagcaaaataaaaagtacttataattgtttaatacttgatttctgtccttttaaaagtatctccgtagaatacatcattcaaagcctagacagaaaatagcagatgctttagagttggatttgttgcatacttaaagtagctgtatttttttctcacattggtattacttccccttttcattaccagttttattaattgcatatatgtgctttaatgtaagctgtccaaagttttttttacaagagttgggatatatgtaaataaaaataattttagagtagtattaatataacaaagagatgaaggaaaccagactgtgtgagtcaaatcctggctctgcttcctagtggtgtgactttggaggagttacttgtgtctttttgcattgcatttttctcaactttaaaataaggataataagagtatttaacttcattggatgttgtgaataatagaagcgattggaataataactagcacataaggaccgtatatatatttgccagctgggtgcagtggctcacacctgtaatcccagcactttgggaggccgatgcaggcggattgcttgagcccaggaattgaagggcaacatggcaaaaccatgtctgtacaaaaaaaaaaaaaaaaaaaattagccaggcgtggtggcacacacatctagttcccgctattcgggaggctgaggtgggaggattgcttgagcctgggaggcagaggttgcagtgagctgagatcgtgccactgcagaccctgggtgacagagccagaccctgtctcagaaaaatatatatgtaataataatatgtgctattatttgctcagtcaattaggtgcaatatataatagttttacttggctcagttgttttaacattcatttactcatccaacaatatttttaattcagttgaatgggtaatacatgtacaaatatggtaaaatttatatattcatacaagtgtgttttctctcccctcatccttattcttttcttcccccatatatttatccacaaatggtagcacctcttcgtattattctggaccttacatttttcgcttgagtattacgttggagatcttttcacattgatacagttaaaactgcctcattctttttaatgatagtttagtattcaattgtattaatataccctcatcatcatatgtaacatttattgagagcttactcctgatccaaatgctttcttaatactttagttttattaactcatggaagcctcataacaacctatgagataggcactatttttctatatttaacaaatgaggaaaactaggcacgggatgattaaatgtccaacagtcacacagtttataagtggtagggctcaggattagagcccagggagtcactttccagagattgctgccataataccgctaaacatgtagcctgtcatagtattacaaggtatttaaccagcctccatattaatggacattccaatcttttgcttaagaaacagtgctatagttaatattttgttaatagaacattttgtacatctacaataaattcctagaaatggactagccatgtcaaaggtaagtacaatttgaattttggtgggcactgccaaattgctctccaatttagggatgttcagaagttcacctttgtccttagtaatttgccaaaatctgccatttagcttgggtctttggaaggtgtgcttttaacatttctagcatccctgaattgtgtgtgatctaccatcatgtaatagcttaagttactatcatatggaattaatgtaacaatgtcagtatgagaggtgtgacctttggacttactactttcaaataacagtaagtattttagatataacttgaaatactccttaatgtgatttatacattgaaattctatcaatcgaagtttgaatagatattgttgaaaaagtaaaatgctgtaattgttaataattgtgaagttgctgattttatgtaccaaagcaattatgtaagagtgttcaaatagttaaatagtgaatcagattgcatttgaacattaagagtgtggtagctagctaaatagaggaatagctgggtcctttcttgtgaaaagtgagtttttgataatccgtgagtcctagtcgtaggtaatgcaaaatgaggtagcgaggagctttatttagatgagttataaaatccacaaattattttgaatataacacacttggtttcagtgcccaatatttcacttgttcaagaaaggaaaaagtatctctatgaatctaagaagcagattgactgacaccaaactcttcaatgtgatccaaaatagacacttaaaatacagaatcttctcaggtcccaacgtagtatacctgcagtgcctgaatatggccctgtagtacctgcttattgtacagtggggcgtgtgtgtgtgttttaaatatcacctcattctccctaaggtactctactgggtatagggacagcttggaaagtagctgtaaatagagataaacaggctgtcagaaacagttatttattgtgagctaattctacctcagagtagtataaagcaacagaaaataactttccctatacctccaccctccaaatgagccattgagccatatcaactttgatgtccaaattattagagcttaatctgagtcttggacaacaaacccttctatgcctcatggcacgaaagtgtgttcaagatggagttaatattttcctaaattctcattcaacatattgtaagctgatatgccattagccccattctgaaaatatagatgaataaagtacttaagaggcatatctgacttctacactcctgagctattaagtgactgtggaaattcccagaattagttaaacttggcaggaccagagagtgcccacacagccttatccagagccacatatatttattctaaatagacagacaaaaaactggtttggctaagttttcatctgttgcccctatgctgtttctagggttaaaattctcttaacaaatttgcataggtcaaatagtcctttagaaatactatattagttggctgggcctggtggctcacgcctgtaatcccagcactttgggaggccaaggtgggtggatcacgaggtcaagagattgagaccatcctggccaacatggtgaaaccccatctctactgaaaatacaaaaattagctgggcgtggtggtgtgcacctgtagtcccagctactcaggaggctgagggaggagaatcacttgaacctaggaggcagaggttgcagtgagctgagatcacacccactgcactccagcctggcgatagagtgagactctgtctcaaaaaaagaaaagaaaagaaatactctattagtcaacaaataaaagcaaaagtgaacatgtgtcctgtggaagcatgcctttataggagtcatgctggcaataacttgtgctttttaaaaaataattttattgatatataattgacatatctgcacataaagtatacagttggataagttttaatatatgtatacacacatgaagccagcactgtaatcaatatagtgaacatatccatcacacccaagagaagtttctttgttcctctttttaatcctgtccttccatacctccccacctcctgtccttaaccatccactgatctattttctatcattatagttagtttgcattacatgtatcgatgattcatattttccttgctgactattattccattttatggatataccatagtttgtttatccattcacccattgctggatatttgtgctgtctttccactttttggccattatgaataaaggtcctatgaacattcatgtaagtctttggacataagctttctcatggggaaataccaaggagtagaatggctgaatcatatggtaagtgtaattttaactttctaagaaactgccaaactgttttccaaagtggttgtaccattttacagttctactagcaatatgtgagtgtgttagttgttctacatccttaccaacacttcctttgtcagtcttttaaacttttagccattctgatagctgtggaatggcatttcattgtggttttaacttgcattttcctagtgactaatgagcttaagcatcttttcatgtactttgccatctatcttccttggttaagtgaatgttcaaatcttttgcctgttttaattgagttttcctattattgagttttgatctttgtagattctggatataagttctttgtcaggtttatgtctgtaaatattttctcccagtctttaccttgtctttttgttctaacaatgttttttgatgagcagagatttgaagtccagtttaccattttattcttttgtggattgtgcttttagcgttatgtcaaatccaaggtcacaaaggaagttttatagttttaggttttacatttaggtctaccatccatttttagatttttctatatagttacgggtttttttttttttttgcattttatgtatacgttggttctaccaccacttgttgaaaagacaatatgctttctacactgaattgcctttgcacttttgtcaaaagccagttgtccatatatgtgttggagtagagcctttttgagctaataaattttgtaaaattttaaataataatactaggcagattaatagggattaaattttatctgttcattatagaattatatgtgttctaccattcacaagattgaacaaattgaccattaaaattattaataaaattataacttaataaattgaatctaatttaatattttcttaatatttaagaatatttaatcataatttttgatcttagaaggtcattctgtgatggtaatatttggattcagctttggcgtcagttgaatattttaaaaatcttggccatcaagcattaggccaaaatgtgtattcagtgtactttgaaagggttttatcagttttcactcaacgattagagtttctatttccccccacacccttgccagtactgtcactgaacaatatttagtaattgcctactatgtgccaaggcattttactggataattggggtgttcaataaacaaagcagaggcggtccctgtttttctagcatttatagtctggaagtgaagacagacattgaacagcttctttcacattttttaatcacaagagtagtaagtgctattaagaagcaatattagagaccttgagcacataccagaggagcaggcagttaatttcttagtaaatcatactattgaaaacttctcctctccccacaactagtttagttaaataaaccctggttgttaatcatagtatactaggtaaactgttagaaacacagatttcttgtcctctgaattgaaaatgtctggacttttgactatagtcattatttaaatccagattgtgaggtgttttttcacctatcttaggcagcattcttttcttcttttatcctttgtgctttaggatatatttttattgcagagattttatgaattcctgaattaaatgtgaacctatttatgtaacactctcttctaaacattgggttaatatacctgagcacagtttatgaacctttgtcctcttctattccatccattaaataaacgagaggatggctgggcatggtggcttacgcctgtaatcccagcactttgggaggccgaggtgggcggatcacaaaatcaagagatcgagaccatcctggccaacatggtgaaaccctgtctctactaaaaatacaaaaaattagctgggcgtggtggcgggtgcctgtagtcccagctactcaggaggctgaggcaggagaatggcataaacccgggagtttggagcttgcagtgagccgagatcgcaccattgcactccagcctgggcaacaataagactccatctcaaaaaaataaaaaataaaactaaacaaatgacaggatggattcgtttaaatatagacatcggccaggtacagtggctcacccctgtaatcccagcactttgggaggccaaggcaggcagatcacaagatcaagagatcgagaccatcctggccaatatggtgaaactctgtctctactaaacaaacaaaaattagctgggcatggtggcacacacctgcggtctcagctattcgggaggcggaggcagtagaattgcttgaatccgggagggggaggttgcagtgagcctaaatcgcgccactgcactccagcctgcccatagagcgagactctgtctcaaagaaaaaaaaaatagacatattttcttttcttttctttttttttttctttttttttgagacagggtctcactgtgttgtccaagctggtcttgaactcctggactcaagcgtgatcctcccacctcagcttcccaagtagctgagaatacaggcatgagccaccgtacctagacagcatcattttataagtgtaatagcatttttagtacaacactgttgatgctgtctcttttttgttccttgtatgtgtgtcagtctcaaatgcctacatttcttacatttggctagtttagctgctcatgatttttttttttttggcaaagccatcaaaatttgctcagtaacgagagtaatatggtaattgtaaagttttaaaaataagtttcggctgggcttggtggctcgcacgtgttatcccagcgctttgggaggccgaggtgggtagatcacctgaggtcgggagttcaagaccagcctgaccaacatgtagaaatcccgactctactaaaaatacataattagccgggcatggaggcacatgcctgtaatcgcagctactctggaggccgaagcaggagaattgcttgaacccgggaggcagagattgtggtgagccaagatcgcgccattgcactgcagcctgggcaacaagagcaaaactctgtctcaaaaaaaaaaaagtttctaagtattttaagcaattgcctttttaaagtagtcatacagtttctagtttgacttcttttgaaggtgataattttcctgcatgattgcctgaattttgaaaaaaattggtaaagttggctgggcacagcagctcacgcctgtaatcccagcactttgggaggccaaagcgggcggatcacctgaggtcaggagttcgagaccagcctgaccaacatgtagaaaccccaactctactaaaaatacataattagctgggcatggaggcacatgcctgtaatcgcagctactctggaggctgaagcaggagaattgcttgaacccgggaggcagaggttgtggtgagccaagatcgcgccattgcactgcagcctgggcaacaagagcaaaactctgtctcaaaaaaaaaaaagtttctaagtattttaagcaattgcctttttaaagtagtcatacagtttctagtttgacttcttttgaaggtgataattttcctgcatgattgcctgaattttgaaaaaaattggtaaagttggctgggcacagcagctcacgcctgtaatcccagcactttgggaggccaaagcgggcggatcacctgaggtcaggagttcgagacaagcctggccaacttggagaaaccctgtctccactaaaaatacaaaattagctgggcgtggtggcgcatacctgtaatcccagctactcgggaggctgaggcaagagaatcacatgaacccaggacgtggaggttgcagtgagccgagattgcgccattgcagtcgatcctaggcaacaagagcaaaactccatctcaaaaaaaaaaatggtaaagtcatttcataggcagtttatctgacaaaagcctatccaaaagccagtcattgcagtgctaatacaccatgaaggttcaggattcaggaagagagtttgctgatgacagtccttggcactacgaacttggaattgtagactatttaacataagaaatttcattattattattaagtacattttgtggggggggaatactgtaggatttcagataaattaatactacattatgttgtcattattggattttaaaggtttttctaatattgcagtataacaataaacacgtatataaataagtccttatccacatgccaaatatattctcagaaatacagtttttgagtcaaaaggcttgaacatctttaagggcgtggttgcatattaccaattttttccccatgtttcctagaaaataataaacccaaattgaccttttcttgatggttatgggtcattcttattaccattagtcaattaacatctctttcctttttaccttccatttattcttttttttttgaggcagagtctcgctctgtcacctaggctgtggagtgcagtggcgcaatctcggctcactgcagcctccgcttcctgggttcaccattctgcctcagcctcctgagtagctgggactacaggcacctgccatcacgcccagctaattttttgtatttttagtagagacggggtttcactgtgttagccaggatggtctcgatctcctgacctcgtgatccgcccaccttggcctcccaaagtgctgggattacaggcatgagccgccacacccagtccttccatgtattcttatagagtagctctctaatgatttgctgctttaaatctgcagtgatccaaagtattaggtaataatttttaattgtgcataaattgagtcctaagactgtatgcaggtcttttgccatgtgcagaagctttaagactgtcattctacgagttcagagatcttttgttttcctgtttcttaggtcttcactttatttctattgaggttggcaagtctcacttctcgtgtatataaatattgtactgtatttagttctaataccatattttgttgtttctaggacatttttctcccatatttttaacagctctgaaattagtgcctgtcctgcaatttctggaatgccataatttgtcaggtttttttccttagtagtacatcaaataaaggagtttattaaaattgatattatcttagattaggtgaaatatggtgttaacttctagatagggatctgtgtgtttgtaagaattgctgttgtgagacatcagcatgaattcttaggtggttgtcttaccttgactttacctagtcagtaagttaaattgaattaaagtggcagggtgcagtggcttacacctgtaatcccagcactttgggaggccgaagcgggaggatcacttgagcccaggagttcaagagcagcctgggtaacagaatgagactttgtctttacataaaaatcaaaaagctgggcatggtggtacatgcctgtggtcccagtaagggaggctaaggcaggagattgctttagcccaagagattgaggctgcagtgagccttgatcgcaccactgtactccagcctgggtgacagagcaagaccttgtctcaaaaaaaaaagaaaaaaaagtatattagcaaaatgttaataacagtcccaaataggaagcagtcttggtacgcagtagagagagttattgttgttaggtaaagtatggtatctatttaatggaatagtatacagtttaagatgacacaaagactgtgtagcgcatagaaaaattgaagtaaaataattttatgctagtattgattacaattatgtaaaaaaaattaattgggaaataatgtcaatcatattcaaatggtgagatctttcattaggtatttttaaaattataagcatattgcttctgaaaacagattttaaagaaagatgtgtaacaaatgctttcttttctatttatattgttggctgtcttcttggctgtttgcatcataggtaagttaagctttaaatcaataggatcttctttgatgtcttgttttttctttgtaacctgaaatcaggaaaatttcctaaaaattcaaatgtgggatattaatgtgagctttacaattacttttcccccttcagtttatcaagtttaagaaataaaaaaaataaggcccggcacagtggctcatgcctgtaatcccagcactgtaatcatgcctgtaatcctagctcatgcctgtaatcccagcactgaggtggggggatcacttgagccctggaggtggaggttacagtgagctgaggttgcagtgagccgagattgcatcactgtactccagcataggtgataaagccagacccagaccctgtcttaattgaaaaaaaaaaaaaaaaagcaggaatttcttacccaaattctgtttcaggtagctttgttgttctgaacttaaaataattgaccagaaattttccacttctgttctctatttttaatagtagcaaagttgtatcgagtctgtgggcattaatattctgattatcctcaaatatgcccattttcctcttagatatgtccatttactttgtagtcacattgatgttttatcttttttttggctaatatagttagttggttatgtttgtgttataaagctaggtattagtaaaatacaatgttatgttttttaaaaatcttagttctgtaagagatggggccaggcgtagtggctcatccagcactttgggaggccgacgcgggcagttcacctgaggtcaggagttcaagaccagcctgaccaatgtggtgaaaccccatctctactaaaaatacaaaattagccaggtgtggtggcgcatgtctgtaatcccagctacttgggaggctgaggcaggaagagtagcttaaatccgggaggtggaggttgcagtgaactgagatggtgccattgcactccagcctgggcaacaagagcaaaactccatctcaaaaaacaaaaaagagagagagagatgagtggccgggcgcggtggctcggcctgttatcccagcactttgggaggccgaggtgggcagatcacttgagatcaggagttcaagaccagcttggccaacattgtgaaatcccatctgtactaaaaatacaaaaaaaaaaaaaaggtagacaggtgtggtagcacgtacctgtaatcccagctactcgggaggctgagacaggagaatcgcatgaacccaggaggcggaggttgcagtgagccgagatcgcaccactgcactccagcctgggtgatagagcaagactccatctcaaaaaaaaaggagatgggtaatttaggaacaatcaattcttgttttactaattactccttagtttgtattcacaaaatgtcccattatgtcacctttttttcatcttctcccttgtgcttgcgtttttacatagggtcagtaaataatacaaaaaagtcttagtttggttgctgtaacaaattgccatagactatgtgacttaaacagcaacatttctcatagtctggagtgtgggaagtccgaggtcaaggtgcctatagatcctgtgtctggtcagggcctgcttccttctggtttgtagatggacatcttcttgtatcctcacatggtagagagcagagatcatctctctctctttctctctctctttctttttttcgcttcccttgagacagtctcgctctgtcacccaggctggagtgcagcagtgcgaccatggctcagtgcagcctcaacctcccaggctcaagcagtcctccacttcaacctcctaagtagctgggactatgggtgcacaccaccacgcccagctaattttttaattttttgtagggacaaggtctcactatgttacctattctgttcttgaacacctggactcatgcaatccttctgccttagcctcccaaagtgctgagattacaggcatgagccactgcatccagctcagagatcatctctagaggggcactaatcccattcatgagggctccaccttcaggacctaattatgtaccaaaggcctcacttcctaataccatcacattgagggttggaattaaaatgtgaattttggggggacacatttagtccatgacacatggctttcttttctaaaaatggtatagttggtgcaaaagtaattgcagtttttgccattgctttcgatggcaaaacagcaattacttttgcagcagcctaatagctaaaggtgaaaactactgtcgaagtaaggtgttttgaattatttattacatacctaggtgttgtgaccagaccaaatctgggcatcatcactctttagttctgtcccctatttcttaatcaaataatacctatttcataggactagtgttaagaattaaagagatgtttgctttttttaacataatgcctggagtgtgatatgtacttaacaaatagtagttgatgttatgtctttttttttttttttttttttttgagacagagtcttgctctggcgcccagactagagtgcagtggcgtgatcttggcgcattgcaaccttagcttcctgggttcaagcaattctcctgcctcagcgccccgagtagctgggattacaggcacacgccgccatgcccggctaattttggtatttttagtagagaccaggttttgtcatgttggccaagctggtctccaactcctgacctcatccacctgcctcagcctctcaaagtgctcagattacaggtgtaagccactgcgcccagcctgatgttatctgtttttaatttcagaacattttactgagttactgctgtataagacactatgccatatggaagggaggaagtaggaaaatgatataatacgcactttgagggcagggatacttgaatccgtacatcagttttaccattgaccataggcttctagcgtatacattgatattgtggaacttgtacactcaatacagtattttgttactgtttcacccaatattgcacaattttatttgtaaaaatttgaagggaaaggaatctactttttttttttagttggagtcttgctctgtcgcccaggctggagtgcagtggctcaatctcagctcgctgcaacctccgcctcctgggttcaagcaattctctgcctcagcttccctagtagctgggattataggcacctgccaccatgcccagctaatgtttttgtatttttagtagagagagggtttcaccatcttggccaggcaagtcttgaactcctgatctcgtgacccactggccttggcttcccaaagtgctgggatgtgagccaccgtgcctggctggaaagtaatccatttctaaaagtgacataaaaatcatttctggacaagcttgttgatgaactgtaagtgtgtttagctgacacaatttaaattccattcccagtttaagtgtccaccctagcgttttatcttcactatttctttttcaggaatgccttagttttgatatacagttaaaatagaagagtgtgtgtgtgtcctcagataattttattccaataagaataagtttttcctgattgttagtccagtttgccatctgtgactttgctgttctctgctctttgattcctgcttttgtctacacatttcattgtagtccaccttagtaattcttatggattacttcattgatgaccttatgtatattcttaaccttttggtttatttttttaaaaagcactatgaaatatgtacaatataaaaatatttatttttcaaagtcctttcttgttgtgttggttaattgagtgtgccaataaaggcaacaaggactcagatgtcttttgtctttctattttgtcatccttagcaaggtgggctgcctgcttagctccctcaaggtcctaatatggctgccgcagttccagatgtcccaggcagatgaccaaatcccaaaggagagtattgtttctcatagcctgtatctttttttttttttttttttttgagatggagtctcactctgttgcccaggctggagtgcagtggcgcaatctcggctcagtgcaacctctgccttccacgttcaagtgattctcctgcctcagcctcccaagtagctggaactacagacgcacgtcaccatgcctggctaatttttgtatttttagtagagatgggatttcgccacgttggccaggctggtctcaaactcctgacctcatgtgatccacccaccttggcctcccaaagtgctgggattacagccaccgtgcccagctgcctgcatcttttaaaagaacaaagaaattatttccagaaggtctccaacagattttgccttaattcttatggttagaacatcatttattatgtgcttatttccaaagcagtcgagggaactggaattacaataataggcttaacaaattttgaacaaagttggcttttggttggcaaggaaaaatcaggaaactaaatatacatagtgaaataaatctgccacataagccattctaataggattgctaggtaggtggattgaaggagatgaatagagagtgtcacaaaatgactagcactatactctaaaagtatgatcaggtaatgttatttgttggaattccacctgttctataactttctgaccaaacataaaaatattaaacagatttaagatacctttctctaaaaagattaacagtgtgtgaaaataagtaattggttataatccattagattcttctgaatcttttttaaaaaaaatctgtgatttccagagatagtctttaatcaattagatagaatgtattttttcattacactctaatgtaacaagtgttacatcaaaataatgcttcattatcaatgaagtgccccaggattttgtatgtgagtaaatattaccttggaatcttagtgtttaacttttatatatcacctcccctttgcccccaacagccatatcatccaagactttggtaataaaaagaataatttctgaaataatgaaattaccagttgcattaaccagcagcaatttggagtggactttataggaaaaaaattttttcctctggtgttatttgccactgcagtgttctgcagtgcctgttggggagaggctgatgactcattaactcagatcagttgcctatgctgcctttctggatttttcctcttctaccacagggttttggtttttgtttaaatctttcacaaattgggtagggaggggcactgctataatttgtaaccaaagaatcttagttgtaagttgcatttactttttatccttaaacacagttgaagtcaaaacagctaaaggcaacatttttatataatcattgatttgatttttctatgagtgcatctgtgtataccacactgctttcatcaaagtatgtaataagtattcctgcttttatttatttatttatttatttatttatttatttatttttgagactctcactctgtcacccaggctggagtgcagtggagcaatctccagtcactgaaacctccacctcccgggttcaagcatttctcctcctccagcctcccaagtagctgggactacagttttgcatcaccacacctggctaatttttgtattttttggtagaggcagggtttcaccatgttggccaggctggtcttgaactcctgaccacaagtaacctacctgcctcggcctcccaaagttctgggattacaggcatgaattatcgagactggcctcatgcttttattttttaaatgttggagaacaacaatagctgtataggccgggcacggtggcttatgcctgtaatcccagcactttgggaggccaaggcgggtggatctcctgaggtcagcagttccagactagcctggtcaacttggcgaaatcccgtctctactaaaaatgcaaaaaattagccaggcatggtggctcgtgcctatagtcccagctacttgggaggctgagacacaagaatcgcttgaacccggaaggtggacattgcagtgagccaacatcgtgccaccgcactccagcctgggtagcagactgagactctgtcttaaaaaaaaagaaaatcaatagctgtatattgtcttaagaaggagttattaaatagcctgtaaagctattttatgtagcattaaatcatatcatagtttggaccttatagagatttgggataaaattaactttcaggccaggcgtgatagctcatgcctgttatcccagtactttgggaggccgaggcgggcagatcacaaggtcaggagttcaagaccagcctggccaataaggtgaaaccccgtctctactaaaaatacaaaaaaattagctgggtgtgggggcgcatgcctgtaattccagctactcgggaggctgaggcaggagaattgcttgaacctgggagacggagattgctgcgaaccgagatcatgccactgcactccagcctgggcaacagagggagactccatcaaaaaaaaaaaaaaattaactttgaatataatctaacttgcagtataatttgcttattgaaagttggtgttctaggagtttgttttaacatttttaaaagcctatttttcactgagaggcgtaagcattcaatgatgaagcagaagattttaatgggatatttttaactattcacagataataaagaagagttataaacaaattagtatgttgtatgaccatgcttaccaaaatgctatatgtttagccctattcagtcatcaggtcaccatagtatgtctacctgatgagtaatttttatttcactgtggggaaaaaacacttgcatatttttctcttttttttttttttttttttttttttgagacggagtctcgctctgtcgcccaggctggtgtgcagtgacgtgatcaccgcttgctgcaagctccgcctcccgggttcaggccattctcctgcctcagcctcctgaatagctgggactacaggtgcctgccaccacacccggctaattttttgtattttcagtagacacggggtttcatcatgttagccaggatggtctcgatctcctgacctcatgatccgcctgcctcggcttcccaaagtgctgggattacaggcatgacccaccgcgcccggcctctttttttctttagttttttcagtttcttatttttatggatacataagtgtatatatttataaggtacatatttttcttataaaatttattgtatgagatgaagtagagtataaaacttgtttggatttcagagaatatacaagagcatgccaagaaatttccttgcttacggtagagtgctatagcatcctgtttctggtcacattctgggatggggtagatagaggagtggttattcacttcgatgtttacctggatcaatacatttgaaaggaagtgggtggaagcagagttgggcagaggaagaagttgaaatgcagtgcaagtccctcagagcctcagttacctagtgggagagatctggagtgattgttgcttgtgagagtatcctgcatcaggctgagatggctgggcctttgtacctccattgtgtccattcagcaggtgcacactgccctgcaagtggtgtgaatgcaggcaaggcagcactctgcatctgaggctgaccttgaagggttgacagctgttagttattcagtaatcactatgggagtgcttttggactggggatatttgagcagagacatgaatgatgtgaagaaatgaatcctggagaaaagaacattctagggaggagcacaggaaatataaaagatccatgttgctgtagcagattaaaatgtaaatattttaaaatatcaaaatggggctgggcaccatggctcacgcctgtaatcccagcactttgggaggccaaggcaggcggatcatgaggtcaggagatcgagaccatcctggctaacacagtgaaatcccgtctctactaaaaatacaaaaaaattagccgggcgtggtggcaggcacctatagtaccagctactcgggaggctgaggctggagaatggcgtgaacctgggaggcggagcttgcagtgagccaagattgcaccactgcactccagcctgggcgacagagcaagactccatctcaaaaaaaaaaaaaaaccaaatggacaaaaatgcttggaagtttacactttaaaactcgtgttttcataattattatgaaagatgtggtaagagcagatttcaggatgtatttacaaccacctctctgtataaacactatggagtagagaagattaaattactcagaatcagaatcatcatcatttttttctccacttaatattggcttttttttttttttttttttttgagatggagtctcactctgtcacccaggctagagtgcagtggtgcgatctcggttcactgcagtctctgcctcctgggttcaagcacttctcctgcctcagcctcctgagtagttgggattacaggtgcgcgacaccacgcccggctaatttttttgtatttttagtagaggcggggtttcaccatgttggtcaggctggtctcaaactcctgacctcgtgatccacccgccttggccccccaaagtgctgggattacaggtgtgagccaccgtgcctggccaatattggctttttaaaaaggacagtcatcttggtttgctaatacaagaatattcaccaaattaatgcaaatttatggatctagtgacaattatctttaagtaaatttgtagacttatcactaggactctaggttctcttattagtatgatgtcacttcctaaagtgtgccgtctttggcataaattaaataatatgtgcctaaaaattagagttaaaaactatagaatcattaaaattttcatgctggctaggattttccagctgactgctaaacccacaagactgctggatcatgaacaaacccatttggtttccgctaatcattgctcatacatttggaggcatgcactgtttaagtcttaaagggaaagtatgtaaataaatacttgttttaaaaaatcagaacagacatcattattccctcataaactttagaataccgtcctgaaccacaggtttcaaccatctgtagggaagctttactagatactctgatgcctctttgttcatccctccaagtctcagcttaacctcctattaagtgactttcatcctgcccaactctaggttagatgccattgctttatgctcttctaaatctccagcctatagtacttctaagagagcacatatgtcaccttataagaactacctgtttgtcttttcattccactatgccagaagatccttgggggaaagattgtgtcttacttcattatattttccatctataatacagcagctggcacatcatcaatgcttaaaaaaaatacagttggtcttagaaaataaagttatgataaaatgcacctgataactaggaaaaaaaaaaaactagctaagcaactagatttggttcaagataagaactatctaccccatcccagattgtgaacaagaaacaggatgctatagcagtctaccgtaaacagggaaatttcttggtatgctcttgtatattctctgaactccaaaaaaactagctaagagactagatttggttcaagataagaacaactagatttggtagcgaggtaagaatcactggacactttagaaatggacactttagaaaaaaggcaatcttagcttatattaatagaataaaattagtagtcatcagtattacttttctgttaggcatactgttagatgcctcacaaaaaccccattagattttacagatgaaactgaggctcaaaaggatgaaacaatttgatttgcctaaggacacaacttataaattcaaagtcttcaaaccgtggcatttgtctctcaataaaaggaagcatttgctgggtgcggtggctcacgcctgtaatcccagcactttgggattacaggtgggcagatcacttgaggtcaggagttcaagaccagtctggccaacatggtgaaaccctatctctactaaaaatacaaaaattagctgggcatagtggcacacactgtagtcccagctactcaggaggctgaggcacaagaatcgcttgaacctcagaggtggaggttgcagtgagccgagattgcaccactgcactccagcctgggtgacagagtgagaccctgtctcaaaaaaaaaagaaaagaaaaaaaaaaagcagcattcagaatagatgaagtagtactcttcagtactcactcatacagcatgtagaacgtttttttatttgtactatttaaaagaaatattgaccttgtgaaatacttctagaaaagggtagtctcaggagtgagggatctgaaaagattatactttgagggacaatggaaggcactaaagagaatgtgcttggagaggaaacatactttgtgtggctatagtaattggaaaaaatagggccaaaggattgaagttaagggaagtagatttaggttggatgtgagatagtatttctaaaaacagaatggctttttccaaattcaggacctatattcaaatagtgtaactgatgacatttttgtaagcgtattacatttcacaaggaactttttttttttttttttgagatggagttttgtttttgttgtccctgctggaatgcagtggtgcagtcttggctcactgcaacctcctcctcccgggttcaagcaattctcctgcctcagcctcctgagtagctggaattacaggcgcccaccaccacacccagctaatttttgtatttttagtagagacagggttttgccgtgttggctaggcaagtctcgaacttctgacctcaagtgatttgcccacctcggcccccccaagtgctggaattatgggcatgagccactgcacccagacacaaggaacatttaaggaaatttgtaatgcaatcgcaagtctggtgggtaggtggtagcattattactgtttttcaaatgcagatattaagagattttgatttgtccaagatgttctgcagcatgttattggtaggaccaggatgtgatcccaagtctgctgacccaagatctcatgctgtttccactttaataggcagatgaccatgtatcatgaatgctatagaggaaatacccatatgtggggaggaacttagactgtgtatgattgtcagtttcttctctgattttgaaaatctttgattttctgaagattgaaatttcacctcattcacttgttcactacttctttgaagacttttcccaacctattgtccaattaaatatgtttgtctttaaatcttctttctgttttcccccgtattatctcatagtttctagaacgtcttgttctgtctctttagattccaatgttttacagtcccatgcctgctcttaatggcttcttctactgtattttcaggaagccaaaaatcctaataaatttctgccaggcgcggtggctcatgtctgtaatcccagcactttgggaggccgaggcaggcagatcacttgagcccaggagtttgaggccaatctgggcaacatggtgaaaccctgtctctacaataaatgtaaaaattagctggatgtggtgtcgtgtgcttgtcatgccaactactgggtggggtggggacgggggcggctgaggtgatcacttgagcccaggaggtcaaggctgcagtgagccgtgatcacgccactgcactccagcctgcgtgacagcgagaacttgtctcaaaaaaacaaaaacaaaaacttactttacagctccctgttcactatatttcatccacattggtgtacacttctgcaagttggaatcagtttctcctgtgctcccaaggtggtgtttgcacctcaattgagcatttaagtcattttgttttgctatatagctatttaaagcttcaaaagctctgtaaacatataataaatggaattccattgacattcaagccttacgtatttccagagcttcttcgacttatcctgcctcccctactttaattctgttaaagtagttgaacaccattcttctcataatagttctccctcaatcttcagtgatttccttgtgtttataggataaagtccacttgttattttggcagtcagttcaagatccacaaatcagtctttacccttacatccttatttctcactgctgttctaatatagtctttataccagtcaggctggtctgttcactattcctgaatgtttttctccattcttttgttattggcacccccgctaccctctgcagtgtctttgctacctttctttttctactgtgtgcaaattctacctgaccttcaaggtatcttctctaaacattctaatctttgaacttttagtaaataagggtatattatttggtactttatcacttattgatctatgactctttgtggttaattttggacattatttagcttttcatgtgtacatgtatttcatctccctcattaaattggtaatagttattaaggtagatcagcagtcacaaataaactttctcctttggcatctgttaccagttttcaatgtgaacttggatagttcctgttttttaaattgtatatcaataaacaaagaggttgaaatgaatttcttaaactattctgtgtgttccactaaaagaaaaaaggaaaaacactcatagttaaaatttaaagataggtaataaataaatacttttaaagagtaaaatatatcatttgttacattgtgaaaagtgctatggtataaaatagggaaggaggaaggatgttgcagttttaaataaatggacagagaagcctcatggagaaggtgatgtttgagtaaagatctgaaggagtgctgaacatggtggctcacacctgtaatcccaacacttcaggaggccaaggccagagaatcacttgagtccaggagtttaagaccggcctaggcaaaatactgagatcctgtcttcacagaaaataaaattagccaggtgtggtaggacacacctgtggtcccaggtactagggaggatgaggtgggaggatctcttgagcccaggaagttgagttggctgtgagccatgatcacaccattacactcctgccaaatcgacggagacagactgtgttagaaaaaaagacctgaaggaggtgtaggagcagataccttggagaataacattctaagcagagggaacaacctgtacaaaggccctgaggtagaatgtgcttgtgtttttgagagctgacaaagagttcagtgtgtatctgcagcatgattaagtgaaagagtagctggataagtcagagaggtcattgaggatgggcttgttgtgggggtggataagttattgaaaagacttcacattttttgttatagttatcgatatttcctatgaaatacctcacatagagatataattcagttgtgataaaaccatccagcatccaggaatagggtacttttaactacattttaggaattttggctgggttcagtggctggctcacgtctgtagtcccagcactttgggaggctgaggtgggtggatcacttgaggtcaggagtttgagaccagcctggccaacgtggcaaaaccctgtctctactaaaaatacaaagattagccaggtatggtcacgtgcacctgtaattccagctaccctggagggtgaggcacaggaattgcttgaactcgggaggcagaggttgcagtgagcagagatccttccactgcactccagcctgggtggtggagttagactctgtctcaaaaaaacaaacaaacaaacaaacaaaaaactagttgggcatggtggtacacacctgtagtcatagctacttgggaggctgaggcaggaggatcgctagagtccaggagtctgaggctgcagtgagctatgactgtaccaccacactccagcctgggtgacagagagcctcttaaaaattttttttaaattaagaaaaggaatttttttattctactttgaagaagtataataactcaagaatacaccaaagatgagagtggtctcatcttagtggactacctatattttgggtcttttgctttacggtttataattataacttatttatttatttatttactataggtaaactaacattatggatttttccaagctacccaaaatactcgatgaagataaagaaagcacatttggttatgtgcatggggtctcaggacctggtaagtaatacatcataatctcaaaataaggatatctaactttgattaatgtcttttcaaaatattttacatagaaatatacaactttctgtttacctgcataaattctgtttgtccttaggcgatctcatagtgactataagaccgaagtagaatctctgtcataagggctcatctagcattgattatctaaattttataattattgaggtactactttgtgatatcctgtttataattatgtaaatgttcaaccagtgttcagttttatatgtcttaattttttgttaaatttgaggtaaataaactatgaagtttatagcttttaatatgtaataccttgcatatagcaggcattcagtaaatgttaatttgctttgaactttaataattcaaacgctcagagcatttctcagcaatattagcttttgccctttgcatttatgaaactttttgaatggttattttaagtgtcacattattaactacctgtgggaaagaagtcttaggacccaaactttatgtccattctgccaaaacatggagtgctgctttttaaataataaatcttacgccagtatttgttttgttattgaatactcccactacacaatgtgattcacagtcacagtttctctaagtaaaacctggtcagtgatgtattatccttaaaacctcatgctatatagtctttttcttgttctagttagagtagtggtgatgacagttttttgatgtttacgcaaatgaagactgtcagtcactgtgcctcttttttctcccccaagaacttggtgtttgagcttgatttcattggcaggtcattaaaaggttatcagtatcttttgccatgcagagaaataattgtcctctcaatgatcataagggtcttcaggatggacagactaaacccaagaacctttagagaaaaggcaaaagaacatcagagagtttaggaaaaaatattctgtgaaactgtgtagtaaactgctcctggaaacaatttttattttattttaaaaatttttttaaattttactttaagttctgggatacatgtgcagaaagtgtaggtgtgttacataggtatacatgtgccatggtggcttgctgcacctatcaacctgttacctaggttttaagccccacgtgcgttaggtatttgtcctaatgctctccctccccttgcctcctgcaatttttaattcttaagtacttaataaggtaatggaacaatggcatccttttttggcttatgaaatatgatttttaaatttcattatctctggtatttcagtgcatcttaattcttaagtagtcggcatagaggtaaatatttatagaatgaataagtcttcattgtttttacacaggttaattaactcataaagctttaatagtttccactgaagtattacctataacatagttctaatcagttgtatcagaaggctaaatattaaaaattggtttattcttacacgtgtctaaaaatatggcaaccttccttccctgctagaaaagtaatttttgcttactagaccacatggtccaaaatagtaagttcagtaaatggaattccattgacaatttcttacccaatggtggtgactgattataaatatccttacggcctatgaaaaaaattttgtagatgtgtgtgtgagtttttctagtagagctattattagtttttgaaaagggtccatgtcccagaagagttttaagaactactgctataagttattagaaagtaaacatgttgctttaggtctgtctctcaaaggaaatggtaacagcacagcgaagtgataattgtgtggcattctaccatactactagccaaaccatttattccaatttctacttttaaaagttttttttattgttccaaagccttcactccatgtatcatagcaactctcagaacatacctgaatcctaccaggtaagtttgccatgcagaacttgaaatgtttgaaaagttttcatgtatattatgtaaataaataatctttggcttacctctttatattatacactaaaatatatatctatgtgaaactaccagtatgttccatagtaggtttttatccttcttatgaatatatgagagaggcacaatactgggtttattgggtgttttaattatttgtgactattcacagagcactagagtcttaagtcatcaaaatagtcttttgttctcttcagtggttacagcctgtgacatggcgggtgcagccatgtatgagctggtgagagtgggccacagcgaattggttggagagattattcgattggagggtgacatggctactattcaggtgtatgaagaaacttgtatcctttttggctcaatttcctgccactttctatatttcaaaatttaaggatttaggccaggcatagtgcctcacacaaagtaatcccagcactttgggaggcaggcaggtggatcacctgaggtcaggaatttgagaccagcctggccaacatggtgaaactccatctctaataaaaatacaaaaatcagctgggtatagtggcaggcgcctgtaatcccagccgcttgggaggctgaggcaggggaatcgcttgcaccctggaggtgggaggttgcagtgagcagagatcgcaccactgcactccagcctgggcaacagagtgagactccatctcagaaaagaaaaaaaaaattgaggatttaagccaaaggtggaagcagcaaagcagcaacaactaatgatattagaagcatgaaatgctggtgttgtgaagagacctgaattatgcaggagtatgttaaagaaagagagaaaagtactatgaattggtactcttattttaagaaattagtatcttctgaactttcattgctcttactgcttcagtaattcatgaacttaagggggaccaagtgaattttttcttcattgggacgcatattgtagaagaaagcgtaaacagaataacaatattgacttgtgaggttaaaattctctaattatgatttcagtttaaaatagtaagtccacaaataaaacggtcaccattcttttgatagcactgagtgacatattacatttcagttttattactaggaaagctttactatttggttatcataattttggcttttaaacatagtatttattttcaattttctatgaaaaataaagggttaagcctagtgaagaagaaccacttttttagtgcttctatatgtgttttactttgattctcaaaatcagcattaattctttgagtatttaatcaagatttatttggtacgacgtttttgccattctaaaacacatgcgtgcagataactagtctctttatagtactaggtgccaatttaaaacaaaatcatctagaaattttaaataaaaatagaagtttttgtagctatgaaattgtgactaatcagaaatattttttctatttttacttttatcttttaatctgtttaatctttttcatggcttgaagatttaaaataaatgaaaatgtaaacagtgacaaccctccttgcctttgttgtcttgtatctagccgtttatcaaaacacatacacacctccatgcacacatggaaccacatttatagctccctttattttatatccttctagtttagtaattacatacatgagcaaatacaaatatttgtatttttctttcctttctctctctctctctctctatatatatatatacatgtgtatatatatacgtatatatatacacatatatatatatatacatatatatatggtttttttgtttgtttgtttgctttttgagacagagtctcactctgtcgcccaggctggagtgcagtagcatgatctcggcttactgcaacctccgcctcccaggtttgagcaattctctgcctcagcctcccaagtagctgggattacaggcacgtgccagcatgcccggctaattttttgtatttttagtagagatggggtttcaccatcttggccaggctggtcttgaactcctgacctcacgatccacctgccccggcctcccaagatagcatattttaggtactgttatacaccttgctttttttcacttaaaagtatgtgtattctagaagataaatagatatgtgataaatatagtaaaatgttaaatatagaacctagcttgtagagactgggagtccactgtaaaattctttcaactttgttgttgttctgaaaattttcataatcaaaattggaaatgaaaatacatagtttagagagatttctagaggaattcatgataactctggttcttttttttacagccatataacaattccatcatataaatgtaccattatttacttatcaatgtcttaatgatagaagttttggtttctagtttttggttgttataaacagtgctacattgtaagtatagtaagaattcacagaagttggattcctaggtcacgacttacccattttgaattttgataaatattgctaaattgctctcaggaaaagttgtactgattttactcctgtcaacaaatgtgtagaataaagtggactcattatgcttatttatatattttattcttatttgtatgttttcaaaataactttattcttaagattttaggttttgtccaagtactaatacccttattaggggactgatattcctcagcagcatatgtgaagcaatgtattaatgagggagttttgcttctgtttttagccctgtggttcccaaactttgcagagtcattctgagaagctgcagcaaactcatgtggtgccaggatatttaaaatttttgaggcaaacacaggaatgttagacatattgtcagacaccacatgaactagtagcttgagataataaacagtttcattatgttgctgtactatatttttgtcaatgatgtcatatctttgcaaagctgagtttttggcagttgctaagctacaaaagcaggtatcatgtgacaatcaaaatggaacaagtttccaatctgattgcaagattggaaaattatatagttccccaagggcatatacattcatgagaattatggatatttaggactgaaattaatattattttttctttcaacttatgcatatattttttcaaattgctactcagttgttaggacgtatatacatattaggttgtttagacataactgtttaataaatgcaagtgttagatatatcttttgtcctgggacactgaaagaagttactgaaaacactatgaatcctgtgaactgagaaagtttgggaacttccgttttcacttcttgagtggcatttccttgttaaactgtggtatttcctgttaattgtgtctttaaaccttcatagtaggttttccttagctgctgtttttagctggtgtgtctgttggagatcctgtacttcgcactggtaaacccctctctgtagagcttggtcctggcattatgggagccatttttgatggtattcaaagacctttgtcggatatcagcagtcagacccaaagcatctacatccccagaggagtaaacgtgtctgctcttagcagagatatcaaatgggactttacaccttgcaaaaacctacgggtatgtctgtgtaaccaagaatttctgaagttattgaaagaatataaaatgaatgtttagtaaactacattgtactcttagtccaaataaaaatagactacagaaggatagtttaaagtttttcttaactctacttcatgggattttagaactaatgttttattgataagtcaggtaattgatttaaattatagcagcaggggcaagtctacttgacatttatttgcaaattaaacagcaaatacatttatctctaggttggtagtcatatcactggcggagacatttatggaattgtcagtgagaactcgcttatcaaacacaaaatcatgttacccccacgaaacagaggaactgtaacttacattgctccacctgggaattatgatacctctgtaagtatcatttgaactttatcctgcagagtgcctctatttctatatgatagctgcccagttttagtgccctaagtaattaaagaattgatatttaatacataagttttgagtaactcctataatttttgaaagtttttgtttgtttatttttaacttggatttagggatgaaaaagcagaacatagtatttctttttaaagaaatgtaacagttttctaccatattaactgatgctacatttatttaaagccctagttgtttaggcatagaatagactttgattttaatggtgtatcaatattcacatagtaattatataatgggaccgggcatgtaggctcacgcctgtaatcccaacactttgggagggcgagatgggcagagcacaaggtcaggagatcgagaccagcctgaccaacatggtgaaaccctgtctctactaaaaatacaaaaattagccaggcgtggtggcgcacgcctgtaatcccagctagttgaaaggctgaggcaggagaatcgcctgaacctaggaggcggaggttgcagtgagctgagatcgtgccattgcactccagcctgggtgacagagcgagactccatctcaaaaaaataaaaataattagtattattattatataatggattatttgaattctctttttttcttttcttttttttttttttttttttgagacagggtcttgctgtgttgcccagactggagtgcagtggtgcaatcatagctcactgtagcctcaacctgctgggctcaagcagttctatcacctcagcctcccaagtacctgggaccacgggcacatgccaccatgcccagttaattttttttttttgagatggactcttgctctgtcaccaggctagagtgcagtggcgcgatctcggctcactgcatcctctgcctcctgggttcaagcgattctcctgcctcagcctttcaagtagctgggattacaggcctttacttatatttaactatttctttgttgcttaatatacttctttctttctttttttttttttttttgttttaggagatggggtgtcactatgttgcctggggtgctggaactactgggcttaagcaatcctcctgcctcagttttctgagaagctgggattacagtcacaagtctgatatactcctttctaactcagaaattttgtttgtaattattaaaaaagtaataaatgcaccaggttaaaaaaaaaaaaaagctaagactatatataattaattataataaaaagtataaatctccctttgcacttacatgtatcaccttcctaaccccaaggagaatcgggttactttgattttgaaggaagaaatgttcacaaatttgaccatactaaaatcctactgtatttctataggatgttgtcttggagcttgaatttgaaggtgtaaaggagaagttcaccatggtgcaagtatggcctgtacgtcaagttcgacctgtcactgagaagctgccagccaatcatcctctgttgactggccagagagtccttgatgccctttttccgtaagtttgagatgtgtcccacgattttccctcagagttattatatgtgcttatgtttttattatctttatagataaagggcttatgtgtttaacactataatacattttatctagagtaataatggtgaattaaatatttttatctattgctagcacttattataaattcaaaccattgaagatttacttttttcatggttgcccccagaaagcattatttctgaaacttttctggaaaaattaaatttgctgaagaaaatctgtaccaaaacatttacttttttcatggttgcccacagaaagcattatttctgaaacttttctggaaaaattaaattttctgaagaaaatctgtaccaaaacaatgtaactctgtttcttcttcttcttcttttttttttttttaattgagacaggatctcactctgtcgcccaggctagagtgcagtggcatgatctcagctcactgcaacctctgcctcccagctcaagcaatcctcctcctgcctcaccctcctgagtagctgggaccacaggcatgcaccaccacacctggctaattttttgtatttttggtagagaccgggtttgactatgttgcctaggctgatctcaaacttctgagctcaagtgatccacctgccttggcctcccaaagtactaggattacaggcgtgagccattgcacccggccaccatgtttcttaagttattctagactgggaaccaagacagaagccccacccaaataactgggataacatttggaagagggaaagaaaatagtacagaatgtgcttctaagtgctgtagtgtactcatagctctgcagaaacaaggctttaatctgatttttggtgaaggaaatctctgtagtcatcacgggatccaggggatcagtttagtcccaaactccatgcctgggataaatcaaactgagaagcaagcaacatgaatacctaactttaagtttgatgctggatctacttctagatttaaaattattaaataattcagatgacaaagcagggggaaaatgccctgtttcatggcaaagaagtaaatactccaatatctgtagctttcaactgatgtctatttttggcttaagcctctctgtaaccaattatataattttacggtaaactgattttgtgatgtacaaagttcaaatgattcaagtataaattattaccaagcaatttattatgtcactcaataaaccaaaagcatgcacaggaatagatctcccagcataaaggatgtatttaatttatttgcatgtgtaactttttaaaaataaagaattgtggtataattttaaaaaaatagtagatttatgtcaccataaattgatgatttctattaaaagtaatggcaaaaaccgatatcattatttttgcactgacctaaataaaatcaactgggctttctctgctgcccagcaatctttcttaatttgttgtctgctctttccattttctacgactgcttaaaaagcgtaaaccgtctcctatctctctctctttctctctctgtctctcgctttttaagagataggttatcattctgtgacccaggctggaatgcaatggctagatcatagttcactgtaacctcaaactccaggactccagttatcctcctgccccagccttctgaatagctaggccatgggcatgcaccaccatgcccttctaatttctaaatatttttatagagacagggtcttgctcttttgcccaggctggtcttgggctcaggcggtcctcccacctcagtctcccaaagcattgggattacaggcataagcgtctgtgcctagccttattttatcttattcttttcatatatccctcttctccagtttattgaatatatttcatagtgctttttctttctttaacttgtgtttttgtgttccttacctactttatttttatttttatttatttttattttttttgagatggagttttttgctcgtcacccaggctgtagtgcaaaggcgcgatctcggctcattgcaacctccacctctcaggttcaagcaattctcctgtcccagcctccagagtagctgggattacaggcacccaccacatgcccggctaatttttctttttttttttgtaattttagtagaggtggggtttcaccatgttggccagtctggtctcgaactcctcacttcagatgatccacccgcttcggcccccacaagtgctgctgggattacaggcgtgagccaccgcgcccggcccctactttatttattaatatctattagcaagtcaagtaatccatactttgttttctttgtttaggtgtgtccagggaggaactactgctatccctggagcctttggctgtggaaagacagtgatatcacagtctctatccaagtattctaacagtgatgtaatcatctatgtaggatgtggtgaaagaggaaatgagatgtctgaagtcctccgggacttcccagaggtctgtataaagcttcaaataatatcctagagaaaataccactcatcagtgttcattgacaattaataaagctttgtgttgggtctggagcaatgctgtcattcgtcaaggatctttaaggaattttaaaattatatttgtaattaatctgtatattcaagaaaaggaattttaattttttgtgtgtgtgtgatggagtttcactctttttgcccaggctggagtgcagtgacaccatctcagctcactgcaacctccacctcccaggttcaagcgattctccttcctcagcctcctgagtagctgggattacaggtgcatgccaccacgcccagctgattttgtatttttagtagagacggggtttccaccatgttggccaggctggttttgaactcctgacctccaataatcgacccacttcagcctcccaaattgctgggattataggcatgagccaccgtgcctggccaggaattttaattcttaagccaaacacttgaaagtttctttttatggtctggtggtttttacttattgagagaaagatgaaataaagaaataaaacatttatagatgtgaactttatgtgtgatttatgatctagattattatagtagtatttcttttttcataaaatatttattttatttatgaaattgaaataatgtctatcttcttcatagcaccgtggagcagagaagagaggttggagtggtggggaatattactttaggaacactgattgtaagaggcattaaatatgggcaaaagtttaaaaaaaaaaagaaaaatagggagggctaaaatgttaccttagaaattggagattcactaatatatattttacctctagctcacaatggaggttgatggtaaggtagagtcaattatgaagaggacagctttggtagccaatacctccaatatgcctgttgctgctagagaagcctctatttatactggtgagtatataattggaataaaagcagttaacatctgttcttaagtgtaaagctagcaccaaacttttctaaagagctttttactttcattctaaaatatctctgtacatataagcacattcctagcttttaaaaaatattttacttggccgggaatggtgactcacgcctgtggtcccagtactttgggaggcccaggccggcagatcacttgaggtcaggagttcgagaccagcctggccaacatggtgaaaccctgtctctactaaaaatacaaaaaattggctgggcgtggtggcagccacctttaatcccagctactcgggaggctgagacaggagaattgcttgaatccgggaggctgagacaggagaattgcttgaatccgggaggcagaggttgcagcgagccgagatcgcgccactgcactccagcctgagcgacagagcaagactctgtctcaaaaaaaaaaaaaaaaaaaaaaaaatttacttactatgtcttcagaataagtgaatgtaagacatttatagagctgtctcaatctttttaatgactgtaaaatgatcttatactaccttttttcactacatgttttatcattgatctagttttaaatatacttgtacctttgtaacttgaattatcagctttgaattaatatattttgtctggggatataaaagataagacaattcatgtgttaatgacctttcatctttggttccgtttccatcccagcttttatttctacattttcaggatttataaaacttacattctattctgtagccataaagccaatatttgaattagctgtagacctacattaaaatggagttaatgctcaccaacagtcccttggctataatttctccatttcttgattggctaagatttgacttttggaagtttcttcaagaagacttatggcaactgtgttctctgaattcttgtttcttcataaatttattttttttctactgcctttaaactttaatagtagtttggctgagtataaaattcttgatcaatatttctttctgtgagaactagtattaaatgctggggacattaaaagctgaagctggcctctttttttccttttgtaggtgatttttctcttttcccaaaggactttctctttaaatttgaagtctcttaactttattaagatatattccaatattgatagtttcattaaatttttctggatacataatgtgcccttttcatctatgaaatatgtcttttattttggaaaaatttagaaaattgcatctgaaactttttcattatggctgtcttcttcaaatataccaactagacatgttaggtttttgttatctattttccatgtgcatcatttcctctctactcctttttatttagccttgtgtctgttcacaggataaatggtatttattctttgtgttgcttctaatgaaaccttcacttctatttctttttgttctttcagctcatcaagtatctcttcttatcttactccatatgccttgagattttattttgtagtaggctgcattattagggtttttttttttttttaactgtggtcacagttttcatttattctttgacaagttatttgaccatcattgtattcttctcttctgtctttttccttattttatttttgtttagatatcctgtactgatatttattattactattactcatctttgtaggagatgagagggctggctgtgactgtgtaccagggtagcaggaattcttcatggtaacttgtgaagtttattatggcatgcagctgtgtaaaaaagctattttactcttcttgcctgataccagaaatcagcagctgtaagaccattcacagtgaattctcctctgtctcacccacttttcatttagtgaaaatagggagtacctacttgtgttttattcatccctatcttcctgcttctctttgatgccaaactgagtacaaggaactccttcctgcgactggccatgtagctttttgcagtgttccaaacaaagcactcttgctttgtttggaaacaaacaaggcacttgaagatgtgccttcaagtttgcagaagctttatctgagatgcatggcctcagatgaattcttggcatttttccatacccttatttggttttcaccttatttaggtgactttttaaattatattgttgtgggactatgtctcctagtttttaatgactaaatttgtatttctgtatttcttgttctccttgtttggaggtaagttttatgaggaagagacagtgacatattcatctaccattttaagaaagctaccttattcttttaaatggctgcacagtatccctttgtatggatatatcataatcaatttaactggcatctttttggtggactattggattctttatcgtcgtttacgataggcagcactaaaacatccttaaacatatatttttacactattctttgtatgttttgcatgcatgtttctttgcatgttttttttttccttagagacagggtcttgctctatcacccaggctgaagtgcagtggcatgttcatggctcactgcagctttgacctcctggtctcaagggatcctctcatctcagcctcccaagtagctgaggctacagacatgagccaccatgcctggctaatttttttattttctgtagagatgggggtctcactatgttgcccaggatgggcaacttctagcctcaagagatcctcctgccttggcctcccaaagtcctgggattataggcatgaaccaccatgcttggcctctttgtacatttcttagggtaatttcttagaagcaaaattcctgccaatacagctgctaattattattttacattctgatagcccttcaaaagggctaactgtggacaagagtttctgcttctcaacatcttcaccaatgctagttttttcaacacgttcttatgataattatcaaagatacggaaaagttgaaagaatgttacagtgaataccatgtacccagcacttagatttgacaattgaaattttaactattcttgctttattagatacctgttcaatctgtatttaacaatgaactagcatctttcttgtgtgtatgaaccatttaaaaactgccttgtgttcattttccttttggatgatagttgtttttcatactgatttctagaaactctttttggttttttgttgtttttttttgtttgtttgttggttttgagacaaagtctcactcagtcacccaggctggaatgcagtggtgcgatcttggctcactgcagcctctgcctcctggattcaagcagttctacaacctcagcctcccgagtagctgggattacaggcatgcaccaccaccacacctggctaatttttgtatttttagtagagatggggtttcaccatgttggccaggctggtctcgaactcctgacctcgggggatctgcccaccttggcctcccaaagtgctgggattacaggcttgagccaccgcgcctggccagaaactctttgattaatgaataaattcgtcctttatctgtcatgagttgcaaatatgtcccagcttgtttatctcttgattttgtctgaggcatatttttcttgtaggcactgatacctgtaggtctgtcagagaattctcacttactcatatgtatctgtcttttctgccatttctttctaatatcacaagtatctgtgacatttcatcacagatttaaaacacagcatgcttgtataagaaagaatctgttcttattagattggaatatgtggtaattattgtgttgttgaagccttaatattgataagtaatgtttcctaaagactttcttcatgagaccattttatggatgcctgaacagtcagtattttttattctgaaagatgcaatatgataaataggaaagtactgaattttccactaattatgttaattttacttatataaacctctgtttctttaccagtaaaataaaaaaaccaaggcattataaaagttccaaaatcttttggaacttttataatataactatatatttttcctaatatcttagtgtttcatagcgctttgtactttttagatgacatttatttaattcacttcatctgccatatatacaagtatatagggcaggcgttattccatttttaataggttaggaagccacactgggaaatcaagttattttgctaaggttaatgacagaataggaactagaacccaacactcgtttctgtatattagctgcttataagtggtttactgtctaaatttacaggataggacctgatctgcatagcagaataatctggacaattaagatattactcattttaataacatttgctacttttgaaaagtaaccacccaagctgattggttaagggttacttttgcatgcatacatgtttgtgtgtgtgtatgtgatatatagagagaagctacatttgaaaattaatttcagacttaattatttcaacaaagaatagagaaagtcatttcctgctttctaaaatgtgcattatattagggccagctaggctatggcatcaaataattccaaatatatatttgctcaatataatagatgtttatttcaagtgttcagggcactctttactctgtcattctgagccatgatccagcctgaaatgagctctaccattttcaacacatggcttccaagactactgggagttctttccatttcagtaggccagaaggaagaaagagtatggaagagcgtgtgacttgcctgaccgtagaacacattattttgacttgagttttgttagccagagatcagttacatggccatatctaagtgcacaggatgctaggaaacaattcagtgtgtgcccagaaaaagaggaagagcagctttgagggagccactagcagtctacgttgtgtacttattgctttaaggttttcttaagggtggaaaaaaacaggatttttatatgctagcattgtaacttataataatattcttcccaatttaggaatcacactgtcagagtacttccgtgacatgggctatcatgtcagtatgatggctgactctacctctagatgggctgaggcccttagagaaatctctggtcgtttagctgaaatgcctgcaggtaagtctgtgtattgcttatcatgtaaacaagactgatgggattttcggggctggcttagaaactctgttttaaaatttcttttcatttttcagatagtggatatccagcctatcttggtgcccgtctggcctcgttttatgaacgagcaggcagggtgaaatgtcttggaaatcctgaaagagaagggagtgtcagcattgtaggagcgtaagcacccacactatttactttgcaaaaggaaaaaagtcacagatgtattaaagagagaaaaaaagtcacttattttaaagagagaatatttagctcccgctgggagcagcggttcttaaggagggttgcactccagagtcacctaaggagctctttgaagatgcacatgtttaggcaatttctacatgtcctggttccataggtttgactttaatttatatatttatatgtttaatttagatatttatttaatttttataatttagaaaattatagacataataaggtgagattgcatcacggtaaaaagaaagtgaagattcgtgatcactacataaagccatacttttttcttagagcgtttcctccttgcttcatctatttgattagaataataaaattgattataataaaatatctatctcatgtctcataatagaaggtgttctgtagtttctattgttgtttacaacttaaatactggcttttgtttaagatttttaggtaagattttctttccaaaggtcatttctaaagttatttacattaaaaagttatttacattaaaatcgactttaaaaaaagttaacatttatatatatgttatttttcataagcatttctaatgaccattttttttgtaatgaccatattttttttaaatttagagtttctccacctggtggtgatttttctgatccagttacatctgccactcttggtatcgttcaggtatgtctttccctagtatagtcaacttctgagcctttcctcctctctgcagcccctgctgttctaatgcgatctaatgtaatcgttgtgaagtatttaatttagtctctaaaggataggcaatggtaaagtctggtttagaaacactcttaacacagagcctttaatactgtctgtttttttcttagctgtttacataggatttataataaacttaataatatataagtggaaaatataggtagcaaaaattttattagtattagagtagtattatcctttaagtcatagtaaccctagttatagaaacaaagaggcccaaaaatgtgtaatacccagaagttatttcacttcacagtatgatccaaggctctcttctgtttagtgataattctgagtccaggattctttccatcttgtgactccactgtcacctagcctggtgatcatctgcatctagctgacacaagggagctgggccttgtggagaaggcatacccaccttttttgaaccttggattcaaaagtgacacagtcactccactcattctattagccacatccaggtgaaagcaaggctggaaaatgcagtttctgcctaagcatttgctttccagtgacaagacatgaattttagtggataggtagccagcttggctattaaaagaagcccaaataaaagatgtgtacaaatcagagctatagttaaaaaaaaaaagtgatatgtgtatattattcatgtgggaaaaacagaatatttacttgtgtttctgacagtatcagagaaaaggaaatgtcagaggctaaatgtacaactctcaagctttttaacgtttgctaaaattttgagttttaaattatggggaaagagggaacagagttagaaatgcatggaatatctgtgaatgtttgcccttacaaaaatcactgtcagttgttgttggattggccctgtgaatgataggcaactaaatttaatcaaaacacttagatgtttttgttttgtttgttttgatacggagtttcactcttgttgcccaggctggagtgcaatggcacaaacttagctcactgcaacctccacctcccgggttcaagtgattctcctgcctcagcctcccaagtaggtgggattataggcacccgccaccacacctggctaattttttgtgtttttaatagagacaatatttcactatgttggccaggctggtcttgaactcctgacctcaggtgatccacccgcctcagcctcccaaagtgcagggattacaagcgtgagccaccatgcctggcccagaacagttaaaaaaaaaatttttttttttttgagatggaatctcacccccatcatgcaggctggagtgcagtggcgtgatctcagctcactgcaaccttcatcttccgggttcaagcaattcttcctcctcagcctcccaagtaagctggcattacaggcatgcgccaccaccacgcccggataatttttgtattttagtacagacagggttttgccatgttggccaggctggtctcgaactcctgacctcaggtgatccacctgcctcagcctcccagagtgctaggattacaggcgtgagccaccatgcctggccagttagaggtttttaatcaaagtaaagtgtgtattcgatctacataaaccttttctggttctattgtaccataataattttcaaaagagtaaattaatttttctttttgcttttggatttggcacagtattaagaaaatagaggtaaattttaaattcgatttgtaggtattatgcacttggaaaatgaaaggaaatagattattgtcattttctgcaagttttattctgttttaattttacttagtatatactaaaacgatgtataatttgaccagtgaattgtagaattgcatatttaggggtcaggcatggtggctcatgcctgtaattccagcactttgggaggccagggatcacatgaggtcaggagttcgagacaagcctagccaacatggtgaaaccccatctctactaaaagtacaaaaattagccgggcctgatggcgcatgcttgtaatcccagctactggtgaggctgagtcaggagaattgtttgaacccatgaggtggaggttgtagtgagccgagatcatgccactgcactccagcctgggtgacagagcaagcctctgtctcaaaaacaaaaaaaaaagaattgcatagttgggacaaacatgcttcggtattttttaactttgttttttgagaaaaattactgtttttgtgtgtgtgttttttttaatcaggtgttctggggcttagataagaaactagctcaacgtaagcatttcccctctgtcaattggctcatcagctacagcaagtatatgcgtgccttggatgaatactatgacaaacacttcacagagttcgttcctctgaggacgaaagctaaggaaattctgcaggaagaagaagacctggcagaaattgtacagcttgtgggaaaggtgagttgttaaattccatggaagatagatctgtgggttacactggggtgtttcaaggacagatagagccttggatattacagattcttgcctagcaaaataaatatttattaaatatttttaattgaaattttctattcattatagtacttagcatggtttttgggtatattgtatgtgagaaagaaacatttgatttacttttatcttgaaatggaatatacccatcaccaaccaaattagaggtagtagatttaggatttgttagcatacatttttgtaggaatgctagggctaggtttcagaaggattggcttctagttcctccaataattagctattggccttaaacaggtgagttacattcttgtgcctgtatcttggattcttcaaggaaagatggtgtaattaaatttaggcaaattaaatgccagaatgaaaagacttctcagatagtatgcaatgctagttagtactcagagttctttgtctggttttgttctttttattacatgttacaaagtcatctcctaatttattccaaaaaaggttaatattaggagatagctaacattctaacatgtattactacttactatttatagaataaaaatattctcttatctgcccaataagagaagcaagaaacaggaagaactgcaaaaccagataaagacaatacaagaaaggaaaactataggctaatattgttgatgaatgtaggtatgaatgtagatacttaataaaatattaaatattagtgtatgaggtctagtaggatattaaagaaaataaaatgatacatcataagcaagtttatctcaggaatgtccatattagacacagaaaatctattgtaattcactaatgtaataatacaatggaaaaaggatatctcagttaatgtggaaaaatatttgaagtttattacaatttttagaaacatcttagcaaacaaggaatagaacggaacttccttaatgtgttaaaagtaatatactaagacctagggaaaccactttacttactggagaaatttcagatgcatttcatttaaaaactaggattaagaccagcatgcctaatctcatcactgtgttctgtcaaataccagagatcataaccaatgatgtaagaagagaaaaaagaaaagttgcaaagaaagagataacagtgtcattgtttgtagataatatgctcatatactagaaatataacagaattaacagagaaacaaataataagagttcactggggtgttatgattcaagataaacacagatcaagagaatgtctctacactagcagtaccaactagaaaataaaagtaaaaataagatgttctcaatagcaacaaaaactagagtgtaggaactaaccagaaatatatatttcttctatgaaaaccacttttaaactaataaatgaaacagaagatgatatgaaaatagaaacagtccatgctcttggacggaatgacttattaaaaagacgccacttctcagccaggcgtggtggctcacacttgtaatcccagcactttgggaggcagaggtgggcagatcaacgaggtcaggagttcaagaccagcctggccagcatggtgaaaccctgtcactactaaaaatacaaaaaattagctgggcatggtggcgcacccctgtaatgccagctacttgagaggctgaggcaggagaactgcttgaacctgggaggcggaggttgcagtgagccgaaatcacgccactgcactctagcctgggtgacagagtgagactccatctcaaaaaaaaaaaaaaaagacgcaatttctctttaatctgtaaattcaatgtaacgccaatctaaaattcatttgatttcaccaagattcacaaccttaaataagaatagtaaagtgtgagcttctcccctattggataagggggaatacaaaaccataataataaaaacaatgtggtattggtaaaataacagaccagcggaccagtggagcagaatagagatagacttgtgattgtataaacgattgatattgcaaagatggtaccgaaaatcaagggaggagaggatagattgtttcagtctgtgatagaaaactgtttactatttgaaggaaaaaaacaaaatggattgttctctaattccacatacaaagttagaatccagatagattcataatttacgtgggaaaggtaagactttcagtttgatagaaaacaaatattaagaaaatatctttgtgatctagagttggaaaaggacttctaaaataaaccccttaacattagccttaaaacaaaaaaaagagttttttgattacataaaaagtaagcatttatgtttagcaaaggcctaccctggttaaaggtaacagaccagtgacattgggagaggaagtttgtgacatctaaaactcatggactggctgggcattgtgactcatacctgtaatcccagcactttaggaggctgaggtgagtggatggcttgactccaggagttcaagaccagcctgggcaacatgacgagaccttgtctctacaaaaaatataaaaattagctgggtgtgatggtgtgggcctgtagtcccagctacttggaaagctgaggtgtgatgatcacttgagctcaggaggttgagactacagtgaaaagagatctcgccactgcattccatcctgggtgacagagtgagaccctatctctattaaaaaataagtaaatacataaataataagataaaaatgtttagaaaaattttaattttaaaaatacttttaaaaaaattaaaaaaaaaactgatggactaatgtctaaaatgtacaaagatctcctgtaagttaataagaagactcgaacttcaacagaagtgtggccaagggaaagaacagactgataatagaaaaggaatctcaaaagactaatagacctgtggagaattgctcaaacaacactgagaacatcacattatactagttaaaatgtcaaatattgcccagtgttgtggggacagaggagctggtgggtggattgtctggtgctgccattgtgagcagtctgataggacttgtttacataccctggaacctagcaattctgtttctggatatttatccccaaagaaattctcaagcaggtccttaagtggatgtttgtgatggtggggaattggaagaaatctgaatgtcctctactgtgagcaaaagatggaaggtaaaatagggagggtgcacaccacagaggatgaaatacatgagagctggaagcagcagaccatgttgcacagcagcatgggtggatcaaaacaaagtaccaaaccaaagacacaagtaagaagttttacataattaaagacacttgcacaaaataaaatatatattttacatgaatttatacaaataatacacataaaacattgtttaatatttacctgtggttgaagagaggactagagataaaagggatttacaaaaaaaaaaaaaacaaaactggagacctgatccataatgcaagaatgtagttaactcattgggcttgtccattttccactcccaagaaatctttacctgttagtgatcctggcaacactaatactatctctcaaagctgctagggcaattgtagaatttagggcttttgaggtagtgatatttaaagggtgaagctctgtaacttagctatactagtaaaatagcactcagacatagagtagtacatacttactgtacttcatagttctaaatattttgtaatgtttttaaaattcaactatttatgagctatatagatttttatgaaacaagactgagaattcaaataattaagatagcaagccaagatgtgaagaggtatttcaagaaaagaacatcaagcttatttttaattaattaatttatttatttgagggagtctcacactgtcgccaggctggagtgcagtggcgcgatcttggctcactgcaacctctgcctcccaagttcaagtgattctcctgcctcagccccccgagtagctgggactacaggcgccctaccacacctagctaatttttgtatttttagtagagacggggtttccccatgttgtccaaaatggtctcaatctcttgacctcatgatctgcccaccttggcctcccaaagtgctgggattataggtgcgagccacagtgcctggccaagaacgtcaagctttttgccaccgatgtttgtttgggatttttttttgtgagataaggtctcgctctgtcacccaggctggagtgcagtggcacgatcttagctcactgcaacctccatctgcctcccaggctcaagcaatcttcccaccccagcctcccaagtagctgggtctagaggcgcatgccaccacgcctgggtaatttttgtattttttgtagagacaggttttcaccatgttgcccaagctggtctctcactcctgagctcaagcagtcctcctgccttggcctcccaaagtgctgggattacaggtgtaagccactgtacccagacccatattcttagcagcactgttcacaatagccaggaagtggaagcaacccatatgtccatctatggatgaatccataaacaaaatgtggtatatatatatatacaatgagatattattcagccttaaaaaagagatcccatcacatgcctcaatacagataaactttgagggcattatgctaagtgaaataagctggtcacaaaaggacaaacactgtatgatttcatttttatgtggtatttaaaatagtcaaatttatagaaacagaaagtaaaatagtggttaccaggggctgggggaggagagaaaggacagttactgtttaatggatgtttcagacttgcaagatggaaaagctctagagatttgtttcacagtaatgtgagtatacctaacactgttacactgtataattaaaagtggcaaagatggtaaattttatgttacatgccttttaaccacagtttaaaaagaacatcaatcaaaaagccgttataagtaaatttattaacaataggtgatggtggaaactatataatagtttctgcttgttaattaattgccaccatcaatcttacattttagagtaaatgtctaaaaatatctttttctcttctaggcttctttggcagaaacagataaaatcactctggaggtagcaaaacttatcaaagatgatttcctacaacaaaatggatatactccttatgacaggtaagctatattgatttcctttttttatttgaggattttctgttgtgttttggtgaaggagtacacattaaaaacccttttttattctcatacaggctcatacactctgacttagtagattggtttatttgtatatttgtagtagacatgatctaatatgtcccctatcttgatttgctcatttgtccaattatgacagtattttcactcatatattcatctataattagatttaattgtggcttagtgcagagcctggggattattccctccttcagaagccttcttcatttctttccactgcccatgtctcctttactctcttacgttgttgttttgagacagggtctcactctgtcacccgagctagagtgcagtggcgcaatctcagctcattgcagcctcaacctcctgacagttctcccacctcagcctcctgagtagctagaactgcaggtgcccaccaccatgcccagctaatttttttttttttttggcagagactgagttttgccatgttgcccaggctggtctccaactcctgggctcaagcagtccacccacctcggcctcccaaagtgttgggactcaggcatgagccaacacgcctgtcttcttttacttttttcctaaataattattactcttttcctaaataattaatagttctgctttcatgcctcatttcccaagagtcctattgcttgctttctaccaaggtctctgttagagcactccaactcctactcagtgctttctttttttcattattatcaatgctactactgaggcttgtttaaagttctcatttcttttaaattttgagaatttagccctttcatgccaggttatcttttctccctcaaatcatatttggccccatataagactgaagaaggaactgagccaatggaaggattaccagaatgtagggcaagcagtaaatatgcctgtatatcagtaagccccagaaatctgctctactgggaacttaacgaagcttctaggaaccacctacacaaagataacaagggaaaaattctttggaaaaggtgtaataggagtatccgtgaaattatgtatgcaaaggtgtttaaacatatccaaaagttgtacgaatgtatgtgactgaagttgaatatttgttcacgtgtctgttatttaaaagtatgggcaaatgaaaacaaacacattaagaaaaaaggggctactactaacttcaggaacttgcagtttcctgctttcctattactcattaaacctaatccactatcacaagggagtctttacaactcagttattttaccatttgggttacttatttaactgcattgtacaaaaacaaaccctcagagagtcattagattatagtaatactgtttcattgtttctcccacttgatgatgttaacagagaaaagtaaaatttacccttaaaataaatacaagaatatatatcttcttctatcccatatcctgagacatctctgtccaaaaactctggttaagtagttgttggtcttttcactattatttttttattccttaggtatcatctaataaataagcaatctgcatacttagataaagaaactaatgctctagtagttttatataaagtatgaacctgttttggagtttatttttgttaattttttggaccttcatttattctaggttctgcccattctacaagacagtagggatgctgtccaacatgattgcattttatgatatggctcgtagagctgttgaaaccactgcccagagtgacaataaaatcacatggtccattattcgtgagcacatgggagacatcctctataaactttcctccatgaaattcaaggtatattttgtttctgctgtaactttttttatttggaaatgcttctttttttcttttttttttagacagagtctcactctgttgcgaggctggagtgcagtggcatgatcttgtctcactgcaacctctgcctcctgggttcaaacgattctcctgcatcagcctcctgaatagctgggacgacaggtgcgtgccagcacgcccagctaatttttggatttttttagtagagatggggtttcaccatgttggccaggatggtctcgatctcttcacctcgtgatctgcccgccttggcctcacaaagtgcaatgcttctttttaatttttctagctattttgagtcccaaacctgggctgtaaaacttgcagttattttcacacatgttcaggttttgtaaaatcagtagagacctcaaagttatgttcaaataggaattctaatgataaaaattagtatatcagccaggcatagtggttctcatgcctgtaatcccagcactttcaaaggctcaggcaggaggatgacttgagcccaggagttcaagaccagcctgggcaacatgtcgaaatcccgtctctacaaaaaatacaaaagattagccaggtgtggggcacacacctgtagtctcagctatctgggaggctgaggtcaaggctgctgcagtgtgccatgatcccaccactactctccagcctgggcaacacagtgagacccagtctcaaaaaacaaaaaaaattagtatgtcacgtctaaaataaatgctgatgtgtattcccttttgtcttagttgccaggcaaattagagcttacttcatagctgagcaacagttgccttactccaagtgcctattaacctctagcacatgtgttcttctgaaatgacatcttctctgtttacttcttttaaatatcatgtactgcaggtcattttttaactttttttttttttgagacagtcttgctctgtcatccagggtggagtacagtggcacaatctcggctcactgcaacctccacctcctgggttcaagcgattctcctgcctcagcctcccaagtagctgggattacaggtgcctgccaccacgcccagctaattttttgtatttttagtagagacggggtttcaccatgttgtccaggctggtcttgaactcctgacctcatgtgatctacccgcctcggcctcccgaagtgctgggattacaggcgtgagccaccgcatccagccattttttaacttttaagtggcctcttgttcttttggaagtacacaagataaaaatagataattaaatgaaattattagtaggaactcaaatgtataagattgtttttaaaatatttgatcagttgaattgtatttatttctgtcatgacatccaggcatatttactaaccacctactgagaatgattctctgagtgtatatgtaatataaaaatttttaaattatatatatattttgtgtgtgtgttcacactatagattgaaagtaaacctgtacaaataggtaagcactacattgagagtttaaaaacatttacacctttttagtcttgtcatttcaccttgagataaataaacaaaggaagtaatcagaattttgatacggatatacacggtcgtttattaaattctttttctttttttttctttttttttttttgagatggagtcttgctctgttgtccaggctggagtacagtggcacgatcctggcccactgcaacctccccctcccaggttcaagcagttcttcctgcctcagcctcccaagtagctgggattacaggtgcattcaccacacccagctaatttttgtatttttagtagagacgggggtttctctatgttggccaggctggtcttgaactcctgacctcaggtgatctgcctgcctcagcctcccaaagcgctgggattacagacatgagccactacgctaaaccaaatttcttaaatgtcacccaagaatgaacagagccaacagtacattatggtgtgtccataagatagatattatgaaggcattaccatttttgtcaaaaatattcaaagacatggagaaatgcttatggcacagagtgaaaaaacttccatatgtaacttgatccaaatattgtcttaaaaaactatatattcatagaaagaggatgaagaagaaatatacctgtagtaatgatgatttctatttacatgcttattgtgtcaaattaacatcacaggtattttttaatgtcattactcttctgtagcattgttttgtggctggagagtaatatttttctattcttagacacttagaaaatttccagttgttggccgggcgcattggctcacgtctgtaatcccagcactttggcaggccgaggcgggtggatcacctgaggtcagttctagaccagcctgaccaacatggagaaaccccgtctctactaaaaatacagaattagctgggcgtgatggtgcatgcctgtaatcccagctactcaggaggctgaggcaggagaatcacttaagcccgggaggtggaggttgcggtgagctgagatcacaccattgcactccagcctggacaacaagagcaaaactctgtctgaaaaaaaaaaaaaacaaagaaaagaaaagaaaatttccagttattggtgtggacaaccatgtagttgtgtgtagttggttttgtgcattttcttagtatggagtcccagaagtggaatgattgggttagagacctggaacattttaaagtctgtctctttttttttttttttttttttctgagacagagtgtcactctgtcactaggctggagtgcagtgacgcgatctcagctcactgcaacctccgcctcctgggttcaagcgagtctcctgcctcagcctcccaagtagctgggactacaggtgcacgccaccatgcccagctaatttttttgtatttttagtagagacagggtttcaccatgttggccaggatggtctcaatctcccgaccttgtgactcgcctgcctcggccccccaaagtgctgggattacaggcgtgagccaccaagcctagctaaattatcttttatacatattactcagtaagttgcctaaattttacttttccatcccagtgtgataataccagatgttgagcaaattctgttttgattaaattaattcctaattatcatgcattaagtcatgttcatctaatatatgaagcggcataatttcccactattgtgcacattgttgaggataaaggctttggtcactgaatgtggttatcaggcaaaatgcaaaattaaaattttgttttctttctgtttggttggatttgtatccttaagaaaaagggaaaatgagtatagttttacctcctgcctgtggtttaccagtgtccctcactaaacctagtactcaaaatatataaaatacgagtaacctgggccaggtgcagtggctcacgcctgtaatcccagcactttgggaggccgaggcaagtggatcacttgagatcaggagttcaagaccagcctggccaacatggtgaaacctgtctctactaaaaatatgaaaaaaaaaattagctgggcgtgatggtgggcgcctgtaatcccaactacttgggaggctgaggcaggagaatcacttgaagccaggaggtggaggttgcagtgagccaagatcgtgccactgcactccagcctgggtgacagagcaagactctgcctccaaaaaaaaaaaagtaacttaacatacgtaatgaaaattattttccaaatgcgagttgaatttgtaatgtcttctttcaggatccactgaaagatggtgaggcaaagatcaaaagcgactatgcacaacttcttgaagacatgcagaatgcattccgtagccttgaagattagaagccttgaagattacaactgtgatttccttttcctcagcaagctcctatgtgtatattttcctgaatttctcatctcaaaccctttgcttctttattgtgcagctttgagactagtgcctatgtgtgttatttgtttccctgtttttttggtaggtcttatataaaacaaacattcctttgttctagtgttgtgaagggcctccctcttcctttatctgaagtggtgaatatagtaaatatacattctggttacactactgtaaacttgtatgtagggtgatgaccctctttgtcctaggtgtaccctttcctcatctctattaaattgtaaacaggactactgcatgtactctctttgcagtgaatttggaatggaaggccaggtttctataacttttgaacaggtactttgtgaaatgactcaatttctattgtggtaagctcattggcagcttagcattttgcaaaggaattgctttgcaggaaatatttaattttcaaaaacataatgattaatgttccaattatgcatcacttcccccagtataaatcaggaatgtttgtgagaaaccattgggaactatactctttttatttttattttttattttttttattattttttttttggggacggagtgtccctcttgttgcccaggctggagtgcaatggcgtgatcttggctcactgcagccttcgcctcccgggttcaagtgattctcctgcctcagcctcccgagtagctgggattacaggcatgctccaccatgcccagctaattttgtatttttagtagaaacggggtttcaccatattggtcaggctggtctcgaactccagacctcaggtgatccgcccacctcggcctcccaaactgctgggattacaggcgtgagccaccgcgcctggccagggactatactctttttaaaatagacatttgtggggctcacacaatatatgaaatagtaccctctaaaaaagagaaaaaaaaaatcaggcggtcaaacttagagcaacattgtcttattaaagcatagtttatttcactagaaaaaatttaatatcaaggactattacatacttcattactaggaagttctttttaaaatgacacttaaaacaatcactgaaaacttgatccacatcacaccctgtttattttccttaaacatcttggaagcctaagcttctgagaatcatgtggcaagtgtgatgggcagtaaaataccagagaagatgtttagtagcaattaaaggctgtttgcacctttaaggaccagctgggctgtagtgattcctggggccagagtggcattatgtttttacaaaataatgacatatgtcacatgtttgcatgtttgtttgcttgttgaatttttgaacagccagttgaccaatcatagaaagtattactttctttcatatggtttttggttcactggcttaagaggtttctcagaatatctatggccacagcagcataccagtttccatcctaataggaatgaaattaattttgtatctactgataacagaatctgggtcacatgaaaaaaaatcattttatccgtcttttaagtatatgtttaaaataataatttatgtgtctgcatattgcagaacagctctgagagcaacagtttcccattaactctttctgaccaatagtgctggcaccgttgcttcctctttgggaagaggaaagggtgtgtgaacatggctaacaatcttcaaatacccaaattgtgatagcataaataaagtatttattttatgcctcagtatattattatttaattttttaggtaatgcctatctcttggtctattaaggaaagaagcaatcagtagagaattcaggatagttttgtttaaattcttgcagattacatgtttttacagtggcctgctattgaggaaaggtattcttctatacaacttgttttaacctttgagaacattgacagaaattatgcaatggtttgttgagatacggacttgatggtgctgtttaatcagtttgcttccaaagtggcctactcaagaggccctaagactggtagaaattaaaaggatttcaaaaactttctattcctttcttaaacctaccagcaaactaggattgtgatagcaatgaatggtatgatgaagaaagtttgaccaaatttgtttttttgttgttgttgttgttttgaatttgaaatcattcttattccctttaagaatgtttatgtatgagtgtgaagatgctagcgaacctatgctcagatattcatcgtaagtctcccttcacctgttacagagtttcagatcggtcactgatagtatgtatttctttagtaagaatgtgttaaaattacaatgatcttttaaaaagatgatgcagttctgtatttattgtgctgtgtctggtcctaagtggagccaattaaacaagtttcatatgtatttttccagtgttgaatctcacacactgtactttgaaaatttccttccatcctgaataacgaatagaagaggccatatatattgcctccttatccttgagatttcactacctttatgttaaaagttgtgtataattgttaaaatctgtgaaagaataaaaagtggatttaaatt

SEQ ID NO: 36036 - DNA, 16308 bp, Homo sapiens
ctcggccactcggggcatcgcggcggcctttctagccgctgtcccaagggttggtctcgcgctttcggctgcgagctctctgtggtgctggcagcgacatgtggcgcctcccgggactcctgggccgaggtaagggacgtccaagcaaccagcgtcactctgggccgcaaagaccgaactggagtgggggcgggcccgaggaaacagccgaagcgatcgtgggccgggttagagccaaggaaggcggggcttgaaagagggcggggaagtcaggggctgctggaatttgagatgtggatgggcctagctagaagagggtggagtccaagaagttggtaggactgttgggagggggaggagtccaatggcaggagatggtggactgaatgaatgaaagaggattaggggccaatggagtaggcatagccagtgaagagaggagaggtttagagtcaaagagccccaaacattagtgagagtatatgtatgaacgtttggtcatcttagaacagtggttggcatccacaggagaccagcagaatcacatgggcgcttttaaaaaacgtggatgctctaccctgagaaatcttagtttattggttctggggtactaccctagaatctgtagtagataaaagattcccatgtgtatccatgtttaagaacctctgctgaggcagatgacagtgattcctgggttcttgttgaggtgcctgagttttggttgttctgtacagctcttccccgtacactgggacctagcctctggagggtgactcctaagtccaccagcccagatgggcctcagactacctcctccactttgctggttcctgtgcctaacctcgacaggtaagatactgccattttaccactcatttcctcccctagtcaccctttttttttatttttttttttttgttgttttttgagatggagtctcattctgtcgcccaggctggagtgcagtggggcaatctcagctcactgcaacctccgcctcccaggttcaagcagttctctgcctcagcctcccgagtagctgggattacaggcacccgtcaccacaccctgctaatttttattttattttattttttttgagacagagtctcgctctgtcgcccaggctggagtgcagtggcgcgatcttggctcactgaaacctccgcctcctgggttcaagcgattctgctgcctcagcctcccaagtagctgggatttcaggcatgcaccatcacgcctggctaattttttttgtatttttagtagagacggggtttcaccatgttagccaggatggtcttgatctcctgatctcatgatctgcccgcctcagcctcccaaagtgctgggattacagtgtgagccactgtacccagccaatttttatatttttagtagagatggggtttcaccatcttgaccaggctggtcttgaactcctgacctcgtgatccacccacctcagcctcccaaattgttgggattacaggtgtgagccaccgcacccagtccctggtctccctttgcccctacttgatagcctcttatttcatcatctaggtcaggtccccatggcccaggcacgagcgggggtccaaggtcccatggatggaaggatgccttccaatggatgtcttcccgtgtctccccgaacaccctatgggatgccatatcttgggtaaggcttccccagcctggtccttgaccttcagtgtagatgagaatgatccttcatgggtatacagccgaacctggaacaagggctagggaatcactgtgtccatttaacaagtaacccatggtattggagcatattcaaggagatattgccactttccacacccccgccatgtatgttttcctcatttaattcagtaaacatttatgtaacaccttgtctgggccaggcatttttgctagtcactacggacatagcagagaacaagatagatacattcttgccttcatggatcttacaataaataataatacattgcatcttttttttattattcattttttttatttttaaattattatttttttctgagacagagtctttctctgtcgcccaggctgaagtgcagcggcatgatcttggctcactgcaacctccgtctcccgggttcaagcaattctcctgcttcagcctcccaagtagctgggattacaggcacgtgccaccacgcctggataatttttgtgtttttagtagagacggggtttcaccattttggccaggatggtctcgaactcctgatctcgtgacccacccaccgcggcctcccaaagtgctgggattacagctgtgagccaccgcgcccggccttatagcattatttattaatgtaaagtattatacatgcattatcttgtgtaatccttacaaaaatcttacaagggaaatatcaccttcattttacagctgaggaatctcaggctctgaaatattaggtaacatgcgtagggtctcatacctgttaagtggaggagccagatttaactctggagttcatgttctactgcttggttgctgcatcaaatacagagcctagcccgtaatagttgctcaaaaatatttgttgaacctgatctataaggtcagattcttactagtgaacactaggtctcatagggcagagtcttcgcttttcaggcaatgttccaggtggaagttctgcttataagatcttctgaatgaagttgacacacacatcactctcatgtttgtcacagctcatccctgctgctttcgtgctgtgtactttggacaaatgacttgacctgtgtgacccttggctttctcatctgtaaattggtgtcatcagcagagctgagcctgggatgtctccatgacagggttacccctctatggggagctgtggactaaggccatatcataccctgaagagaggagcattttcccatgttgccaaagaagatctgagccctagggctgtcccatagtgagaagtaggaagtgggcctggattccagaagtcccaatgccatccctgtgctctgtcactactgctcatatgaaagggtctgcacgcaagctgtcctcagtaccatggatacttgtctctgttcttcacaatgctggtgccttttcttctggccttagcccacacgtcacccccacagacaggctttccctgactccttgtcttgtcaggaccccttttatgctctgtgtaactctctgattagtttccttcttggcatttaacatcactagtaattactctatttctctctgtagttgtgttttgtctttctaaacacaagatataaacttcatgagggcagaaattatgtctgtcttacttgctattgtatgcagtgcctggagcaacaagtaagtatctgggtcaacctgtgtgttttttttaggctggagcgcagtggtgcgatcctggctcactgcaacctctgcctcccaggttcaagcaattttcatgcctcaacctccgagtagttgggattacaggtgtgccccaccacgcctggctaattcttgtatttttagtggaacagagtttctccatgttggctggtcttcaactcctggcctcaagtgatccacctgcctcagcctcccaagtgctgggattacaggcatgagccactgcacccgaccctgggtcaaccttcttaagcataacataaggagagacaggagacagggaaaaccaaggagtctctgggataagagctagctcaggtcttctgcagacctgtcagagaagaaacacctttacaaagcttacacctggagatgtgtgtgtgctggggtggcttcactgggggaatgggagttggtggaaggaggggttgtgcaagactggaaagagagcctaatggggaactctgacctgttgctatatttgcaactaggtgccaacctaccccattatctttttgcctgcttagtcttcgcttatttagtcacttgatcaagcatttattcaggttgtacttattaggtccctactatatattagcactgtgctgtacttgggcaccagagatacattggtgagtaaaacacacatggtccctgcccatgtcgtgcttatagactaacaggagagacagaccttagataaataaatgtagagatgattgtttaaatgccagtgtggtcagggctccagagaagttagggtgttgtgaaagtttgtagtcggggagctgccccacctggatttcctgaggaagtgatgtttgagaataaggccgggtctgatggagttgattggtgaaggaccgtgtccttaacgtgctgtctttcccagggcactctggccgtgctggccctgcagctggcaaggcagatccacttccaggcatccctgccagcaggacctcagcgggtagaacactgctcctggcacagtcccctggaccgtttcttctcatctcccttgtggcacccatgctcctgtgagttctcagtcctggggacaggagggctgggctgggcgtttctctgggccaggaagcgtctctggacacacctcaggaaaagagccatcagcagctccttgcctttcctatctgaagtcagaggaagaggaatgtggggaagttctatccacccagggcatgggccacacctgcccctcagtgtctttccatttcctcccatcacctccaaccaagggaggcccacagggtccagactactttagattctgggtgtggcttcctggcccacattcaaccagttaaattattctctggtcagtcactcagtcattcataaataaatgaatctttattgagcacctattatgtgccatggtgcagaagcaacatagcctagtggttgaggctctggagtcagattatagaggttcaagtcccaaaattgctgcatactagtcttatgtccctgaacaagtcacttttaacttccttctgcctcggtttctttatctataaattggggtaataataaaacccaccccataggtttcttgggaggactaaatgagttaatacatgtcaaggacttagggcagtgcctgacacatagtaagtgtgtagtaattattagtttaagcattagttcttgtccttattatgatgataatcattagcaatattgctatcaaagaaagtgctaggtactggggctacaacagtgagtaaggtagatgcctccctgccactgaagaatttaggcagaggagtgattgatgcttagggtgggagatcagcacaaatacaggcccctctagactcctctggagggaagccaaggaaacagaggaggaggagtgtgaaggaagtgtcacaggagtttcaaaattcttcctatggcctctaaaacctcagggaggactcagtcaagcccgagcagcctgcactgatcctcttctgacctgatcactctttttttttcttttgagacacagtcttgctctgtcacccaggctggagtgcagtggtgtgatcttggctcactgcaacctccgcctcctgggttcaagcaattttcctgcctcagcctcctgagtagctgggattacaggcatgtgccactgcaccccgctaattttttgtatttttagtacagatggggtttcaccatgttggccaggctggtcttgaactcctgacctcaggtgatccacccgcctcggcctcccaaggtgctgtgattataggtgtgagccatcgcgcctggcccagacctgactactcttgctggctctttccagcactgcgacaacacatcctccccagccccgatggcccagctcccaggcacactggcctcagggaacccaggcttggccaggaagaagcctcagctcagccccggaacttctcacacaactctttgagaggagctcgtcctcaggacccctctgaggaaggtatgtccctgcctcatggaatcagcagaaggcagggggcggtggtggtgagctgggcaagatggacgttgtttgctgcgaagggaattggcactcctgtgaggtcccatgccttgtgaggtgattcagggttatttcggttcctggcaagggtgctggctggaaagcctgggtagactgggagagtcggagaaaagaagtacaactttctcctttgccctggccgggtgtcggcctttcccttgcaggtcccggtgattttggcttcctgcatgccagtagtagcatcgagtccgaggcaaaaccagcccagcctcagcccactggtgaaaaggtattatccagatttggccacctggatccccataacattctcttgggcaggtggcaatcctggtaaaccatcccttggtgagtcttttatatttctttcccaggaacaagataaatcaaaaactctttcccttgaggaggctgtgacttccattcagcagctcttccagctcagtgtttccatcgctttcaacttcctgggtaaccaaatggaccctgccccaaggcaggagggtgggaaaatggaaagggtatggggtagctcagatatagtcaagatagggagtggcttaaacgagagattttattttctcccaggtaggtagaccaaatctggcatggcagggacccattcttatgcagatgtgtcctgccatttttaaaactggctcccatcttgaggcgcagtttggcaattccagctcctgccctcctgtccgtattctagccagctggtcggggcaaggtagggaagctaaaggatcactccttccctttaatctagacgttgcacaaatccttgtccagaatataggcacatggccacacctcgccacagaggagactagttactgtgtatgaaggaaaaaataatcttggagggcacgtagcattctctgccacacttaggaaagaacaggctcctggggtttggagcagatcctcgatgtgtgaacaggaacctcttaaccctcatgtggggactccaaatacccttccaccatttgccctgttctttgcagtaacttggctcattttaggccttctaatgcggagactcagactccccacagcatctattggggtctagtgggcagataggcaagaggctgggattcattcacaacaaatttgttgagcatttaccttttgccagttcctgttttaggtactggggatacagtgatttacaagacaaagtccttattctcagggagcagaaaaacaataattgagaaacaaaaagagaatttcagatgttgatagatgttatgaagaaaataaaggaatgtgttagtgacttgagcaaggagcagtttttgatttagaagtcctcactgagcagaagacctttgatctaagacctgtcacaaagacagccacttttgtttcaatctggagaaagagctttccaagtggcgggaacagtaagcgcgaaaatcctgaggcaggattggattttgattgctagaggaacaaaagaaaggtgagtgtggctggagcttagagatcttgggaagggcggaaggagataaagccagaaaagcaggcaggggtcagatcaggtgaggtcttctgagccacagtaaagagtgtggattttctaagtgagacaggaagtctttggagggctttaagcaggagcaggaaagggggcagccacatgatctgatgtacttttccaaagatctctctggctgccatgtagacagacatggattgtaggattgccggggggaaaaaggagacgaggcaggcgctgttggtgacggctgaacaaaacatgtcagtggcatggtctagatgagagaaagaagagagcaagaagagtagatggatctggttatattaatgagccaggtgggaaagaggaggatggtgggatcctttgcactcttgagtcttctacccaagggcagagggctctgtcaaccctggacagtgagttttcaggcagcaaggaggcaactttatttaattcactgctggctgaatggaacctggtttctccctcatgagctttatgtgattttgatgggcaaagagtctcttctcagaatttacttgcccatcccttcattcatatattcatttattcagcaagcgcttggcatggtggcagaacgcgaaaggagcataagccataatcatgttttgcatttgtatggcgccttcaccctaggcaaaattatttcttctacattctttttctgcttctgcctccaggattttacagtctaattgaggagacaggacttgtacttttgaaacggtttagtttgtagaaaaaggcttggtatattaagtaagtgccaaaaaagtgtttaagcctgagtgtggtccgaaggtttagagcagacacaggatgggagctttgatggtggaggcggaaagaaagatcccaggcaggagagacaattgaagcaaaggccttgagttgagaattggccgtgccctcatcctttcctgtttcctttttgtttgggcaatgaaaagagcatggactttggggttggatgtgcctgcattcaggtcttgacactgctgtattaccgctcccaatttcttcatgaaacaagattaacagtatcacttgtatcagttagggtttgttggttatgagcaacctaaacccactctggctaacttaaacataaaaggaatctattgggatctattgacctgccaagcctcagaaaggacaggaatcagggaagcttcagagacctaagaggcagcagctgatagtatcttcagagtgctgctgtcagaataaacctacaagggctgttttctctccttgtcccaaccagatcaaggttcagattcctgagaaagaacctccgtggttaggaagaacacaagcacattgattgacagcactaggggaggtgttgttcccaatgggaaatctagatgctactaccaagagaaggaggaatggtttatagtagggcagaacccactgctgtccatggcaaaccagtgaaatatttagaagatagaaatatatgcaaaggccaggcacagtggctcacgcctgtaatcccgacactttgggaggccgaggcaggtggatcacctgagatcaagagtttgagacaagcctggccaacatggtgaaaccccatctctactaaaaatacaaaagttagccaggcatggggtcaggcatctgtaaacccagctacttgggaggctgaggcaggagaatcgtttgaactcaggaggtggaggttgtagtgagctgagattgcgccactgcattccagcctgggcaacagagcaagactccatctcaaaaaaaaaaaaaaaaaatatatatatatatatatatatatgtaaagtgtctggcacaaaaaaagaaagggaggaggatcagatgaggagtctgtaggtacctggctgagggtgtggggaagttcactgaggaagctgtgtttgtgccctgtgccttcttacaggaacagagaacatgaagagtggcgaccacacggcagccttttcttacttccagaaagctgcagcccgcggctacagcaaagcgcagtacaatgcgggcttgtgtcatgagcatggcagaggcacccccagggacattagcaaggtattcccctgcccccaagcctgccttctgtgctgggctgctgagattgatgtctagaaatgagcagtgggcagggatgggggaaagtttggcttcttttctccacttggttctagcccagctgcgaaggaaaaataagaaagaagctcctaacttccaggaatttagactcaaaattcagggagggcagggattttgcctttcttctttgcaactacatcctcagcctagaatagcatcttgatgaatggattaattaatttttaaaaagtgggataagaacacaaagaggttatatataagaatgtatttcgtagagttgtatgtgaaggcaaaaaaacccaaaaaaacctgaaagtttcttcaatggaaaactggttaattacatctatttgggccttaaaatgatgtgctagatctgtatgtcagggaaagacattcatggtgtactattaaagttaaaaaaataggttataaagtagtatagagtgatctaagtctctctctctctctgcccccccccacacatatgtgcgtgcaaatgcgtagatgtctaaaaggtatgtgtgtgagtatgtctaacacatatatgtgagaagatatttgcaaggctgtacgctaaaattttaagcaagaatgatctttaggaggctgaatttcttgggattttatgtttctatttttggtttatatttttaaattttagcttatctgaattttctgactagtctataattattatgtattagttaattaaaataatttttaaaaatttcactgagtgcaaaagatgcttacagagttgccagccgactgggtgtttctccctttgccccaggcggtcctttattatcagttggctgccagccagggccacagcctggctcagtaccgctatgccaggtgcctactacgagacccagcctcttcgtggaaccctgagcggcagagggcagtgtccttgctgaagcaggctgcagactcaggcttgagagaggtgagtgccattggcagggtctgttcaaggtctctgaggcctgtggagcctgaaagtgaccaagatgccttcttttccttcctccttgaccacaggcccaagctttcctcggggtgcttttcaccaaggagccctacctggatgagcagagagctgtgaaatatctttggcttgcagccaacaatggggtatgcgatctcagtggacaagcatgttggggatgaagcctgataagagaagggattttggaactggtactgagttcttctgtgcttaggagattgttggataggagccttggcctggcttcaagccttagcgctcactgacttactgtgtgaccgttgggcagttgcagtagtacgccagagctggcttgcaccaggctgtgagagctgttggcagcttaaaatctgctatggtgggaatatttgcaccacagaaattgctaaatgccataaaacagggctttttccctcctcgagagccagttgttcaacatttaccagcacactactgggcctggtcacttcttgattcaaacctgtttcctcgtctttaaaatcagaataataatgcttgccttacctgtccagtacttcacagggtggttgtgaggatcaaaatctaactgagataactaacaggtgtgacagtgctgtgaaacctgtacacatgaaaaacacatcattacaagtgatggtaacccagggaaattagaagacgcatcaagtggagacagtaaacagggaacactgctcagtttggggtgggtggggatgtctggttgtctgtgaactggggtcattggcattcagacaattcagatgtgttccatgaagcattagttctctgggatgcttgtaagtcataagaggaaaaaaatggttagatgggtttgggaaatactgagttaaacagttaatataggaagtctcaaagctttatgtcactgtagatcactgaaaaggccatctgtaatttgctgtattcctcaagtgtatttgaccagtatatcttttgagttgcatcttgaaggaccaggagtcttggattaaatcaagcaatatatgcgtgaactgtaatctccctacataggggactgctgcttcctttgttttctggccaatacactgatagcttcgttgaactcctgggcatcagaatgcttttccttgtctactctgtgttgcccagagtatctgtagtagctgtcaaaaggggaccaatgtcaccaacaggtatccactgctgtacctgccttgccttgaaagagccccacagagccttccaaagttgggcaggtctgcacatccatgtgcagggcaagactgggcatgctggcctgctttaatcagaccagcgtgctagcaggagaaatgtacaaaaggatatctgtcacctgctatatgacgctgtattgggactcagacccaacacacttccaccccacagggaattgtgtctttctgggtttgtactgagcagtgttgcaggggtggtgttttggccttacgtgtgtccactgctgtgttgtaacgtggtctgtaggcatgagtctgtcatgtttgttggagagacttttggcctgtgtgttatagaagcagggggagaatgtgtagacaactcttcccagaagtttgactgtggagggtagaagagaaattggaccatggttgagagtcaatagtgttttgttttgtttttttaattgggagagtgaatatgattcatgtagtgaatgtaagcacttttcatatagtgtatttaatccttgcaacaacctaataaggtaggtgctattagcatcccactttataggtaagaaaactgaggcaccatgaggtagagtcacgtgcctgagttaacacagctggtaagtggtagagccgtgatgggagtgcagacagtctggctatgcagctggacacccagcctctacctgatcctgttcctcccaggagcatagttctcagagagaggagagacaatcgaggatccagagctggggcaaagagcatagcgttttttgttttgttttgttttgtttttttgagacggagtctcacactgtcgccctggctggagtgcagtggcgcgatctcagcgcactgcaacctccgcctcccgggttcacatgattctcctgcctcagccttctgagtagttagggttacaggtgcacaccaccacacctgcctaattttttttgtatttttagagacggggtttcactatgttgggcagactggtctccaactcatgacctcgtgatctgcccaccttgccctcccaaagtgctgggattacaggtgtgagccaccgcgcccaggccaagcatagctttttaaaggagaagagtttccttttctgtcagccctcccaggcagagattcaggaaggcacagggcctttgggaagacaaccctccaccttcgcctccttgctgtttcagggcaacataggagcccgactcccaggtttgctataactggcctgagtgtttcctgtagccttcgttgtgcatgctttcagccagcctatgcaagagaagcctccacactgccctggctggaatctccctgggtggagggatccccctctcctttgtgttgggtgagctctgagcctctggcatttcgtagttgagatcccttgctatggggcgggccaggactgggccttgaccgtgtgtggatgaagtcccagcatgcctgacttcatcttcctcctcccttagcatgtcagttcctcattcctgcatgtgtgtatctgtttgtctgtccattttctccttaggactcacagagcaggtaccaccttggaatttgctatgagaaaggccttggtgtgcagaggaatctgggagaggccttgagatgttaccagcagtcagccgctctgggaaatgaggccgcccaggagaggctgcgagccctcttttccatgggggctgcaggtacagacccaagtccaagccaacaggttcattccctgagctcagtactctgtgacagataagtaggtagcagtagtctctggtctcctagtcatttccaaccccagtggtggctaagaatgcagcttttgggatgggcacggtggctcacgcctgtaatcccagcactttgggaggccgagactggcagatcaccaggtcaggagatcgagaccctcctggctaacacggtgaaaccccgtctctattaaaaatataaaaaaaaattagttgggcgtggtgcggaccctgtggtcccagctactcgggaggctgaggcaggagaatggcgtgaacccgggaggcagagcttgcagtgagccgagatcgcgccattgcactccagcctgggtgacagagcaagattctgtttcaaaaaaaaaaaaaaaaaaaagaatgcagcttttggagtcaagacaaacctgagttttttttgtttttttttgagatgatgtttcactctcgttgcccaggctggagtgcaatagcgcgatctcggctcactgcaacctctgcctcccgggttcaagcgattctcctgcctcagcctctcaagtagctgggattacaggcacccaccacgatccctggctaattttttgtatttttagtagagtctgggtttcaccatgttggccaggctggttttgaactcctgacctcaggcgatccacccgcctcggcctcccaaagtgctgggattacaagtgtgagccaccgcgcccagtcaaacctgagttttaacccccactatcactgaacttggactccatggcttagtgcctcagtttcttcacctctgaaaatgaaggtaatggtagcacctaactcattaagttgtcataaggatgaaatgagatgacactaagggacttagcacagcctgacagcacagtaggtattgaacaaatggtagctgctctgatgattttgtaggagagacaatatcccaaggttgcctgaattacccttctagggctctaagagccctgctcactcatgagtcactggggttgggagttaacaatgcctggggaaccaagcccttgaagaagtgctggctccaaagtaggagtccaagaatatacagcaagagtaagagttgctctcacctcttcttgtagccccggggcccagcgacctgacagttacaggactgaagtctttctccagcccctccctctgcagcttgaacaccctgctagcaggaacctcacgcctaccacatgcctcgagcacaggcaaccttggcctcctctgcagaagtgggcatctcggagccagcctggaagcctccagcagggctattcccccacacccctacccactggaaaggagtgttgtaagactaggttttggctaaggtgagataaaacatagtccctggtgcctcttaggggccagagcgggcaggaggttggataacaaaaatagagcatcagcaaccctttccaggtagaaattccagcgggagttcaggttcccaagcaatttcacgtacatggctggtaagtgactgatctttccccccgcttggtagcctcacagatgagtcttggatgcattcacagtcatttctggtctgtgcaccaaaggatgcattcagtgacctatgaaaaaccctactgaagggtccagagaccctggtgctcaccttagcctttgtctttgagcaaataacttaccttcttccttcttatgcctgggttttctcacacttaaatctgtactactgtttgccaatgtctgatgtgtgtatccctggttcacaagaagattttagatggtattcaaattaatattttctatttagttatatatttaatgtataatataaaaatatgattagcatattgacctgtagtttgatagatgttctgtctaggataaagctaactgtaaaaaaaaatagtgaatcagtttaaagaaaaacataacgtaaaagtgggcacagatccagagaggtagcaaaaatcacaggggtggttccatgaatggctgacacttaggaaactctgaattaggccatcctcgagactagcccaccattcacctctgttcatcccccgtgggctcataatcgttttcatttcacctttgatttggaaggaagaagtttcttgcccaaatgcctggatgtgtctgcttgactttcagaacttctcacctcagccctaaagagggagcctgtgggttctcagagagatatcacaatttgagtcccaaagaagaggccagatacccacccaccttcccccaaatcttaagcacctgcgccagtacagtcaagaagaggaaagtgtgtgaagacccaggtctggctctgccacttgcctggccatgtcaccttgaagctgtgacctgactccctatattgtttcctcagttgtagaccaaaggcaatggtgtctgccctcctaccttagaagacaaatgcaagggcatttcaccacagagaggacctttgtgctcactttggcccaggaggcagtgatgctcatggttgcatgactttatgagtcgctgggccagggtgaggacctgggcctcctgactcctggcccagagttcttgtccatcagttcatactgcaattttatgtgaaagcattatgactgtcctacccatgggagagtaaatgtagattgaatgctaggagtcttaaagctggagagtatagattttgaggtccccatttgggaaacatgtgccagaaatgtctaggtgtttaataaaacagatattggattatctc

SEQ ID NO: 36037 - DNA, 226843 bp, Homo sapiens
agcggcgctgtgtgcgcctgcgcggggcgccgagacagggcgtgttcgctgttcagtgccggtgttgcagggagtgagggcagctggagtgcgttctgccgaagcttgtggttgcacgcccatcgtcttaggggctaccttccgtggtgagtgtgtgcggtgttgcacttggggttgcttctcgctgcgtggccgcagcggggctgaacccttcccactccatcccctccccgcacccggaccagcccctgggacgccctcggacgcccacccgctccaaccctggggaagcctcagagtggcagcgaaggcctcttgcctttccgcctctgcgcttgctgtcatcgcccacgtgctttgttgttgttcggtgcagaccatgtccaagtctctgaagaagttggtggaggagagccgggagaagaaccagcccgaggtggacatgagtgaccggggcatctccaacatgctggatgtcaacggcctctgtgagttctcgggcaggactctcccgtggatgagctggaaggctttctaagtttgccaattcactgctggtcctgctgtgagcgattgtactggtttagaccccagcccctgcttgtaaacctcacttgtcaggggcttcgcgcagagggtttgcagtaggatttgttctgttccacctggaaaacgatcctgagagtccacgatgagaatcacacagacagctgtgcctcatcggttgtctctgctgtatggcattgaggtggattttccacagtttgcttaatagtcactttaattataaattgaaaattaattttgagtccttcttcctgtctcctaatacagtctttgtccatgaacaaatgacacagaaaagttccatggttaataagcattcttgtgcctggagcgttttaagcatttcttgaatctttacattcttctgagtatttattctccgaacttggttcaggcttttgtcacctcctcatgctgtggtgaaatcctcctaacttgccctcttgccttcagtttcactgcccagtttaatcactgggtcactttcagtgtcattttcctgtaacccctgtctatggtgttaccctctcccttaaaaccagggattgcagattcacatgcctccaagtgagggcggtcaggggcggttatgaactaggtgataggtgtcccacttgaaggggccagctgctgcacctgctactcagacacatgtcaccataggaatgttggcccaatgtgccagattattttcttaaaggaaccaagattctatatttttatgtgaaatttgctaatttttagatgttggctactaattctaatatttgaaaaacctgtgataagtgagctaaagcagttcttcaggctgacgtggctttggtttaaaccctctccgcacttctccaggttgtccattatcgacggtaatgctccaggtttcttggcgtgatgtacaaggcctttctgaatctgaacacaaccttacccttccatgcagctggcattccagccattctgaacctgttgcccttcctggaccagagcctactcgttcagatcttggtgcctttacaaattctgttttccctctttctcagtcgtttgcacctgaaatccttttacttctaagagtcagcttagacatcaccacctgtgtaaaaccttatccgtctgcaccaggctaacatatcccttccctcctctgtgaaggtggtcgtgtgtattgctttgtgactcctctcacataggattgtactgatttttttcttttttaatctagaagtctctcttctctgctgggacattgggaagacaaaagctgtgcaatattcatgcttgcatttttttaataatagtgcctggagcacagtagatgctcaaaaatagttgaggaatgaagaaaatgaaagaatgatggattaggcctgtgagtttgggatatcaactccaggatgtgacaagagagaagaagggagatgttcaggagaccctgaaaggcgatggatagccatttaggcatggagagaactgcagagtcaggtttactgtgaattcacggttttcacggttcgaaaacctgcctgggacagaggttggagttgatgctattgatatgtcttggcagaaggaaaagggaggaaacgtagatttgcgtttcgtaggctttatgaaaatacgtgccattaaacttaggttgtgtactagttagcctctcaggcttggtgtgtgttggtctcttgcattccgtaagggtccttgctgtcagcaactgagcagatgcctctggaattggatatctgagtttgccccttgctgcgcctgcccggctctgccatgaccatggtcattattgggggcactgttgatacagaggagaaagagaaggggatagggaagatgatgcatagcgggaaccttggccccatggccttcctccctacagcactcattctcaccaggtagaagagaggctgctttcagcagaggagctttgtacccttcggcttttgaagaggagactttatgtaatatttataaatggggagaatggcttagctatttcggttcagctccgttatctctttgaagccttggcttttattaaggaagaaaagccacttgcttcctgaaatatatttccggtataacattgggtggtgaaaagcgagatcattcttaaattttcctaaagaagtagctaacaacggataatagtactttttgggaagttgggtggaagtgaatttggagatttgcagattccatctcctctggcttctgtagcattgagccaaggctgctctctgcaaactccctgacctcaggacttctcggagcctagggggttccaggatgctcttcgaagcctccaccagggctcacttctcagcagtgcacacacactgacacagtgcttaatatatacaagtattaaaatacttcacatggctacattaattataagtgtaagaatttttttttctttttttttttttttttcctgaaaacagggtctcgctctgtcacccaggctggaatgcagtggtgcagtcacagctccctggggcctcaccctcccaggctcaagcaatcctcccacctcagcctcccgagtagctgggactataggtacacgccaccacgcctggctaatggttttattttttatttctttgtagagatggggtcttgctatgctgcccaggctggcctcaaactcctgggctcaaggagtgcccccatcttggcctcctaaagtgctggcattacacatgtgagctaccacacccaacctccatgtttctttactgataaacttttagctgtaaccaggaagttttatatactagtatccagcttaaacacagcttaaacttgtatgtacagagaatagctgtttcttgcatctcaagttttccctttattattcttactttgtttaatttctcaagaggttagaattaagctttgaagataaaagtaaggttttgtactactaagcatatgagatgcccgtctttcttcctgggagagttgtatcttctaacgcagcccttccttagagacagcaaattacctttaaaagatgttttgaggagtttaggtaccaagaactttctgatggggaaaacttcttaggctggagacaggtatcagacaggttctacagttttctagtagtccagccagattctagaaatgctcacttcctaccatgagaggcagaggagtacagcacataggaggggaacctggatttggatagacgtggattcaaattctgctagttagtactgtgtaaccttagagaagctacttaacctctctgatcctcaagttacttaataattggtagcctaagaaaccacttcataagactggtttaatggtttgcgttaaatgcaataatgcacattaaatgttagttattaactagtgttagatccaataatgtacattaaatgttaactattaatatgaatatccagctatagacccatatgtctcagacatacccagttccaacatagtcagtagcctgaaccaagaactttactttgttaactcgactgggtaaggcatttgtatcaggtgttggaattttttgtgtggcttattagaacctgtagtgtttggtacttttgcctaaggttctaattgatttagatagctatttatttaaaatttgtcctaatttatttattttccatcattttgttttaacatggcatgtaatttgcacacacattctcgttaaagcttccaagaacaccagtgtgggcaatagagtgagaccccatctctacaaaaaattaaaaaatgagctgagggtgatgtgcaagtcccagctttcagggaggctgcggtgggaggattgctggaacccaggagtttgagtttgtagtgagctatgatcgtgttactaggtgacagaacaagaccttgtctcttaaaaaaaaaaaaaagcttcccagcataatcgtaatgctgctgattttattctttttattaaagagatttcactgcagaaactctttcccaagcagcagctgtcttcatctggttgataaagttgattttgaagggccctgtaatcagcttccatttccatagagacagaatcccagctgtagccggaggaactttctttcatttctcttatttaagtgtttcctgattttttaatctcttcaagtgtattgccctctctgggtggtcaagcctttatcattttttttccaagttagactaaaatatttttcagataaatctcgaaaacaacctgctttcaagggagtggtctttctaaaggaccaggcaaaataataaacaaatatgatcatgggttatctggaagagctatctcaaaagtcttgttaaacctggaacacatgctatccatgtcgaccttctttgggggatagattaaagagctggggaggacctgtaattttagatataatctattaaaatcatttttttgttttttaatttttgttttttgtttttgagatggagtcttgctctgttgcccaggctggagtgcagtggcgtgatctctgctcactgcagcctccacctcttgggttcaagcgattctcctgcctcagcctccccagtaactggggttacaggcgtgcgccaccacacctggctaatttttatatttttagtagagacggggtttcaccatattggccaggctggtcttgaactcgtgacctcaagtgatccacccgccttggcctcccaaagttctgggattacaggcgtgagccactgtgcccggccttaaaattatttatgttttcactcctctaggttgtgtgtatgtgcccacctttctgtttttaaacacgccgcttcttggcctggggagcccttttcgtttttctcgctccagctagcccttgcccccttgtcagttagtgcttgttgaaagaaggaaggacttaactattcacatgactccatttcctgtgacctcctcaaggaggcccctcgagaatactcagttctgacccaccatcccatccagcctagctgaagtgtctctctacttggcatagtacttgggaaaaatttattgaagaaggaatgttactgcttttagttaagagattcaggttggctaagggagaaagcatagctctggagaaggagcatgtactctgtctccttcctgcaggcttctccgcagtttccagagggaagcagtttccagctatcaggaacaagatggaactgacaacttctatttttgattgtatgatagggttaaaactggaaatgcttcattgaaacaaagaagaggtgtagcccctttggcatgactgaatcggtaatggcatttgactttttgtcagtcctctgacattctggctctagtggccctggtggcttttttgtaagcatcttttttgtttgctactagctgtgtatccttgggcaagttgcttgacctctctgtgcctcaggtgcctcatctataaaatgggaataataagagcacctcatagggtcattgtgaattaatatctataagggcctagtgtaccacccggtacctgatggtcttaatacttgctattattagaacactcatgcattacttaatggtggggatacgttatgagaaatgcataataagattttgtcattgtgtggtcattcccagaatgtccctacacacacccagatggtgtagcctactacacacctgggctagatggtgtgcttgtgactcaggcttttgctcttaggctacaaaactgtacagcatgtgattgtatggaatcccatagggaattgtaacatgatggtgagtgtgtgtgtctttatacaaaaacatacagtaaaaatatagtacattattgttatctcgtgggaccgctgtcatatttgtggtccattgtttgtttgtgtttttgagacaaggtctcactctgttgcccaggctggactacagtggcatgatcttgcctcactgtagcctcggcttcctgggctcaagtgatcctcccacctcagcctcccaagtagcgtagattacaggcacatgccaccactgccggcaaatttttgtaatttttatagagatggggtttcgccatttctcccaggctggtgttgaactcctggactcaagcgatctgcctgccccagcctcccgggtggttcattgttgagtgaaacattattaagcggtgcatgactattgtaaaaaccattttatctgtgatggtgtaacaagtgcaaaacaatatctttatttcttggaaacgttggtgatggtacttctcagtggtctttgcccacctgtcccatggtcttgtcaaaccagcacacccactgccttattcctcacctgagtcagaattcccaggagaagttgggcggctgggcccagtgtgctagggtcaagaggaacagccgttgccacacactggcgagttcagagctgtgcatagcccggggggcggctgctgggggaacagcagcaggattttcgttgggatgtgcttgtggccaagtttctgttgagaatggcagacatgctttgaaaactggtaatttttccactaataattaaaatactctgtgtcctgcagtaactatttattgaatgtatttttttatgataggcattatgtaaccagagttcgtttgggagtttacattgaattttttaatttctatttttttatttttttattttttgagacacagtctcactctgttgcccaggctggagtgcagtggcgcgatcttggctcactgcaacctccgcctcccaggttgaagcaattctcctgccttggcctctggagtagttgggattacaggtgccagctaccatgctccgctaatttttgtatttttggtagagatggggttttgccatgttggccaggctggtcttgaactcctgacctcaggtgattcacctcccccccccacccccggcctcccaaattgctgggattacaggtgtgagccaatgtgcctggtcttatattgaattttaaaattatctactgagaaattattgtttgttatgttaagatgactataaggtgtctattacatgtgaagtagttatattttcaccataagaactataacactcactgctttgccattataaccaatgctacaattggtatggataataattgaaaaccataccctgtattatttattcataaattcacatgaacctagttgaaagaaaacacaatctagatacaggagatccattgttagagaaaagactagagatgactttttttttaattcagcgtaaagacctcttctttggatagcaagtttgtgcaggtgggttaatttttttattttttaaaccaaaggatgatgtaaaaatgtggccaaggagcatttggtctagatcaagtgtgtgagcagcaggggtcagtgttgagcctctgtgttttgctcctgggctccctgggaggctggacacagctcgtctcatctccacacagagctttgctgcctctacagttcttccaccttcattcgccaggttctgtctttgggtagagagatggagtcttaatggcattttatctgtgtagctcacagtgaaagaaatctcacgtatgttacagtcaaccagagcatctttgaggttggcatgtttcacagctgccttgcatgtggcctctgaatagagaagtgctgatcagagcatgtttccaatcaaaggaaatggaatttgcagtgtccccattgagcagattccatcagcgtgtgatgcttaatgctgtaaaacagtatttcaggtttgaggtgctagcaaagcccaaaaggccaataataggattaatagtacctactttgttaatgtcctacggctgcaaaacaaaacaccgcaggctgggtgattttgacaacagaaatttatttcccacggtcctggaggctggaagttcaagatcatagtgtcagcagggctggctgctcctgaggcctctctcctgggcttgcaggtggccgtcttcttgctgtgctcacatgatcttccctctgcatccctgctgtccctcagtctgttcagtttcctcttctcatgaggacaatagtcagattgggatagggtccaccttaaggacctcattttaacctgatcgcctctttaaaggccccatctccaaatatagtcacatgttgaggtatttgggattggggcttcagcatattagttttgggaagacatagttcattccataacatctagattagaggttctcaaatgatacagacctgagtgcctactctgtggtaagtgcttctcacactcataacatccctctttggttcacctaccgtcagcattttatagatgagaaagtagagagctatggaggttctataaagtccccagtgtcactcaggcagtggtggaaacggagttcactttgtttttttttttttttttttttcttaaatggagtttcactcttgttgcccaggctagagtgcagtggcatgatcacggtcactgcagcctccgcctcccaggttccagcgattctcctgccttaggcttccaagtagctgggattacaggcacctgccacaacgcctggcgaatttttttaattttagtagagatggggatggggttttgccatgttgaccaggctggtcttgaaatcctggcctcaggtgatccacctgccttcgccactcaaagtgttgggattacaggtgtgagccactgcgcccggttggagttcactcttgagtgtgtctgaaaggtttgctgtgtgatactgtgctgtgttgtatcctagccccgaagggctcaccagggccaggcttggatgccaaggagaggtgactcctagggcctgccttaccgtaaggcattcattttcagaattcttttttttttttttttttgagacagagtcttgctgtgtcacccaggctggagtgcagtggcgtgatctcggctcgctgcaagctctgcctcccaggttcacgccattctcctgcctcagcctccccagtggctgggactacaggcacccgccaccaagcccggctaattttttgtatttttcgtagagacgggatttcaccgtgttagccaggatggtctcagtctcctgacatcatgatccgcctgcctcagcctcccaaagtgctaggattacaggtgtgagccaccgtacctcgtctcagaattctttaaaacactgtgttaagcaaataaaatagtgttattgggctagccctgccagcttggaaacttgggtttacaggatggttgcagagctttaactgttgaagaaaacataagaagcaacttaatctccatcaatattagcagaaccctccccactttctttatggtttcctgaaaaactattaatctcaatagaatggaatgatcagatgtgagatctttgtataccgtatgttaattcattttcttttgtcttcaaacttagaacattagcttaaaacactacaaagtatggggctggaaaagattgtgttggggaaatattggttcatgtatcaaatagaataaacctgaagtacattaaatggtagttttagttatagtatccatacctcataaagatccttcttatttcatccgtttctttgcatatccattaattattcctttggactctgtgtaacttataattttaagggtgaggccaaatgaaaggcacacatcagaacaagcaattacttgcaaggaggtttcgcctcttagtttttcaggacacagtgcagaccggagaacggtaatgtggtttgcaatctcagtgtttgaatggtggtctatgtaacttggtgttcttaacagctgtaagtgaggctgggcgcagtggctcatgcctgctgtaatcccagcctgactcatgcctgctgtaatcccagcgcttccggaggccaacgtgggtgggtcacctgagtgaggtcaggagtttgagaccaccctggccaacatggtgaaaccccctctctactaacaatacaagaattagctgggtgtggtggtacatgcctgtaatcccagctacttgggaggctgaggcaggagaatcacttgaacctgggaggtagaggctccagtgggctaagatcacgccattgtactccagcctgggcgacaagagtgagactctttcaaaataaataaataatgaaacagctgtaaatgcttaagtctttagggcgtgtcaaagatgcctatgtaatttattatatgtttgtattctacaacgttgtgcactctttgttaggaggatgaaaataatagataatatgattgaaataccatgccatctatgcatggagtgtattaatataatacacgcacacatttaccacataccaggcattgtgctaagccctctgtatggattaatctttcaaacctcacaatgtattgtcattatatagttaataggtaaggaaacagatttaaggagcatcattaacttgctcaaagtcacccaggcaataagtggtagagcccagatttgaagccacacctgcagacgtcggaagcagtgttctcagcttctcctgttttgccttactggtttctgacagtcatatgcacataccctgtggaggagatgaagataacggctaattcagcgagcatgctgagtgcctgtggccacccggtcatgttctagaagccatggtagctgtcctgtctgggctaatgattctgtaacaatttaggaatgcattcagggacactacctatgtttatcccatttgaaccagggaaacaggaaccttcatcttcccaaaatacttacacatagttttaaaaaaatctattccaaaaaaccttattgaagtattcgtatcgataagtgcataatgacagtacaagttgacagattttcaaagcaagaaacattatcagtaggttgggagctggtgctcctcctagtcactctccctttaagtcctgagactgccagcctcctgagcttatactggtagttccaatggaaatacataacagaatgcaaggcttttacttaactcctccttctagtcctcatcttgacctcccttccactcggaagcgtgcctcttacagatatgggtgatgatagaattggaatatctcacagtctcagatttggtacctgacacgcaattaacaatactaatattactaatgccagtattgctaaaaacagttgtcttatgcatatgctatcttcattctccctctttaaaaaaaaaaaagctttttttttttttttttgagacggagtctcgctctgtcggagtgcagtggcgtgatctccgctcactgcaagctccgcctcccgggttcacgccattctcctgcctcagcctcccgagtaactgggattacaggcgcccgccacaacgcctggctaacttttttttttgtatttttagtagagacagggtttcaccgtgttagccaggatggtctcgatctcctcacgtcgtgatccaccctcctcggcctcccaaaatgttcggattacaggcgtgagccaccgctcccggccaaaaaaaggctattttttgaagagcagttttcgattcacagagagctggagcaggaagtacagatccacgtctctcctccatcccccgttcctagtttcccatattaacatcttgcattggtgtgttacgtttgctatgattgctggaccaatattgatgcgttattattattattattatttgagatggagtctcactctgtcacccaggctggattgcaatggtgtgatctgggctcactgcagcctctgcctcccaggttcaagggatgctcctgcctcagcctcagcctcccgagtagctgggattacaggcaggcgccatcacacccggcaaatttttttttaatttttagtagagatgggttttcaccaagttagccaggctgttgatgcattattattaactaaagcttatagctaacatcagggttcactgtatatagtatagttttatgggttttggcaaattaatgtaatgtattcaccgttacagtatcacatggaacagttacactgctctaaaaatcctctctgctttacctcttcatcccctctccctcattatctacctccaaaacctcagacaaccactgaaatgttacagtttgtctctataattttaccctttccagaatgtcatatagctggaatcgtagggtatatagcctctacagattggctacttttgcttagcaacatgcatttaagattccgccatgtctttttgtggttcgatagctcatttctttttagcagtgaataatactccattgtctggatgtaccacagtttggttatccattcacctattggatgatattttggcagcttccaactttggacaattatgaataaagctggtgtaaacattgttgtgcagatttttgtatagacagaagatttcagcacatctgggcgaatacctaggaatgtgattactggatcatgtgataagattatgtttagctttataagagactattaagctgtcttctcgagtggctgtaccattttgttttctaccaataaagaatgaggtttcctgttgctccacatcctcaccagcatttggtgttgttggtgttttggattttagccattttagtgggtatgcagtggtatctcattgtttccatttgcaattccttaatgacatatgatgccgagcatcttttcatatgcttatttgccatatgtttatcttctttggtgagatgtccattcagatttttcacgtactttttaattgggttggtgttcctgagttttaagtcttttttttatattttggatactagttctttatcagatatgtgtgttaacaaatactttctccttgttggcgctggtctttcattcccttaatgatatttttcacacagcagaaatttttaattataatgaagtcttatcaagtttttccttcgtaagttgtgcctttggtattgtatctaagaagtcattgccaaatctcaggtcaactagatttttctcctttgttatatctagaaatttttatagctttgtgtttttcattaggtctgtgattcatttggagttcatttttgtgaacgatgttaggtctttgtctagattgatttttgtgtgtgtgttgatgtccatctgtttcagcaccgtttgttgaaaagactccttttctcactgaattgcctttgcacttttgccaaagattagctgattatatttgtgtgggtctatttctgggctttctattttattccagtgacctacttgtctattgtttcaccaactccacactgtcttgttactataactgacattaagttttgaagttggtcagtgtcagtgctccaactgtattttcttcaatattgcattggctgttctgcctttccatgtaaattttaggatcagtttgttgatatccataaacttgctggtattttgactggaattgatatgtagatcaacttgggaagaactgacatcataacagtgttgagtcttcctgttcatgaacctgaagtatctcattgtttatttaggtctttgatttcttccatactagctttgaagcttttctcatatagagcttgtacatattttgttagctatatatctaaatatttcatttgtttggtgttaatgtaaatggtgtgtttttaatgtaaaattctatttttttatatagaaaagcaattgcctttgtatattaccttgtatcctgcaaacttgctgtagttattagtttcagttcttctttgttgattctttgggattttctacgtacacatcatattatctgtggagaaagacagttttaattcatcctttccaatctgcatacattttgctgctttttcttaccttactgcgttaacaaggacgtccaatctgattttggctagaagtggtgagaggggacatccttgccttgttcccaactgtagtaggaaagcaactagttccttaacattaagtatcttgttaattgcaggttttttgtagatattttttattaagttgagaaagttcttcctctattcctagtttgctaagagtttttatgggtgttgaatttttccagtgctttttctgcctctatgcatataatcgtatggatttccttctttcacctgtttgaagtgatggattgcttttgtttttgaatttgaaccacctttgcatacctggagtaagttccacttggtcattgtgtgtactcttagtacatttttgaatttatttgctaacgctttgtagaggatttttgtatctatgtccatgagagagattggtctgtagtttctcctttttgtaatgtctttggcttaatgagttagaaattgttctctttgcttctattttgtgaaaggtattgtagagaattggtataatttcttccttaaacgtttggtagaattcatgagtaaacctatctgggcatagtgctttctcttttagaaggttattaatttatgattcaatttctttaatagacgtaggcccactcaaatgatctgtttcttcctgtgtgaattttggtagattatgtctttccagcagttggtccattttatctaagttataacatttttggacattgagttgtttataatgttactttattatccctttaacatccatgaaatcagtagtaatggcccttctttcatttctgtttgtaatttgttcgttctttttttttttttggttagcctccctacaggattaccagttttattgatcttttccaaaaaccagcttttgtactcagagattttctctattatttccccttttaagtatcactgatttctgccctaatttttattaatatttttctgtttacttgtagttcaattcattctcatttttcttgttttctagggtagaagtttagattattgattttattaggttggtgcagaggtaattgccgttttgccattacttttgcaccaacctaatagaactgtcttgttttgtaatacatgcatttaatgctataaatttcctttagcattgattttgctgcagttcacaaattctgataagtagtattttcgttttcatttaattaaaatatttttaaaaattttttgacatttctttgacatgttatttagaaatatgttgttaatgtccagatgttttgggatttttcagctatctttcgtttgatttctagtttaattccaatgtggactgagagcatatattgtataatttctattttcttaagtttaaggggtgttttatggcccagaatgtggtctatgtctatgaatgttctgtgcaagcttcagaagaatgtgcatttttctgttagatggagtagtctatagatgtcaattatatccagctgatagatggtggtgttgtgtttttaactctgtccttactgattttctgcctgctggatctgtcaattactgatagagtggagtcttgacgtctccaagtataatagcggatttgtttctttctctttgcatttctataagtttttgtctaacatattttgacgctgttgttagatacattcacattaaggattgctgtgtctttcttggaaagtttaccatttaatcgtcatgtaatacccttttttatttctgataatcttccttgctttgaagtcagctttgtctgaaattaacatgactactgcagctttttttgtttagcgtttagcgtcatatctctttctccatcccgttacttttaatttagttgtatctatattttatatttaaagtggatttctcatagataacatatagttagatcctgtttttttttttaaaaaaaagatccacactgatagtcttataattgatatgtttggttattaacatctaatgtgataattgatattacttagattaatacctacaaaataagtgttttctattcttgcccttgttctttttttttttgtcttctgctctttttctgctttccgtggctttaattgagcatttaatatgatttcattttctcttctcacaacatattccgttttctcttttctcagcaaatgtacatttaaaaatttattttttagaaggaggataaagcaaggaataaaaacttcttaatgatagccctagagtttgcaatatacatttacaattaatcttaactcacttttaaataacactgtgccacttcagagccagtgcaggtaacttaaaatcagacatttccagttccttcttgttgttctttatagaatcggtatcattcatttcagttatctgtaaactataatcaaccaacatgcctgttacgccttttgtaattatcccattgttcttagatattttgtcttacttttctcctactcttctttctctttgcttttcagtttaggaagtttctgttgacatgtcttcaagatcactgattctttccttgactgtatccattctactaatgagccagtcagaggcgctctttatttttgttacagtgtttgtgaactctagcatttcctttcaattctctcagggattttgtctctgctgacattacccatcttttcttgcatgttgtctactttttccattagagctcttagcatatcaatcatattaattttaaagtcgcagtcagataactgtaaaatatctgccatatccgagtgtgcttcttttgcttgatttctctcctcagcctttcttctttttagagtaccttgtaattttgttgtaagccagacatgatgcattgggtaaaaggaactgaggtaaataggcttttagtgcgagttctcacatttttgtagctttgggtgtcagagggtaaaattttctcttgtgtcttccttgtgttttcctccccttttctcttagattttccctgttgaatccttaaatactgtgtgagccttgaacttctgccgtaattccgtattattttataggaccccttctgatgagaaggcatcgggaaaagggaaacgttctgtaatcctgtgcttagatctctctagtgagcctgtgccacttggctgtgaccttcacagctgtttctcaacttccccgcatcccctccccgcccccggctaccaaattgagacaggaaggtgtgagcgggctggagttgggtatttccatcagttcctgttggtcaggctctggtaaatcccaggtagcctaggctctgctaaatcatttctctgtttgttaaggagagcagaatgctttgggcttctttcacagtggttgctcttctccccttccatgaagcacagagggatttttttttctaattttttcacccttagaacctggtagggctcttagaggtaaaactcagcaaagtacaggagaccccttaagaccgggcccccaggaacttgttgttgtttttgttgttgttgttgttgtttttaatctctcaaattagtttaccactcagtctctggcaattcggcagttacccttgaggcattcctaccggttgctggctccagcaggtatttctgctcctactatgctgtgattctctgtgtttgcctgtctctagatttcggtatggtggtttgccctgtgacctgagttttctaatgaatctatggaagagttgtttgttttctgtttgctcagctttcttcttactgtgagtatggtagtgacaacgtccagaatctctatttgctaaccagaaacccgatacatctctaatctggtattaattttggaaatacggctccctgctttttagaatttgaactgtatctagattttcagcacatatagccatttcctatgatacagtctctcctttagccctcacgtagtcttagttctacaggcacccctatcttttatgcgcattaggagtccttaggacaatgtatctctagttattttgattgtctgaagcttatactctggaatattcctcagaaaggcatcaagagaataatcccagagttttttctgtggatagtacataaaaatttgtgttctttttacatgaaagtcaattttacaggtatagagactcgacagtttcttttctggagtgttgtcgatgtgttactctatttcttctggcataaagcattgtttgaaagtctggtgatacaattttatttcctgtaattttactggagtatgacttggtgtagggcgtaggtcattctggtctgattatttcccaggtatgtagtatgctctttaaagtttgaaaattgtattagtctgttttcatactgctacaaagaacggctcaagatgggtaatttatgaaggaaagaggtttaattgactcaccattcagcatagttggggagacctcaggaaacttacaatcatggcggaagggaaagcaaggtgcctttttcacaaggcagtaggatggagaagtgctgagcgaagggggaagagccccttataaaaccatcagatctcatgagaactcactatcgggggaacagtatgggggaaaccacccccatgattcagttatctccacccggtctctcccttgacatacgaagattatgaggattacagttcaagatgagatttgggtgggaacacagcctaaccatatcagaacttttaaataccttttatttcaagaaagtatttttattgtgatttttagtctatgagctctttccttatgttctttatggttttctggggtctgtatgttgatttttttgcccatctttaatatttgtcacttttgcccagatccctgttcttgcttcatttctttgttttaaaagaaatccctcatgcctataatcccagcactttgggaggccgaggcaggcatatcaggtgaggtcaggagttcgagaccagcctggccaacatggtaaaaccccgtcgctactaaaaatacaagaattagccgggcgtggtggtgggcacctataatcccagctactctggaggctgaggcaggagaatcccttgaacccgagaggcggaggttacagtgagccgagattgccccgctccactccagtctgggcaacagagagagattccatctcaaaaaaaaaaaaaaaaaaaaaaagaagaaatccccactttaacttctgtttcttgtaaagtattacgtattgtgtttatttgctcttatatgtctttgaatttagctttcatttctgaaataattttttttgtttctaatttttttcttaagttttgtccctttattgctgaatttttggaaatcagatttatgtttctgttttgtgtcatgtatcattgttgtaatggctttttaccttgttttgaaatagtcaattatagttttgccctgtgttctgggcatctttttggttagtgagttttcatggtcaatgatgttcttctacactttctttttccttttattccataataacgttatgggatttgctcccaatattttttatgttgctcatttttaaatgaaattaattttcctaaactttcagaggaaggcttagttctagatagcttttctaactttacagagctctgtcctctggttgattttatgtagttttcagaaatacagtggcttgctttcagatgacttggttcagtccttctgcccacttttatctggatcttctctatccttggtctctttttctctctctttttaaaagcgttttatttttacttactgctccttgtggagtagggctaccctataggcagtgtgcctctatcattggtctctattatttctgtcttatccagctttgattctaggccctgtcctgcaagggagccctaggtggtcagtttccaggtcacagggcctagacttgtcctaatccatcagaccctactgcaggccctgctgttggaatgggcaaacccttcctaatttcagctgctattctcacagaggtcttctgggctttctggtgaatttgtttagctattcgggggttctcagttgtcaagtttgttagttgccccttgggttctctctgctttcgtcacatgcatgctgatatcatgccaatctttgggttactggtagcttgtcctcatctacttgtattttggagttttttgtggggacactttataacctagttttgttgtaaattgtgtccttgaattttttcttgctgcctagtttctctattttgatgtagggtttcaggattcctaaaatctgccatgctgcctccacgtttcctgcacctacactttttcctccttggtacagtgggaaaaataagcttctcctcaaatgaaggataatgtgtatgtagtatctgatgcagaccaggtactcaaaaaatgatcattgtgatgaacagtttgacaatttcatacttgttgagcagtggcatagtctgttttgaagctgccattgtgggagctctgataagagggggatttaggggtgaagagtctaatgggcctttggggtgaggaaagaacaagagggtgagggtttgtgggtgtcattgatggcagatttgtttgcagtgttgagagaaaggtggagggaatggactggagcaggactgggagaagagacatcacacacagtgaagacgtagcgaggccctggagcagatcagaagaaacacacctaagtttgacttaggggctgattgatgatcaatgtcaatctaggtgactggttataggattggagaaggcaacacttggaggccaggataagggatgacatgtggggagagaatcaaaatccaaggttaaaaataatggttgagctgcctacgagaccaaatcatgttttgccttcgggtaagagcaggtggcacaccatggtcttctaatatttagtgactgttgagggacttagaactcttagagctccaagagtcatgtggcttttgtacagacagcaggtttaggattccagctcctcctgcttgaaaagaaggtttacttttcccagggaaatgtggggccaggttcaggtgagaagtatgggggaaggttgaggcggacgcagagagctgctgctcaagcggagaatggagagtgatagagaaacgtctgacatcagcccctgggaagagggtgccggtgcctcacctgggcggcttgtttaggggtccggggggttgaagatacacccaattttctgaaatgcaaagtgtgcacagttaatactgctcatgtcttaactttggcaaaaaaacaacctgtgtacttaaactccttgtcttttgaacatcataaaatgccatgcagttggcaaattgtggatgcaaccggtggcatatttgtttagccagtaagacagtatcagaattaatcagcttcttgtttggaaacagcttttagggggttctctctgcttactagttctgaaatcacagacaagttacataacctcttgtgtctcatttttctcatctaaaattgagagggaagaagagactactattgccttgtagggttatcgtgagaaataggtgaattgataaagttcttagaactgtgccagtcatgttttaagcatttggtaagcattagctattgttgtttgttattaccttatttttttttaatttttttttttttttttttttgagatggagtctcactctgtcgcccaggcttgggtgcagtggcgcgatctcggctcactgcaaccactgcttcctgggttcaagcaattctcctgcctcagcctccccagtagctgggattacaggcacccaccatcacacttggctaatttttgtatttttagtagagatggggcttcaccatgttggccaggctggtctcgaactcctgacctcaggtgatctgcctgccccggcctcccgaagtgctggaaatacaggcatgagccaccacgccgggactgttctaacatttttgattctagtgaacacatatgtaaagtgctcagcacaacacagtgatgtagtggtcattacataaataatcttttttctctcttttatttgtttcattttaaagatgaggaatttgtgctccagaacaatccagtgatttttctcaggatctcatgggatgacagggcaggtctcacctgctaggaactgtgcgttctttgctttgcttttgtgtcttattttattctagataggaaggaattttccattcaggtttatattatttttattatggttggaattgctgtcataaaggacattccatccaggtgtcaataataattttccagtttgcaaagaagaagctcaagatttagaatctggaaaccttgattgtactctgttctgattctgctggcccgtggaatcttagaatacctttacttctctggcccactgttttcttatctgtaaattgaggagcttaagttgtttgatttctagagttcctttggctccaacattctataaccatgatttctaaaactgcataagttttgtgttacacaaataaaatagtttatgctagaaaaattagtcaatacaaacaagctaaaaagaaaaaagaagagacagaggaggaaggtagttagaaataaaacaaaatggactctggtccttgaaggttttattaaccctaaaaaaattttcaggcacttcccttttaatgggagtttcaaagcaccttagtacttttatggtacaagtctgcctgtcagagttctccagagaaacagaatccataggcaatatatatatggagatttattatggaaattggcccaggtgattatggaggctaagaagtcacatgatgtgctgtctgcaagctggagaacctggacagttggtaatgtaatttagtgcaaggccaaaggctggagagtcataggaggggtgcgtgtcagtgatgcaagtcccagaatctgaaggcccaggaaccaggaactctgatgtctgagggcaggagaagatggatcttcatgaattctcccttcctctgccttcttattctattgaggcgctcaatgaattggttattgctcacctgcattggcaagggtaggtcttctttactcagtcccctgattcaaatgctaatctcttctggaaacaccctcacagaccctggaaaagaacattttaccagctatctgggtatctcgtagcccagtcaagttgacaaataacattcaccatcactttctgtattgtatcctagtgttttatttcatctccttattgcagaggaagctcattgagggcagcagctgcatctcactcatattctatccctgtcccaccaaagaagtacagtggcttgcagagtagctgtagctcaccaagttttgttaataccatccagtgactgcatatcttaggtggcttactatatttttctctttaattctctcaggcatcttcagaaatagtttttctgtgtattttttcctggagcaaaaactgtgtgtttggacaagaatgatgtgggctccataatttaaataccagtgtcttgggtctgtctgtcttctttctccttaatgtcctgatggactcatagactccaattagtgaccagctcatggggggttctcaagataggtgaatttgctgctattatgtgtagaaacaggggccatctttttttttcagttgtcatttatgttcaattgttttgtcattgattgagagaggacttaattgtgattgatagaccctttatctataaatagtagaattcagtcaagtattcaaaatttcaagtgttttgaaaacttactactgaagagtttcagtaaccctgcacactaattagttgtgaaataaggaaaagctttcatcccaccgtgatattttaaaagttttaccttatgaacaaaattcagaagaaagctttttatgattctggtgtgttggtgaatatgatatttttattatttattgatatcaaatattttattgtctgtcttcattttaatacattgtcagaacctgcatacgtaagtagatcagaatctgtgtcctactaccaagggtgaaataacttcagccatgcgacatgggcaggcgttttaagcagcatcacggagatgcagagctcaagttggtcagcattgctgcccggtgctgacatctggccagcttccacattcctgtggagcctctgatgagggttatttaaagctgtggctgtttctagtccaccagggaaccaaaatggaaaagccatttacaccgtgctgtatgttaagatccagttaattctttgtggtctagaactctgggatgatttgcattaacgtggctgtctctgtgcacaactgccgagggttctgtctacagtgcaacttgtagaatcttgcagaattggaatagtgcagcctgcagtgctaaaacaaggcagactcctttgaatattctagaaggtatggtggttcttccagcatgttacatttgaaaccacaagaggtgtgaaaaagccctggccgggcgcagtggctcatacctgtaatcccagcgctttgggaggctgaggcgggtggatcacgaggtcgggagttcgagaccagcttggccgacgtaatgaaaccccgtctctattaaaaatacaaaaattagccagttgtggtggtgcgtgcctgtagtctcagctactcgggaggccgaggcaggagaatcatttgaactcgggaggtggaggttgtagtgagccgagactgtgccactgcactccagcctgcgacagtgagactctgtttcaaaacaaacaaaaaagtgatgaatcctttgcagatagcaaaggcctttttagtggctttcattcggaatgcacagtctgtgagctgaactggtgattgcagtctagtttttatgaccaacgttacagaacctttcatttagagtccaagatggccaatgctcacccatgagaagatcttagaaacttccaagttccatatcattttgtgtgttttcaggcctcatttcccgtgtctcatcctggctttgttcgccctcatctgtctggatgtaagtgccattctgtgacactagaactttttcccatctctgaagtgctactaaaggaatcatttgcttcctaatttgccagattgaaaactatggagacaagttccagagttccacatctttgtgataagttgggccaccttgggaacgagtctgtaatgtcatcttacagggctgtggattttatcctgcttattttgccttccttatattgtctactttatcctgaagaagaggaaaaagcgggacctatttcaaatactgatacctgcttccatgagttatctagacataatgattctttctctaggagttttagtttttcgatttttcttttttttttttttttgtttttttgagacggagtctcgctctgtcgcccaggctggagtgcagtggtgtgatgtcggtcactgcaacctccgcctcctggtttcaagcaattcttctgcctcagcctcccaagtagctgggactacaggtatgcaccaccatgcccgactaattttttgtacttcggtagagatgggatttcactatgtcctgaaatcctgaactcctgagctcaggcagtctgcccacctcggcctccgaaagtgctgggattacaggcatgagccaccacacctgcccagtttttttattttttatttttattttttttgacaggtggctcacgcctgtaatcacagcactttgggaggccaagtcaggtgaatcacctgaggtcaggagttcgagaccagcctggccaacatggtgaaaccctgtctctactaaacatagaaaaattagctgggtatggtggtgcatgcttgtaaccccagctactcaggaggctgtggcacgagaattgcttgaaactgggaggtggaggttacagtgagccaagatcatgccactgcactccagctagttctttgatttttctgaatttactccattaaaatactgaccactccttccatgttatatcctgtattagtatgttctcacactgctataaagaactacttgaggctgggtagtttctgaagaaaagaggtttaattggctcacagttccacaggctgtacctggaagcatggctgggaggcttcagaaaacttataatcatggtggaaggcgaaggggaagaaatcacgtcttcgtgatgggagcaggagaaagagagaacaaatagggaggtgctaacacactttcaaacaaccagatctggtgagaactcactcaccatcatgagaaaagcaagggggaatccacccccatgatccagtcacttcccaccaggtccctccctcaacacaaacgattacaattcaacatgaaatttaggaggggacacagagccagaccctatcatatgccttccctgtttttcatctctgtgctcagataagcctgggattgactccatcacccgtgagttgtgtaggtcccctgggtgcatggtgtactctctaccctaaagcatttctcagtttgtcatcctacgataagtaacatctctttctgaactgccattgtctttctaaatccacctctcagtgtccatgattcttatacctagcgtgttaggtggttggtccatattctctgttccgtaagttgtgtggtcgtgtagcttatcctccaaaccaggacattttttagagggacagctggtataatccaagaccattccaggctaatcaggatgtgtggtcgatgctgcctctaagagaatctccaaggtagagacggccggcgctctgagtgtgatcagtaaatatccagtcaataagtgcctgcgtgagtccttgattgtctttcttttgaaattattgaaccaactagttccttttgagcattttcctgctgattcccttcctggctcaagaataaaaaaatcataaatcacagggacagtgccagcaacctcaccctgcccccacaccccacaaatgcttccctcccattgattttgcttccctctgttcattttggccagatccaacgttcacctaaataacattcctaaagaggctagagtagaatgataaccaaggcactgtagtatttaactgtgcacgtcaacacgttttcttagttactgagttgaattttgaaatgtattctactctgaaaatgcccgggcaaagcatagttgaatattgctttaggaattttaataacagtttgttctcactgctttgggggagctcattctgaatggtgtctggttagcaggagcattagaagatgttatcaacacagcagaaaatctaccaggtgtgattacggtcagcaaggcaccagtagcgggtcagtggtacagcctgctcccattttcccgacacgttcaacgggggcagcttttgtacttttaaataacccattctatttcggtagaccttttctcccttcttttctaacagctcagtttccatacaagactcacagtgaactcaccattcccgagtggaaaggagtgactggttgtataaatatgtctgtctccacttggtctttgcctgaccgggctttgtgggggtctgttgattctttcagcttcactgccttccctgcagacccgacctggagtcctttgttgccctaaatatttttctcaaagatcttttattaactttttcttttctgctcttgtttttcttcctcttacctactttaccatgtggtcctgtggcaagagtgagaaagaaaaatacattctagtggtgtgatcggctgaagcaacgactgaatttctcttctccattaaagaaaaagaaaagaaaacacaacttttaaacttttttagtttctctcctgctaagtgtttgttgaaaggacacaatgaaatgactgaaaagaaccagttttccctcattaaatctgtcctcgtgaacctgagcttgtgaactttgcacttttttgagaagagcaacatttttttttccttgctaattagttgcttgtgctattttcggagaaattaagggaagatgggagtaccttcagttttcttttgacttcagtgactctcagatggatggtctgcaggtgtgagacactgctaattgtctgccagttgcagctcacccatctttcttggtaataaaacccctaatttttagctggcacgtggtcacccagaagccagccttgtagctaggcatcactgtgttactgaattttgattaattgcttgtaagtggaaataccttgtacaacttcttggaagtgtcctgaaggaggaagccttctttatcctttcctttttcctgagaggaatgtagatgtgatggctgagctcaggctgtcgtcttggatcttgaggtgtgttttagtcagctctggccgttataacaaaaatactatagactgggttacttaaacaacagaagttttttattcgtggttttgaagcctggaaaatgcaagatcaaggtactgacggatgcattgtgtccggtgagggctgtcttactgatttgtggaaggccaccttcttgtatcctcacccagtggagaaagagatcgtgtctcacatgtctcctcttatgaaggcacttaacctcattcatgagggctccaccctcatgacctaatcacctcccaaaggccccgcctcccaataccatacactggggattcgggcttccgtatatgaattttttggggaaaacgttcaaatgtgtagtccctagcaaggtgggagccatgcataggggatggcttggtaacgggaaaccaggggcctctggactgcctatgagagaaactcctgttttgtgtaactcctgttgagtgtggtttgctcttacatgaagctgagcatagtcttaactgatacatctatgaatctatttaataatcttgtttgttatcagggatttctggggagatttttttcatgtcagactatacatctcagggatagagcaatgctttgtctggtggacagaaaaatctgaactcaaagaaataaaaatgtgtgagatttctgcagcgtataaaatcttaaccatgatgtgggaaaccactatcaggattctgtttaaaagccacaaaaatgcttttcttcttccccttagcctctttctgtgccattctgtaacaattcagtcctaaagccattaactgggtgtattagtttgttttcacactgctaataaagacataccaagactgtgtaatttataaagagagaggtttaatggactcacatttccacatggctggagaggcctcacagtgatggcaggagatgaaggaagagcaaagggacatcttacatgggggcaggtaagagagcgtgtgcaggggaactcccatttatataaccatcacatcctgtgagacttatttactgtcacacgaacagtatggggaaaccactccccatgattcagttatctccatctggccccgcccttgacatgtggggattattaaaattcaaggtgagatttgggcgaggacgcagcctaaccatatcagtgggacaggaaaacagaggcgttcaggggtggcctgcgggggagcattggcgccttggtgaagggagcagccgtgcgggttgggcaagtcggggcccaggcagagtgaggagggcgtcctggtggaggtggcctggcatggagtttagtatcagggcagagtgaggaggaaggggtgatggggagattggttgctctacatagtggaacacgtgttggataattgaaagggctcgcaagattccacagcacctgctcacgtgaagacttaataaaagcacaggaggtggttcagctgtaggaagaaagcacaagccagcatcagtgacccaagagactcactgttgtggctccaaagggcacattttgtctccagattatgaaccatcaacacgtgtccaaggaatcttggtgtcaggagagcctgggcagaaacatcaagcactgtcttctgtgcttggccagtcaccaagccaacccaggccctgtgtccaggtgtaaggcatcgatccgatccgcacctccctgaatgttcaagcaagctggctctggggaccaccaggggcgtttttaactttaagctggcccactcctccttatcttgattaagaatcagtaccaaacttccaggtgtccttgcagatgagcacagagctgtcccggtttcactgtaagataaccattttatgtagctctatataggggcatttattaaataagtaaacggtttaaaggccaacgaagcggagttctcgtcgttagaggagagaattacaaatacgggaagggagaaaactagaatgagccctgagatgtattggaattgggtagattggggtgaacgtagggtgtttaaaaatagaagtagacagtgaaatcagtacaggtgttaggagtgtgttattccctagctctgaccactgagaggggccgagggtacctgactcccccccaccccaaagtaatgagcacatctagtgcctgaattttggcttataaatattatttcccacaaaaaggaaccagagatcatgggataaatggctgattccaggactgtggcagaaaaaatacaagatgaacctgaatatcttgtgtcagaaggcaagaaagtgctgcaagaatgagggcgtgtgtcgaaaggactaataagccagcttggatggactcatactggccaaatcaggggcaatttaaccatcactgtaaataataatgatagattataacccgtcagctaaaatagcaagctgcaaagccatgcaagtataactaaataaaccatgatctcccagcaccaatgctcttgaccttttggagtggacgattctttgtcatgggttcggctgccttgcgtgatgtaggatgtgtgtcagcatccctggcttccacccactacaccagtgctttacactagtgccatccagcagacagagaatgccagtcaccaacgaaattttagattttctagtggccacagttgttacaatccaaaatgtctccagacattgtcagatatcccaattgtggggggtggggaagttgccttgatcggggaccaaaagacacaataagtttagagtttggtgaggaacaggatattgacattgtgtcaaagtacccgtcctccttttcccaaatttactaattacaagaggggaaaacaagacattgacaatggagaggccaggcagacttacgcgatcaaagtgaagatccttatcaatgggataaatggaagtcgtgtgtcctaggtagggtgccatgacaagagcacagtgtttctgcgatatccctgccaaagatgctgatatggtttggatccgtgtccccaccaaacgtcatgtggaattgtaatccccagtgttggaggtggggcctggtgggaggtgactggatcacgggggcaaagttctcataaatgggttagcaccatccctcctgtattagggttctctagagggaaagaactaatattatatatatatatatgtatatatgtgtatatatatatgtatatatgtatatatgtgtatatatatatgtatatatgtatatatgtgtatatatatatatgtatatatgtatatatatatagaaagatagagagagagtgaatgagtttattaagtagtattaactcacactaccacaaggtcctgcaataggccatctgcaagctgaggagcaatgaaagccagtccaagttccaaaggtgaagaacttggagtccaacattcgagggcagcgagcatccagcacaggagaaagatgtaggctgggagactaagccagtttagcctttttctacctgctttatatcctggccatgctggcagctgattagatggtgcccacccaaaattaagggtgggtctgcctttcccagcccactgactcaaatgttaatctcctttggcaacaccctcacaggaacacctaggatcaatacttagcatctttcaatccaatcaagttgacactcagtattaaccatcacaccacctttgtactgtatagtgatagagttctcatgagatctagttgtttaagagtgtgtggtacctcctcccaaagccccacttcctcctgccctggccatgtgatatggtttggctgtgtccccatccaaatctcatcttgaattatagctcccataattcctacatgtcgtgggacggacctggtaggtaactgtatcatgggggtggggctttcccatgctgttcttgttatagtgaataagtctcacgagatcgaatggttttatgaaggggagttcccctgcatacgctctcttacttgctgccatgtaagatgtgcctttgcttcctctttgccttctgccatgattgtgaggcttcccagccatatggaactgtgagtccattaaacctctttcctttataaattatgcagtctcagtttcgggtatgtctttactagcagcgtgagaacaggctaataccccatgtgaagatgcctgctccagctttgccttccaccataagttccctgaggtctccccagaatcagatgcttctgtgcttcctgtacagcctgcagaaccataagccatataaacttcttttcttataaattactcagtctcaggtgtttctttatagcaatgccagaatggactaataccgatgaatgaatcaagaatcaacaaatgacaaatctccagcctgggcaacagaatgagaacccatttctaaaaacaaaacaaaataaaacaaaaaaacatttaaatcaagcaagaatggtgctgtgagcctgtggtctcagttgcttgggagtctgaggtggggggattgcttgagcctgggatgctgaggctgcaatgagctgtaattgcactactgcaccccagcctgggcaacagagcaaggtcatgttaaaaaaaaaaaaaattgtacatagagggacataatacaaaacaattgcccctgcaatcttcacaattgccaaggtcacgaaagtcaaggaaagagaaattctcagcttagaggagacgacaaagacctgacagctacctgcagcgtgaattctcaaccagatcctatttcttccctaaaataaatgattgggacatttggagaaacttgaatgggggctaggattagatggtcctcatgtactgggttaactgttttaatggttgtattgtggttatgtccatttttgcttgtaggagatataccatagactttatggggcatcaggccagcagcttaatctcagtggttcaagctgggaaaacaggtttttgtattgcattttgaacttctctataagtttgcaatggtttgaaaaaacaaaaaacaaaacaaaaaaaaaaacatgcggccggactcggtggcccacgcctgtaatcctagcactttgggaggccaaggtgggaggatcatgaagtcaagagatggataccatcctggctaacatggtgaaaccccatctgtactaaaaatacacaaattagctgggcgtggtggcacgcacctgtagtcctagctactgtggaggctgaggcaggagaatcgcttgaacttgggaggcggaaattgcagtgagctgagattgcgtggctgtattccaaactggtgacagagtgagactcagtctcaaaaaaaaaagcaaaagttgtggtcagtagaagtgatgcatattttcttcaaagcgtgctgagccccaacatcgagacccttcctgagaaaaatttttatcttatccgtttaaggaaaaacctctactgcattaacagaatgttcttaaagaaataatattggaggctggacacagtggctgatgcctgtaatcccagcactttgggaggctaaggtgggagaattacttgagcccaggagtttgagaccaccctgggcaaaataacgagaaccacatctctacaaaaaatacaaaattagccgggcatggtggcatgcacctgtgatctcagctacacgggaggctgaggcaggagaatcatttgaacctgggaggcggaggttacagtgagctgacattgtgccactgtactccaacctgggcaacagattgagaccctgtctcaaaaaaaaaaaaaaataggaaaaatttacacatacacacacacacgtgtatatgcatatgtgtgtaaatgctgacacatacagtaaagttttagaccccagagtagaggggagatcatttctctcttttacttttgtggctctgtatatattttctttatttatagttagaaaaaccattctttaagcaaacctaatcttactgagcagattaaaccaccatgataatgtttgaagccagagagcaatctgcatttcaaatcagtgctttgaaatgtcaaccaaaatatgtttagaagaaattgtgaagggtttcaactctgatcatctgataccatggaggagaatttctggatgggcacggaacatagctgaagcaataacactggcggccttctgctagataaagtttctgtttggatgaagtggcttcaaaaataataataattaaaattttttagcacaaggtaaggcccctgtgcacctctgcccccttggctggtctttctgactggcacagataattgaaatggatcactaatggctgggcaagcaggtcggggcgccacgcagagctaactggccctcgtcatgttggattctgtgacattaatctgattagctctaacttgctgagctaattgcaccgttagttgcatgccttttcttcctttggtttaacattgaatagatcgtgttacatgaatcctagcttctattttggtgagcgatagtgcttcaacctgtgaaaataactttgccgtttgctttgtaggagtacaggtagaatccggatacagtgatacatttactgactgacctttttttttttcttttctttttagttaccttatcccatatcacacaactggtcctcagccataacaagctaacaagtaagtgatgtttctcatttgttacagtttctgacatttaggtaatcctatggcactgctgagtctgttactgtttccttgggagaaactaatgaagaatgattatttgcagaaaccttagtttactttggtgacactaagatgagaatattgtcatcctgtattttgtccttttgtagttagctctactttgaagattcttttcttttttttgagacaaggtcttgccgtgttacccaggttggtcttgaactcctgggctcaagcgatcgtcctgccttggcctcccaaagggctgggattacaggcatgaaccgtggcgcctggcctgaagattctttcttatcatgtttataaaccaaagagaaaaaaaatgacattgttgctctggaagtggttccattcagagatagtaaatgctatgctgacctgaattgccagaccattggtgagcatttcatgagcaaaacttacttgaaagcattgaaaacttgaaattgttagaacaagttctttgttttcatttatatttcctcctcgaaagggaaagttttaactgtttaatacactttctgtccctgcttgatggaggaaaagatgcaaaattgtatacatgatatacctttacatctgcatttttcaaatttttgagtctggcttccccaaaagaaaaattctgctgggtatccatagagccccacagtagacgtatctgcttagcatagatgaatgcctatttttatatgactatcttgtgtgcatgatgggccgttttcttcgtagagctgtggctttaaagattttaatgacagggacccacgctcctttcccattcctaatgactcagttctttttgcttgccatttttcttgcagacttgaatgattttctaatcatgtggcaagaatttgtgaaggagctttccgagtccagtgaaattgagcagaatgtcatgttgagggatttgtgtcatgaatttatgtgtgtatgtgcattatatacagcttgaagcgatgtcacagagctgttgattattgagaattaagagtggcagcagggtcccctcatgtgcaagaaacaagtggattagtcgttgttagccaaagcgtatatttgtaaggcaaaggcagagtgacggcacagttgtcacacttaagtagtggtggccacagaagccaaaagtgagacctacaagtcatgtgtggtcattgttgtaacaggtaatttattgccggttccattgtttttctgggaaatggtcccgtggtccacagagaccagattctcagttcagaagggattcatggtctgttttgaagcgtggaccacgtgattcctaaatcccccaagatttgtgagcagtaataactgacatgttctgttgtgtagtttagtaaagtatttcttaattgctaagcttaccattgttacaacaatgataccttgttttgcttatcttgtgcaaaccagtttacacaagaaagcaaaactggccaggatcagtgaccgatgcctgtaatcccagcacttaggaaggctgaggtaggaggattgcttgagcctaggagtttgagaccagccaaggcagcatactgaggcccccatctctaccaaaaatcaaaaaattaaccggacatagtgggtccagcacctgtggtcccagctactgaagaggctgagcccagtaggtcgaggttgcagtgagccatgatgacgaccctgctctgcagcctggacgacagaggtagaccctgtctccaacaggaagaaagcaaaacctttatttctattatatcattcattgatctcttctttaaaaacatctttcagatcactgtagtttatttctttttacatcttcacaaagatagaaatctcaggagtcaatggatcagtttcttcctccaggcattataatattaggttaatttagaggagcatatttatatgtggagttacattgtgttggccattcaggagactgactgtgaaagaatccaaactttatatttctgccttgccagtttttttttccttttcttcactccatttgagacactcttgacctaatccagtaaactctaattaatagtcttggtaaattctgtttcaagccatcctgagtagcgtcactgacacccgatctgtttcagtaaggtcaaattagcatcctttactatttttctggcatttaaatgaatgactttgctatggtttttcaagtgtttatagtaaatatgtccatttgatggaaatataaatatgcattaagtgtaagtggctaggcacaccctgctgtcactttttatggtaatcagtgtctttcactttctgttgtttttaatagggaccagctgacaacgccacattaaaaccacagggactcaaaagataactcccccaccccctcacccggcactgcttttatcttgcaaaagtattcatgtttttctcttagtatgccaattacaccgttctctgacatttccacttatgtactcatggaaggaatgaatggtttactcaaactgggacattgatttggggacactgttgactccactgacttaagatctacagggttattgaaacagtgtggcacgtggttgacttgccttttcttgccagtggttttggccttgacatgtctacccagggcagtaaaagtgaggcgacaaggaagctgaaagtgggatctgtgattctgaaattcctcaagaatctgggagcagaaattcctgaacttttaaatactgcagttcataaaaatattaatgtattgtcaagctaattgctgttaatgctccaagactattatggtgcccctatttgaatttaaacctgggagcttggggcagcgttgatgggtttttgaagtcagcgggggacttaatctgtctgtagcaactttcctagatatgtatatatgcatgatgtgtttaaggagacgggaagaatagttgcaagtgaatttttttcttctgcctttttgctatgaatgggcaggtactaactttgaatgcaacaaagtcattggcaaagtcagaatgcaaagccatcctggcccaatgggaagagtttcagattgaagatcctttcggaaataatgctttctttgagcacctgcctgtgatgcagtacgcacctggcagaaggctggcttactctcatgcactcactgcccctctctgcctttcagaaactgccctaatctgccccacatcccatgccagcctctcctctccatttgctgctctaggaagatggatcatcttctgtccccccgtagccctgcctctgggcccaggatctactcttgcctgcctctcctcctccctcctcctctctaccagcctctccccatcctcccctgggggccccctggctggtctggcccatctgaagcctttcctccccaaactctcttgcatgtagactctttaactctagcatggcattccctgtccttctcttcctttgtgttttttttctctctccaaatagatggtcagcttttgtggaagcatggatcatttcatattcttcctgaatgcctgtgactgggcccttagtggcttcgcagtaattacctgtataaaccgagtgttcattgctcccaggaggtatgtgaatgacagggaagggcagagaggaaactgctggctggagagaaagtggggaacattgggatcagatggtttctttgggattaactggtatagggacttgagtagatgtggctgccacagacttctgtttcttactcgttgtgtgctcatttcaaacatggtagagcgtgatgctctaaagatacatgaccttcagcctgggcaacatagcaagaccccatctcttaaaaaaaacatgagccaggcatctcagctactgtggaggctgtagtgtgaggatcacttcaacccaggagtttgaggctgcagtgagctgtgattgtactactgcactccagcctgggtgacagggcaagaccctatctcaaaaaaaaaaaaaaaaaaaaggtatatgaccttatgtccaataaatgatggccatctcatctttacaatcatagagccaaggaatgatgggctgtgatgtgttactcaggcacacaaaggactcgcagccagggaaactgttttcatgaccgctcagatgcgtgggaaggcagcaataatgccgaaggtcatcttcctgtgtttctttgcttttccttcctgcccctggcctctgtggttaccctccctttcaagccactgtcagctgagtcttttttagtctgctccttaatccaatccctaggttttatggtgttttggaagtgtgagctttgtaaatgctttcctacttgttttttgtttttaaaaaggagtttcttttggggacaaccattttaagacttgtccactagaggtcactgttgagacacatatgtctcctccaggttttgtacctaaagattagaaaccacctttgttgtgagaataaattttgtgcaggctctccggccctgcaccacagggcatgttgctattgctgcttacacagtgcagtttttaccacatttaaggtaaatccttatagaaggaggtatgctgtgttttttgttctcctaccatgaaaatattcagtttcacgtatcattttttagtgtttattatggctactttctcaaattagaaacatttctcttcctccaatatccttacgttgaaagaattatactgctttccatagtattttgtattgggcatatttgagtttttttttttaatctgtggaagaaagtttgaagtatttatgtaaccagattttaattcaaaaataactgtaaaaatcaggaaaatgtgtattttgtgcatatttatgctgattcgtatactgctcaattccattgtgttggggagaatatgaaatgaatgtacaacaggaaatgaattgcattctgtagcagtgataaaacaagctctgggcattacgtttttaagtgaagttttccttaagttttaaaaaaattttattccaacagcaaaacccacacgtaaacattgcaagctactactgcactccagcctgggtgacagggcaagaccctatctcaaaaaaaaaattaaaaaaaaataaaaatatgaccttatgtccagtaaatgatggccatctcatctttacaatcatagagccaaggaatgatgggcttaaatacggcagtagtttttttttttttttttaaattttgtgacccatgtgtgttgaggattagacattcgtcattttgtgcaagaaataaccaaggatatctttttgctctgtgcaaacattgaggagccgacatttatgtaaaacttttcaaaagtgtgggtctctgaatgtaattgtttagttttatacttttaactgccatgtaaaaccttttcctgaggtattggcagttttgcctacaatttcaggtcttcactgtgaccatatctcatcatttaatgcatcggaaatggccaggcaggtagtaaacctaagttttatggcaaaatgtgggttttttttttttaatatacactatttcctattagttacagcttatgtatgaatttagaattataacaaacaagaaatactaagataccttctttggtggtttcaataatttatttatcaaagataatattctaagtacatagaatttaatacttttaaattttatgcagatgtatacattgattatctaccataagtcatattataaacaaattaagcagcatatttcacatgaaaatactgcattcttaaaatttgtagatccaattataatgaagaaaatttagcagtttttaaaaagcataatacattgaaacctttttatgcagacataatagattgctgggatgattgagaagaattaactgtctgaattcctgaggacgaccttcaccactcttctcagaccttgctgttcttaagtctgtagttattccctccttcatagattatttgtcatgctttatgcaaaagttcttgtgcatggcttgtatgaaattaaaccatgaggggggaatatgtaaaataaatggtctctgtgtcatgaatttatcttgtgacaatatcaaaacaacttgctgttcgcattttaacagagtgtaaatgtgtttataatacagaggctttgatcaataacttatttttttaaattactgcacatttatcagtttgcttctctgccatcattaaaagatgagagttaaaaaaatatgcatagtatctttgagtctaacagctattaattaaacaatatctatctgatggtaccggtagtcaggttaccataaaaaagcactggcagttgggcatgtgttgcgattttttggctgtagtgagtgagcacctgagatcatgctatgggagggtctgttgacccaggaacccagaaccagtgcagccaaggccagcgaatgaagtcgaagacgtgtcctgccggtggcatctaatctgtcctcagcttgtagactgtggccaccccccacccccattccttttgttgtcagccccaccaaccaaaatgtacctgttctagaatcctttttctagaggtcctgttttgtgctaagcggaagccagctaacgtgctaattcctccacaatatatttttaaatggaaccaccccaatcgtgagaacttcagaacggtggcaggctgtggagaaaataagacgggggagtgtaagcctgtcactttccaactcataattagcccatgtgcggggctgatcctgaaaaaggtttctattgctattgatgatagaatgtctatcaaacagaattgatttaatagcaaaatattatacgtacattttcagttgatgccctctctcctatatcacttgatgtgtgtgtacatgtgagtatgtgtgcagaatgatagaggagatacactaagaggtgcaatacttaggtacatacattcttgtagagcatctcttctctttttttatgtttttattttttagagatagtgtttttatcacccaggttggagtacagtggcacaatcctagctcactgtaacctgaaactcctgggctcaagcaagcctcctagatagatgtgcaccaccacgcctggctaatttgcccaggctggactcaaactcctgggctcaagtggtcctcctgccttggcctccaaaagtaccagaaatacaggccactgtgagcccctgtgcccagccttcttaacttttcttaagtcactgatctttttaaataatagagtgaaaactacaaccctgatctgtagagaagtgcacgtgatggttgtaattccagcagaggcttgtggatcccattgtgttcatccatgaattctttagaggtccatgcagctcagatttagaaactccagaatcggatgaagataacactagtatgtttgcatgcagtgtggacatagggatgctatttttttgtttgtttgtttgagacaggatctcactctgtcacccaggttggaatgcggtggcgtgatttcggctcactgcaacctccatctcccgagttcaagcgattcttctgcctcagcctccctagtagctgggactacaggtgtgcactgccatgcccagctagtttttgtttttagtagagacgggtttcaccatgttggccaggctggtcttgaactcctggcctcaagcaatctgcttgcctcggcctagtgatgctatttcttaaaggagatgctccttggagatttgtataaaactttagatgatttttaatgcatcacagaactcattcttgatgactttttaaaaaatattgataagtgccatcttattaatctgcttaaatttacattttgttaaataagaatttgcaatcctgtagctcccagggttgaacagaacgtgtgtgggcatatgggcatatgcagttttttttttttttaacggaatacctttcccatttccatttttctttctgttcatcagtcagcctcatagaccaaaaccactcagatacaattgataaccagtaacaaactcattgaccttgcgttttgctgttttcagtctgaaccctcttttgtctaattttttgctggttctttagcttttttcccctgcctatctattctttgttctagtcacctgatttttttaaaaaaactgatgttcctacccctttctctgaatttggcttatccttcagaaagttgagatgaatgctcatctttctctgtgaagccctccttttcatccaactgaaccagcactgtgtggaaagaaatacaaggcaccccacagcctgtgggaccatcaagaacaacacctatataataacttcagcaggaagtgaaagagaaaagagtgaatttgttgaacccccactctgtattacgtggaggaggcaggtgtaaagtgattaagtgaccagaatgaggaggcgacagagctttctgtacagcttccaagtggctgctccgccgtgtcccctgctgcctctgcaagtgatctgtgtgtgcacttgacgtcccgttaggtcagtgtaggagctccatggacgaagcgttcctgtggctctggatccttactccttccagtcgaagaacgggagaattcctaaggttaaaagccatagttgggttatttcgaagggaatgatcaaagctcccatgtggatttggtggattttcctagccctgggcctcttccttttcctccccttcctgccctcctcatgcagtgaccctaaacataaggtctggtaggaagagaagcagtccacttgtggcctcttgatggatttgatggattaattccttttctttttttttttctttttttttgagacagggtctcaagttgttgcccaggttggagtgcagtgatgcaatctcagctcactgcagccttaacctccaggctcaagtgatcttcccacctcagcctccggagtagctaggactgcaggcatgcaccaccatgcaaagctaatttttttgtagaggtggggtttcgccctgttgcccaggctggtctgaaactcctgggctccagcaatccacccacctcggcctctcaaagtgctgggattacaggtgtgagccactgctcccagcctagattaattcttaattgtgaaagaagacagaaactaatgacaaaacgtgctttttctgtgtgcatgtaaaagagtgcaagatagaatgtgacttgctgactatctaccttgtaatgttaataatcgaggcttatgtgtagatatacatccatatatattatacatagtaaaggcatgtactcatataaaagagcctagatcagtccttttataacactgagactgcttttttccattgatggattgaagtttttttttcttgttttttttttttttttttttcatattctactcctctctctttccagtgttttggaattttctaggcatttttcctacccttccttttcttacccttcgctggatgtcacttcctccccaggccactgaatgccatttcctttcctctcagtgctgcctctccctcccagctccccaattaaagctctttattgatgtatggctttgctggaggggtcgcacatcagaattgtagtgcaatttagaagtggtgttcctgcaagatttcagagttcatacgtcctcctgaagatgctttgggagttaacacaagattcaggcattaactaatttttatatcctcagaggagaagaaatccatacttgtcagctttttaggaaatttgtttggttatgcatacatactttttatagctcaggaacatacatttttgcatgtttggctttatcctctaaaatcgaccttatcacttgcttatgccttttttcctctaattttcacgtaattgatttttcacattgctggtgaaagagtagggccattgttttgcggtgagttaagccaggggatatttttgtttactaaaatgacttaggctatagaatcctgaggcagctcatgatagcatagagtgagcgtgtgcttttggggcacaggtccccagtaatacttgttgtttattaaccaaaagtacattaccattgttatttataaagctaataattggaggatgttggcctttcttggcgtagatgcttagatactttgctattttatgtttaccttgaggaacatgtagaaccttttaaatgagaatttgctttactgtttcataaactttatgtttttaaataacctggaactaccgtaattcactgctttaatagctgctttggggtaaatcccataaaatctgtgaagacagttatcattagtatacttttgaacatcagagtcttgtggtaatatgtaattagttcattattgtccaccttgtgtttttggccagaaaacaaaggtaattaatcactataactacaaatgacctttttttttggcatataaagtgctgaagaatgtaattattcctacgcgagagtgagaagattcttctttatgtataatcattaaaatgacattgagaactatgatttgctgaaagaatcggcatgtatgtaattagtctagacaccacctctgtgctatgaatggactcatgttctccagttattacagctagagattaaaaaggctgtgcttttactttgaccatggatgccccatgtcatatttcatctagtttctgctaatttgattttttcctcccttacttcattcaggccaaagggggacacttgtttttcactatcatattcatcaaatgctggggcaaggaaatgtttgctttcaccattttctcataaatggtccatccctcccctcccgtatatataatgaagagcctcactcattttcacctattctcatgtttttagtaatttttctagtgacttggttgtagtaatgtaacatactaagttatctaaataacaagctaattttaatatcctctgccatcctctgtccttctatgctttataaaaaaagctgcagaaatatatgacattgtgaacatctgcccaggcattttcatttgttatgacaacagacaaaaacttcctttttttttttttttttttttttaaatagcaatatgtcaggtttttagaagcaatactactcagtttcattttgctgtgactcattctatgtagtttctttggggactctttggcccaaggattggtggcacttttgcttcctggaaatgggcacgagacagtagcgttgcctccattgcagcacaagggcggacatgccgcgatgccacctgctgtcctggccctggctgtgagcagttgcctcccacgaagtacctgccttaagtcctcctcttcatccccttgctgtaattcacaatccatcactggaggcagaggttgagctatcagttcacttgtttcaaagaggctgggtcccctggctttcatgccctgggccagccctagctcaggaatcaccagctctgaaaacatcctttggtgcttctgcaaaaacagttgggtgtagtgcagcccccaactccccagaagtttggtggagatggtgggtggaggtcacctccagatttcatgcctgtgctgcggagggaaagcgccatgtgtttggagcagcttctggcttcctggcagccgtgggtgtgtgttagcatggtgcagggtctagtgctgcccttctggagctgaagaggacctggctgtcggtggtaaccatatggctctaaagaccaaagtgtgaccccctgaccctcccgtgggctgcacccaggcagagctcctgtccttatgttttttgcgtggtgcctgctgctcccagagtctgtcgctccttacggctttgatttttttttgcctcaagggccccaagatgcttttgctcaaaaagcccccaaatcagctgcacccaagccgatctgtctgtaccgtcactaccacccagcatcctgccattagggttcagtgttttgaagccaagcagtagagcaggtgacatctctttgtatgactacccttggtcatgatgaatttgccactgagtgacttaattcagtgtgctagggaattcaaggcttttctcctctggaaagttgtccgtcttaagcaacagtgatcttaccataaaatgctgtatggggaagcagaagttgactagaaagggtttgattgtagcatccacgttgaacgtgttaagctacctagagtatcatttgtttcacgtgtcatcagttccccaggctcaagaggcatctttatttggatcagattgattattatactcatcgcattatcgcatggggtaagggacatatgtgttggattgataatcgtgatgctgccaatgaattaaaagttttctgagccaaaagagggttcccagaccagcaacatcggcatcccctgggaagttgttggaaattcagagtctcaggctttaccctaaacctgctaaatcagaaactccgggatacccctccatctgtgttttagcaagccatctggtgattctgacgtctctgtggtttgagacccactgccatcgggtagggctgtgtaataaaacattttgcggtgatggaaacggtcagtatccctgccatgcagtagtggagccactggtcaccacatgtggctgtcaagctcttgaaatggggctgctgtgaccaacaatagcattcatcattttatttaattttgattaatctagatttaaattcaaacagctgcatataactagtggctgtccaacagaaagcccagcccagaacataccctgctaattattattgtataaactcctaaaatgctttgagttgttggttgtggaattattaattttagatcatagaacagaatcttccttactctattcaacagaattgaaactgcgattgttacaacaggtgattttgattcttcctatggaggggagacagtttgtgggctgctgaccagttgggggaagcctattcttgagctgattgattgttgattttgtgaatgtgcatcagtggtgcagtaccggctggcacatgcctgttgcaggtattaccgatggccgtagatacatgtccttttaggagtaaagctgttgctcaggaaggggctgtgtcagtatttcacgcagatggactttggtttctccagcctgtccagcaaagtggaggtgcttctggccaaagagaagttaatgaacccttcaggcactttgggctgcttgtggaaccttccagaaactgctgggggagatgggagtgctgaattgccaagtctgggctggcacgtcagatggacaaaactcttgaatcacattcagttcttcagtttaggaggacctgaaggaaagaaggtcatgccgggtgtgttaggcggaactgctgctgcaaagtccagaagaaactttgagatttgtctctggggtgatgtgaccacatccttgtcacctttccaaaacagcagaggctctgggatgagagcgtccccagcagtcctgtgatcctgtggctagagcgaaatgggacattgaggagccaggggatatctgagtcctctgggactgttcccgcaaacctagcaactgaagtctcaaaattaaagcagccatctttggctaggcagaaaatgatactcaattctctgtcagaagcgaagttctacatgactaagcttcctaattgagagccccatttgttgaattatttaaagccatatcattgattttcataatccatctccttttagaatcctagaatgttaaaatgaggtggaagagaccttggaaatggtcataatccagccttcttattttacagaggcccagagaggttatgagttgagtgagggcacacacagcactgtagggtcagggaccacgttgctctttagttcctttggtgtcataggtcagctggggtcatagatcagaagctggacagattgatgaaaaaggatcgtttcaaagatgtaagaaatatactgatgtgcactgttagcttttaaaatgcttcttgctcatgcatcctgtagatatctagaaaattccagtagaatattttgactggtaaaatattgcagtggcctttttggaatacctaaaattgttcccgccacgtatgtataggatttagtcatagcacaattcatattgctaactggttatttttttcagagagtttggttgggagtagtttattttccaagcactaggcctgtttcagttgattgactttgataccctgtcttttgtaacttactttctttaaataacatgcctctcctattttatctcccaggtattgagatgctgtgtgtgcaaagtatggcactgtgcacctaatcagcattctctaaatattggttcaaagagtgaataccatcccatccagaagggtctgcatgttaatttctttagattttcactatggctgggggttaaaaaaaaattccgtatattgagggagactattagctgtgtattatttttttttcctcgtctagcttgaatggagtcttaaacgaaaaattcacatgctcaccaaaaggctgggagaggttttgtaaattgaatatggggttattgtttgcgttcacaaaacaaagccctaaatcacatttagcataatttgtggttttaaattggactgatttagcaaggagagtgaaataatctctcatcctgtcaaaaaggcgatacctttagaccagcatttaattgcactggcagagtaacttcgggaagacggcagtaattctggctgcattattcttggtttgtggctaaattgagatcatcattttctcctggtttcactaactttccttattgctcttcaaactaatcagatgaatgtgctcttcaaactaatcagatgaaggcttagtggtagctggagggtggacaggggagggatgaggtctgtgggcagctgtaatgtatatactttatgatctggggggagaagatgacatccagtgacccagaaggcacagcctggtgattttcttttctttttttttttttttggacatagagtttcactcttgtcacccgggctggagtgtaatggcttgatctcggctcactgcaacctctgcttcccagaagcgattctcctgcctcagcttcccgagtagctggaactacaggcatgcgccaccatgcccagctaattatttatttatttatttattttttgtagagatggggtttcaccacgtcggccaggctggtctcaaactcctgacctcaggtgattcacctgcctcagcctcccaaagtgctgggatcacaggagtgagctaccacaccaggccaatcttttctcttctcgagatagagttgtactcttgtcacctaggctggagtgtaatggcatgatcttggcttactgcaacctctgcctcccaggttcaagcgattctcctgcctcagcttcccgagtagctgggattacaggcgtctgccaccatgcccagctaatttttgtatttttagtagagtcagagttgcaccgtgttggtcaggctagtcttgaactcctgacctcagatagtccacccacctcggcctcctaaagtgctgggttacaggtgtgagccaccgctcccggccctggtgattttcttggtaatcccttacacacagtgaataccattcatttacacagaagtgttccatggactgtgcacctaagaaagaatgtacatttgcagccacactgtacaggtagggttcatttgcattcctgcaggtatcccagagggagggttctggaggaactttgagctgtctagattacccgatgaaaacttgttcttttatcaacggccacttccggagctcgcgcaggggccgctcactagaccactgctccctgcccgtgtgccccagttcagagtaatctgtattcttcacagtcccttcttccagtgaaagcatctcttttacctttcaccaagccttacctctaaaaggccagtgataccttagacatttcagaaagctcaaaatgatgactcaaaactataataagcaacgtgcctgtccctttacttttgttcccctgggagttatcaattggtcgtcttgaaatggctagctgcttaaatattttagatgtatgtttggcattttacacacacctttgtggtggttctaatcacaggtgctcccgggtctgagtttaggtctgactgcaggaagcaggttggtctcccagcctcctggggcacccctggaggaagcagatgggatgggaagtaaacctgactgataagagacatcacactttctcaggctgagttccacgcccctgttcatgttcttagttatctggatagtcttggtatcagagtttacgtgaaccatggccaagcttatcacccacagaaatgtttgtagaaagactgaatagcaagtgggatagatgaattacagtctatggaaactcctgctgctgccaatttacagtttgtgcttttaagataaagatgcctttggcttttacatttgtattttcaaatgtatatattctagggaaggaggaacctttcaggtccccagtggctgattttcacctttgatctgaatactagtattcatagcatgctactgagttgactttttgtatttctatataataacagtgtatcgatctcttgctaatctgatgtaacctttgtgtgtgtatatgtatgtatgtgtgtgtgtgttactgatcaagttaaattactccagaggccaaaatcagaaactagggagggtgaatatttcatcatttaaaattgagcttatattgttattaatgcaatgttaagaggacagcttttcagatactgggttatttaagcagcttcaatgtacatcatcccggaagggatttggagatctccatctttcttctggtggcaatgcaagaaaaccaaaagaaaaaaaaaattgcacctataagatcatatatgacaaccataagtatatatgcttcataatactcatttttatagactgtttgtggtacagaaattctcttttgtgcatttttgctctgtttctccccccccattagccatctgaaacaaactgtgccaagcacttagctaatcatatacgaagaagcatttcttcttctgacggcaatgcaagaaaaccaaaaggaaaaaaaaagttgcacttagaagatcgtatatgacaaccataagtatatatgcttcttaatattcatttttataggctgtttatggtacagaaattctctgttgtgcatttttgctctgtttcccccctcattgtccatctgaaacaaactatgccaagcacttagctaaccatatatgaagaagcatttaagcagccactcagaagtgagtgactgcttatgaaaaacctgtaaaaaataaataagaccggtaggtgaattcgatggcccttttgaagttatgtctttctttgctttgaaagaaaaacaaaatgtgccgctgccatcccttgctaggagttccattcccagattcacactcagcatttttgtttccatagtggtgccaccgaacatcgcagaactgaagaatttggaggtgctcaacttttttaataaccaaatcgaggagctgcccacacagatcagtagccttcagaaactcaaacacctgaaccttgggtgagtatcagtggagcggaaaggatggagaggaagagagtggaaggggcatgccgggtaaggccaggggagggattccttttatattattgcacagaaatggatttctaatttctttttatgttttgggtcttaaaaaaattttattgttttaatatattctttcagtggcctacattagtgcatatttgagagctaattgagaggctaattgttggcgcaataaggaagttaaatttttattgtattttctgtccagtaaaattttatctcagttctgctgaccgagaagggacttatttgcatagcatgaactggcggacaagtggtaatatggctgatttctttttcctctctgtgttaaattggaatagtttacaaagcaccttcgtgccgtggagggaagaatattttccctaatgatgcttcattcatttatgcaattcttctctttagctgagaggtgacagtcctgtctttctttatgcaaaggtgaagagaggagttttgattcagctgaggttgcagaaccagggagcagtaaataataataatgataatctatttttgtgtattgctttgcagcacttgaccctctcaacatttgtgaggtacggagggcaggttttagtgctttcattgtatacagaggaagccaagccttttcaaaggggctaagggcctggctcctggtcacccctgaggttagcggccaagctgggaagatggttctgggtctgaaggctccttcagaccccattgttatggtctgggtctgtgtccccagcaaatctcatgtggaattgtaatccccagtgttggaggtggggcctggtgggaggtgattggatcctgggggcggagctctcctgaatggtttagcactatcccctcttggtactgtccttgtgatagtgagtgagttactgtgagacctggttgtttaaaagtgcgtagcacctccccccttgtgctgtcttgctcctgccatgtaataagcatactcctgcattgccttccaccatgagtaaaagctccctgagacttccccacaagcagctgctgccacgcttcctatacagccggtagaaccacgagtcggttaaacctcttttcttgtaagttacccagcctcaggcattcctttatagcaatgggagaacagacaaatagatccatagaccccaaccggaactgcggcatcagaatttcatcttcattggcgcagctatcagatgaaactgcccactcatgctgcagtctctgtgcaaagtcatatgttcattaaatttgtagccactaaatgctctagttaagttagtgattgacgtggagtggcaatagatgctggccaggtatttcccaggtttttttgtttttgtttttttttttttgagacagagtcttgctttgtcaccaggcgatctgggctagctgcagcctccgcctcctgggttcaagcgattctcctccctcagcgtcccgagtagctgggactacaggcgtgcgccaccatgcccagctaatatttgtatttttagtagagatggggtttcaccatgttggccaggatggtctcaatctcttgacctcatgtccgtctgcctccgcctcccaaagtgctgggattactgcgtctggccgtatttgccaatataatagggagcagtcatgaaaaaaaatctcattcatggagtgatttttagtttattgctcccacaaggaatttggtcagacacattattttgaagttcacttgggcttagggaccaactttatgagatccatgggcagcctttattcttatgtctgagggaaagtgaagttaaaaggagggaggaacatcgcttgagatgagatggtttttttttttttctccctacaaatttggagcctgtatacccatctggcaaagcagaaatgaaaagatgctccatttatatcttggttttacaggctattctatcctgatctttaatttgtatgtgagaaagaagctaaaactacatatagatgtatattcttactgttaatttgttcatttattaaatgaaatatatgtacacattatatctattttatatatatatatataaaatctcaatcactaggaacagtgcttggcacatactgagcagtacctagtattagttagctattgttatcatcataattgtcttatttacgttttcattgattccatgactatgtaagtgactattctatgtcaggaatcttcctagtaccggggagccaaggtgaaggttatggtccctgaccttacctattggggcaaggctggttataaacaggaacagaccaatgaggtcacagatatgctggcggttgtggaccaacagggggaacagcaagaccggggagcactttagtccacagatgagatcttcaggagcacaaacacagcagggagcacaggagccgagacttgatgcgtgagaatttctcagacttacaagttgaaggaaggcatctcagatggagtgaatggcactcttttgttttgttttgtttttgagacagagtctcactctgtcgtcgaggctggagtatggtggcacaatcttggctcactgcaagctccacctcctgagttcaggagattctcctgcctcagcctcccaagtagctgggactacaggcgcctgccaccacgcccagctaattttttacatttttagtagagatgggattttgcggtgttagccaggatggtctttatctcctgacctcatgatccacccgcctcggcctcccaaagtgctggcattacaggtgtgagccaccgtgcccggctgagaatggcatatttaaacgctcacagcactgcctgcctggggcctgggaattgtcagttttttggcactgttgagtataaagtgtgaggcgggcggctgtcaggtcagaggtcaggctagacagggaatcctggatgtctgttgttcagtgaatgaggatttaccaagttccttaccatgtaccaggcattgttctagctgctggccatccagccctgatggagcttccattacagttggagaaaccaactataaacaaataaatgtttataataatgacaggaagtaaaaagtgctaagaaaagcactctgtgctaaataaagcagctcctctcgggcgtggtggctcatagctatagttccagaagtttgagaggctgaggctggcaggtcatctgaggccaggagttcgagaacagcctggtcaacgtggcgaaaccttgtctctactaaatatacaaaaattaagtgtggtggcacgtgcctgtgatcgcagctactctacctgggaggctgaggcaggagaatcgtttgaacccaggaggcagaggtttcagtgaactgagatcgcaccactgcactccagcctaggtgacagagtgagactccatctcaaaaatacatacaaaaataaataaacgagctccaattttatactgacccttgagaaatttgcatagcagagtagcagataggagatatggtcatatttccgtatgaaagagtatggagaagagggtggagggaggtaaactagaggttaggagaccaataagaagacgagcttcatgtcccaggtgaactaggacagtgacagtggaggtgggggggattttatatgaaaaatatacaggcggtaacgttgacagacagtaactgatgggatggaatgataccttcatttctgtgttgggcagctgaaaaatacaacagatggagacaggtttgggaagaagataataagctcaaattttgttcttttttgactttcctaataacattttggtttgaggcagcagaggacagagtcgtacacttttctttttttttttttttctttttttgagatggagtttctttcttgttgcccaggctccagtgcaatggcatgatctcggctcactgcaacctccacctcctgggttcaaacgattctcctgcctcagcctcccgagtagttgggattacaagtgcacacacccacacccagctacttttgtatttttagtagagatggcgtttcaccatgttggtcaggctggtctggaactcctgacctcaggtgatccacctgcctcggcctcccaaaatgctgggattacaggcatgagccactgcgcccggccctaaacttttccttttcaatgaatgcatgttagttgccttcttgttctctttggagttgtttgcatttttggctgtcggtgctgtactgattgtgtaaagctttttgtatttaattacatagctacatagacggagttgtcaaagtttgaacaaaactcccagttctttgagaaaggagctaagatgggtttcactaaaggatactctgtcctcaaatggcataaagaattgtactcacacagtgaggcaagttatagggaggactccttattctaaggagccagggtgaaaagcatacacacaggagatcacaaagtggagatgggaagccacttgtatgtgtgatccatcagaatttgctttcaaagtttttatagtatttacagtttattctgatgattgtaagacatgagagaattttaggccacctgaataagtaaaagaaagtttagttctgttctcaattccttaaatgcggtttatttcatagagttattttccaaaaagtgtgaagccacataggttgatgtggcttcaacaattatccatgttgatgattatttctagggtaacttcactgcaggaccaccgtgcccaactgttcgggaataacgtttgacctcgtttgttgctagagcttgtctcataaacacatagaagtttttattaagtcccttgttggatatttgtggatttggattatttatttatatattttttgagacaagatctcactctgtcacccaggctggagtgcagtggcatgctctccgctcactgcaacctatgcctcctgggctcaaatgatcctcccacatcagcctcctgagtagctgggaccacaggtacgcaccaccacgccatgctgatttttgtaggttttttttttggtatagacgggtttttgccatgttgctcaggctggtctcgagctcctgagcttaagcaatctgcctgtgctggccttccaaagtgctgggattacagacgtgagctactgggctcggcctggatttttttaaatttttatttttgataagtgtgagtaggtcactgtggaggtgagaaaaattagtgcctttagacaagaaggtttctttgaagctggaggtgctcaggacaacctgcggagaagaaactgctctgaaaaggaggcattagtacagacctttctggggctttagaagacaaggaaaaaagatgctgaaatagcctgaaaccccctggttttatcaacttctccatcatatgcaggcatttgcccacttccaacacgcatttgaaaaatcttcccatgcaaacaaaagaattgataccacttggcatagctgagccctgcgaagctttatgtttcaacacctgaggtcacctgagattaaccaagtgtggcacaaatagaaaaccacacttgatagttgagactatccagagtggcttgtcatgaggtgagcttgctcgcttagggctaaatcaaaattttctctcaaatcttttgaaaaataattctagcaacagctctcattccctgagaagccacgtgtgagccatggattgggtgttgggtgcttcggatattttctctcttatcctctcagtgatcctgccctgaaggtgttgtcagcctcattttatagttgaggaaactgggtctcagagaagctgagtaacttggtgaaggtcacgcagctagcaagtgctggagccggtctcctcacctagctgtctcctaccttaaagctccatacttttcctaccgccactgtagcctctcatggaaaccttgattgctagcagtgtcagagcggggccctgagcatggaattcctatgtgtcaaaatgtggatggatggagatggatgttagcacctgctggagggaggggggacagccagcatgttccatccttcattctgcagagagagaacccaccatgtcaccatccacctggactggtgtccggagaggtggccagaagtctctgcagttccttggccgctttgtagctggggctgttgctagcaattcttctgaagttttagcatttgtttaaggacttctttctgcccgccagggtggtgtgcctaccactgttacttactgctgtcagcggcacatgggactctgctgtgttccttaaatgttgtgggtattggtttgtcactcaaaggaaaaaggaatctgcaattaagtagattcttgccaccaggaggtggaggggctccaggcttgctctgggctgaagattgagtgggagctctctctcaggtgagatgcctcttccctctaagcctgtctaaccgtggatttcctctacctaatattgcaaaagtgtatttatttgcagagaaaaatgttaaggaatcagcagttttcaaaaagagataaccgaaagcagcgtttaaagacagaagcacctagtgtggtcttctctgctgtccttcctttgacttgcaattcttctcagaatccttgtatcagagcccaagggtctggagcagctttggcctccgtgcggtatggggtgtttccagacacatgtcgccttcatcagtcacttctgaagtcttggctcctcaccctctcttaggctgttttttcatctcaacatagcattaatgacaagctccatcttacctgtattgcaaggtagttttagtgaacaagcgaagtccttgccataatgtgcttcacaaattgtgacttcatggagaatgtttgttcttgctgtcgtggcagtagatagtcgtggaggtagttttgctgggtgtagtctgtctgggaagttttctgcctgacagggggaacccgcgtttcccttttggttgccccctctgctgtcagctgtttctggtgaggccctcttggtagggctggatggagctgaatgtgttaggagaaggatcgatggctagaatgatttttattgtcacagtcccttccacctttcagtatctgtcaacttttattaaattttttttttaaaaattggcttttaagtatgctcaaagggaactgcgttaagaaaaataaggggcttgaagaaaggataaaagatagtgtagaaaaaaattcccttagacttcactggagacacgcccacacacacacacgcacacccacacatacccacacgcaccacacccacagcacacacacataccgtgtacaaacacacccacacacacaccacacacacactgcgtacacacacaccaccacacccccaaacacaccctatacacacaccacaccacactcatacctaccccacaccacacacatacccgcccccacacagccccccacgtccttcacacaccacaccccacccctcacacaccacacgaaacacccagatacacatacacataacatcacacacaataccacacacacacagcacacaccccacacacacactcacacacaattgacccttgagcaacacatgggttgcgggagcaacacaatgactcatgcagtcaaaaatccacacattacttttgactccgaaaaatcttaattcctaatagcctacagttggctggaagccttaccaaaactagaaatagttgatgaacacatattttgtatgttacatgtattctattctgcattcttacaataaagtaagctagagaaaagaaaatgttattaagaaagtcgtaaggaaaagaaagtgcatttactgtgctttaagtggaagtggatcatcttaaaggtcttcgtcctcttcatgttgagtgggctgaggaggaagcggagggttggttttgcggtctcaggggtggcagaggtagaagaaaaatatccatgtctcattggacccaggaagttcaaacccatgttgctcaagggtcaattgtatgatttaaaaattttttaggttgtgataaaatgcacacaaaatgtaccgtctttgtagtagacagttcagtggtgttaagcgtattcacattgttgttcagccaatccccagaattttctcatcttgcaaacctgaatcctacgcccattaaaccacacctctccattccccctccctccagcccctggccatcaccattctaattgaagataattttcagtgttagcagttgtagaacaaaaacatgattttccctccaaaaaaggaataaatggaatgaaatcaagcaaaagcctgaaaactacaaagcttcatgtgtatattttgagatattatcactacgttcatagggaagttgttctttacaaggaaagatattttgtaatggtttgagtttttgtgtaaagcagtgattaagtttcaccgttggaggaaaataacagctaagaaattttcaagtgtttcaagatcatgtaagctgtctgactgaaattattagcctaaataggacaacataccacaccttctcacttatatgtggaatgtaaaaaagtaaacctcatcgaaacagggaataaaatggttaccacaggctggagggagaggggaattgcagagatgttagccaaaggacatgaaattttagttaggagaaataagttcaagagatggattgtacatcatggtgactgcagttaataacaatatgtggtataattgaaaattgctaagagagtgaattttaagcagtctcaccacaaaagacaaaaaaaatgacaagcatatgaggcagcgcgtgtgttaaatagtatgatttaaaccattccatgatgtagtatacatacatcagaagtatcatgttgtacaccataagtatgtacaatctttgtcattgtaaatattaaataaatgctttttttaattaaaaaaaaaaaaggatgggcatgggggctcacgcctgtaatcccagcattctgggaggcctaggtgagaggattgcttgagcttaggagtttgagaccagcctgagcaacatggcaaaaccccatctctgcaaaaaatacaaacattagcagggcgtggtggcgtgcatctgtggtcccagttacttgggaggctgaagtggaaggatcgcttgagcctggggaggttgaggctgcagtgagctgagatcatgcctctgcactaaaacctaggcaacagagtaagaccctgtctcaaaaaaataaaaaataaaaataaagtataaagtgactctaggatcatggcactgtcttacactttcagcgtctgaaacagaggtgcccttgatagtctgtatgaatgtgtctttggtgtcatgacatagatttttgtccccctgcaacagcatgaacaggctgaacactttgccacgaggcttcggctccctgccagctcttgaggttctggacttgacgtacaacaacttgagcgaaaattctcttcctggaaacttcttctacctgagtaagaaactttcaattctataaatctcctcaaccttgtactttgcgttctgagagggaaatttatttgccaggacccaaactccaagagaaattattggacagagataattttttctttagagactccttttgaatattccttcgtagctcagcagtatgtgcatttgatagatcgttatgtgacaccattgggctgaagtggacttagtaatgtcatattaacattctgagagagattatatacctaaatgagatcaagcctcacatttagctaagagacttgactttctttttaaatagcatgccaaaaaaaaaaaaaaaagtatcttcctatgttgctattaattctttgtaggatatttgcccaggatattccaaccaattatttattaaaaatatttattaataaaccagtaacacaattttaaaattttccagccagtattcctattttgagccttttaaaaagtactcttattgacctatttatccagtacacaggcattaagaaattattggccacaggtgaacacactttattctttcatatgcaaacaaatttcttgctggagatgcttttgaaaattaaaaaatgatttcttctgggaactcatgcactattttggacaaggtttgcttcccttaaatcagtgttctatttcttcaaatagtaacttgtgtggcattcagaaaatctgaattttcagagctgatctctaaaattttattttttaccttacgtacattacctttctatgactttctcaagcacatgaaaccaactataaaatattttcttgggcagtggagcaactatttttattatgttatattaacatgcagttctcgggagtatgagctacaaagatcacttgaggctaggagttcaagaccagcctgggcaacatagagagaccctgtctctagaaataaaaatttaaaaagtagccaggcatagtagcatgagcctgtgatcttagctacttgggaggctgaggtagaaagagtgcttgaggccaggagtttgaggctgcagtgacccactgcactccagcctaggtgacagagcgagactctgtctctaaaaaataaatacgggtaaacaaaacatgtatctaattatactcagcttttttggttgaagataaacagatgctttagaattttagccttcagtaggttggaatcgtattatcattgtgtaataattatgaacaaatttctgactactgatattctccttaagttaggatttactctgttaacttcatgtcattattttagcctctttgtcttcatttacttttgtccttaaggctgtagaaacacgtagtaataattagtcagattatggaactgatgagctgtggttatagcctccatcaccagaaagccttccattaatttgtaacacagtgctatttacataggaaaaggtctattttaacagagctgtattctcttgaaagaacccttttgccctaggtatccataaaagtggcacagtagtgttctttgttttactttggatgcaaatggagaaataaatgtgaatcaaaagtaatctatgagaagtatagcaatcttttctgaaaatgtgctgaaactctgtgccccaaaatgctggcgcccacagttgttaattgcgtcattcctcttggatatagatgttttcctggacacaccagctacacaataagccagtaaatctaagtttgacctgcttgttattattgggagccctaggtatgtcaaaggcttttcaccaagccagggttattaatcaaagctgactccctcgtattgatcagacctcaaatggttgtgttccatgccaccctgtttatatattgctgtttaatttgcagccaccctgcgtgcactctatctaagtgacaacgattttgaaatcctgccgccagatattgggaagctcacaaagttgcagatagtaagtaatttatctaaattcttagaaaatcaattcactgctgcagccttgtaggggtagaatcaagtcaatttgagcaggagtaaggtttgttttgtgggaataaaccactactcctgatagtgtttcttgattatccgccggcacttgtaaatacatggaaaggattgagctttagtagaagagaggacatagaggatgagagtttctgtggagcaccttttaatgtgtaaatatgttgacaacttgttttcttctgtttagctcagccttagggataacgacctgatctcgctgcctaaggaaatcggggagcttacccagcttaaagagctccacattcaggggaaccgcctcaccgttctgcccccagaactaggtaaggttgctgatgaatgaacttagttctgggtttcatgaataacaattatcctaatgtagcaattctgaacaacctctgtcctcttcttggcaactactctccacctaggcacacgatgctgatcatttgagaaccatttgtcattgaccagagttagctgttacaggtttgaccttcccggatcctgtgttctgcagctgtagtgtcccctgtcttagaaactgctgatgaaagatgaccccgctcagctccctgcgtgatgtagtgggaaaagcatgggattagtagtaagagccttatccctggctcctcattgactagctgggtaagctttctgggtcttggttggttattaataactttaagtatcactcttactttttaaccccttaaatttttattgacctggaaaaacttttaccaaatagttaaagtagttgttatggctacttgaacatgttgatacctctgcgggtcgtgaatttgcctctctcctgatcccatctctagtaggaattgttaaatatgttcttgctgggaatggatcctactcctggccgctgaatcctaatcctgtttctctgccaggtcgttcctatttccagggtgggtttatgtcccccgccagaaataacctccaagccagtaattctgttactgcttcgttccactgcaaaaggttcacgagttcccttatcttttcttgtgcagaccctccatagcctctcatttcttcagtcctttgaaccacattgttttctcaaactgcgattatttgcttttctactccaaaataccatcatttttaagaaacacattgaggaagcagttctttaaacaagtttggcagtttgaagaggccatttgttagaaattagaatgcaatcaccaggagggcagggacatttttgtatttgttccctcgggtacagtaggtgctcagaaaacactgactgaatgaattaatgaagcaaggaccttggatgacaggacgttaggaaggttatgagcaggctcatgtggctaatggttacgcataggaagactgagacacagagcacgcctatcagcaccttgagttctgttggcagccatattagtctaaagggaaggcagtcacgtgatttcgtggaccagctgggaagtcccgcctcctctcttgccatttcccttagctctcttgctagtgttaaaaatccacctagaggattatttaatgattttttaagggctgaggagcaactcaacacttctctttactgagttgcaagtagtcacgtgttgctttgggagcagggtgacagaatcaagaaacgctttttgcaaacattttcaaggcaaaaaacttcttgttaaaggagagatctcgggccgggcacggtggctcccagttgtaatcccagcactttgggaggccgaagcaggcggatagcttgagcccaggagtctgagaccagcctgtgcaacatggtgaaaccccgtctctacaaaaagtacaaaaaattagctggacgtggtggtgcatgcctgtagtcccagctactcgggaggctgaggtgggaggatcacctgagcctgggaggtcaaagctgcagtgagcagtgatcgtgccactgcactcctggctgggtgacagaacaagaccttgttgaaaggaaaaaaaaaaaaaaaagagagatcttgtacagtggttaataaccacagatgttagcataagtaatagctggggagcttctgcagaactcaaaaacttgctccctccccaacctactaaatcagaatctccatgtgtgaggtgaattcttctataacttggtgtaaagctcacttaatgcctctgacatgtatgcttggttagtgtggttagtagaaacggaaaaataaatgtgtattttgatgtcatttgatcttatttcatttttcaagcagtgaggcaacgtaggatattaaacaattattttatcagacagtaatttgccacaaaaatgtctagttgaacctacgcatgcctatgtatatattttaaaatcttactcattttgcttatcttatttaaatactgcatgaggtcatatttgttcaacatttctgtaaggctttccattaacaaatcatgtatatttttattcaggtgtagaattgagggggaaggctttaaatgactttatttttgcgagccgtatgtagaaaagcttaatcttaacatttgcctgatagcagtttttcctgattatagacaaacagttgtaagtacgtgataaacctttagaagtcactgtcacaagcaaaactcaagatgaagacaaatggactatttatttttgaatggtgattttttttaaaaagtcaagattagtatactactaatacagtaacagctattataataataggtagtatctattaaggcctggaattgcaaggcactgtaaatgtttttcctgcaatatcacctataattatcgtaagaattataaggagactttttaaagatgaggacactgaggcatagagagagttggttgctgacaagtctgtggggacacagctagtgagtcaggtgagatttgaacctgacagtccctcctctgggtccagcttcctgatcacggtgaggtcctttttcccacccatatgctggtaagaggattcctagaaatgcagtttccaagtttgaacaaaacacaaccccagcacactctcccgaaaaggcaggcggagagatgttgctggatggtgagttggcgtgggctttgccggcatgtgagcaaggctagcataacactttgcaaaacgcagctgagatggcctctgcaagacaaattgctggccctttccaagccagttgcgttgtccccgtgtctctttcccctcagtaaacatgccccaggatgggatcgtctttggtttttttgtgtccccaacgcctgaggtgaccatctggatgctgctccgggctggctgatgggcagtgctgggcactggtgatgcatatgaagcttatgctgcaggtttgcttctgggggtgttttaaagtgtggatgatgatctctcgctgtatattttttacatatctgaatacacgagataaatgcttttgagatttctgtgaaatttcctttcataataaatccagagtttattgacttgtaaactttttggtactggtatttgagccaagcaagagaatccaggcgagttctgatttatcaggtctgagaacatacagggacacagcaaaataaagtcaggggcttggctggaggtttaatacgtgattgtgttactttaccttcactgtgtgtctttgaataagccatttaaactgttatgtctggttcttaagtagtaaagcacttgctttcatattagtctatatacctataagaaatgagatgtaagttgagtctcgtgtacccattcattcatttattcattcaggttaagttcctatttgagggcagacctttgagtccaaggaacttgccttttccggtaaagtaagagtcacttactcaacaactgtttgttgagcccctggtatttgctagggattagaacaagagacagaacacgcgtgactgatgatgttctagcgggagaagacagaagaaagagagagagaatatgaatgacagatatgtggtattaagagctctgggaaaaaaatggagcatggaagggagagcccggctggggaacgggtaatcagagaaaccctcactcatagggtggtgccctttatgcagagacttaaaggaaggagggaggtcccctgacagagagaatggtaagtgcaaaggtcctgggtgggcttgtgttgaggaagagcaaggccagtgtggctggaacagagtgagtgaaggggagagagttgtaagcaatgagcttagacaggaaatggggtctggttcacatgggaactggtaggacattgtccgaacttgggcttttactccgggtgaaatgggcactcctatagatgctcccgtcctaatcaccagaatgtgagaatttgttaccttatatagggaaagtgactttgcttatggactttgtagtcttgagatggggagattatcctggattgcccaggtgagcccggtgtaatcacaaggggcctcctaagacagaggaaggagggtcagaggtaggagtagaagacatggtgacagaagcaagaggctggagtcactcatggaaggggccacgagccgagaagtacaggcagcctccagaaactggaaaggcatgcagccggatgtcccccctgcaatcccgaagcctccagaaggaatgcagctttattggcacctcaattttagctccataaaatccagtttttggacttgtgcactctacaacagtaagagactagatttctattattttaagccactgcttgtagtcattggttagagcagcaaaaggaaactgatacaaatgggaagacattgaagggttttgaggaaaggcatagcatgatctgactttcttatttagacacagagtctcatgtgatcacccaggctggagtgcagtggtgcaatcatagctcactgcagcttctgtctcccaggctcaagccatcctcctgcctcagcctcccaagtagctgggactacaggcgtgcaccactgtgccccactggttttctcagttttttgtggagatggggtgttgctgtattgcccaggctagtctcaaactcctgtgcttgagtgatcctcctgcctcagcctcctgaagcactgggattacaggcatgagccatggtgtgtagcccctgactgtttttcagaggagttctttggctgctgtgctgaaaataggctggagggcagagggcaagggtggaagtggagagtctgagagataggagactatcattgcaatcctggtgggagtagatgctggcttcatccagatggtactggtagtggtagaagtaatggtcggatactggatctgtttccaaggcaaaactaacaggaattggtgacagtttagatgaggggtgagagagttaaggttaactgtgaggtttttggtctaagcaactggaaggctgggaaagattttaggaagagtagattaggagagggattgaggagaggaggtcatcctgacctgagcctcagatatcttaaatttgagatgccttaagggtgtctcattgagaaggcgatagggtataagaatctagagtccagaagagacgtctaggctgcatatatagtttggggcattatcagcatacatttaagagtacaaattggatgagatcccttgtgtgtgactgcagagagtgaaagattgagcctgaagcactatggttcctaaacactgaagccagaaggatcgaggatgttaatgggtcgggctgactcccaggcagacatccgtggccattcagggactgtggccacctcggttgacaccacagatggctccccattgctggagctgtgtggtgtgttttagcttcataggaaaaaggggttctcttatgagacagatgggggttgggggattattctctttttcctgacatatgcagttaactcggccaggacaggacagtggaatgcacataattgaaatatcctccggagcctgcctgaatgcagaagtctctttttgcccagtattttcagccagcatccagactcctaaaaagcagccagccgtgtggctaactgaactttcaccccttttttgttcttttatatattatttcttagaagaattaattagtagagaggataaaaatcctgcgttggtagtgaagaaaggaaactcaatgcataccctgaacaatcctcagaataggtcaacagccccaggaaaaaaaaaaaaaaaaaaaaaaagtgatttgggagctggtgacgtcacctggggtttgttagcagttttctattccatttctgcattttctcacctgccgatgagaccgctgttgtgtgagctgaagatctggattctgtgttttgcataattctctttcctgagcattccatggtttctgctgcttgttctgaattggaatcgtttctggttgcttggcttctaggcagtaatgggacctcttgtcccgcatttgttacccagataattttgcctttggagaagagggaaaaaaaatcacattggtctgctcggcatgcaacaaaacaaagtgctatagacatcaaaaccttaatttgcaccaatcccagcagcctatgggacgtatgtctgcaacgctgcatacacctggggctagccagcttagtgccctgcaatatgtgcccacaatcaataacattttttactacagtaactatgagaagcatagtattttctagcatacttgtgaagagtggaaacaaatactaatccccttcagagagtaaaggatgttatgaattgagaatttcctctcaattatatactccagaataaacagaattaacaatgagtggatgtacagtcaaaaatctcttgttatatctcttaatccttttcctgtggacattaagaagctaaagaaaaataactttcttttctgaggcagggaagaagaaaatccagtatttgtttggtcaattaagtccctgattataagtgtcttgtttatcttctcttctgttactgtcattctgtcaactggttcccatttattttatccagaggtttaaaacgttttttaaatgtaaacagtagaggatagaggttaagtgctggactctccatcactaggcttgggttcaaacctcactctcccactgccttgttctgtgaccttcagatattgatatgatgtggctctgtgtcctcacccaaatctcatctggtagctcccataattcccacgcgttgtgggagggacctggtgggagatgactgaatcatgggggcgggtctttcctgtgccgttcttgtgatactgaatgggtctcacaagatctcatggttttaaaaatgggggtctcatacacaagccctctcttgtggctcctgccattcatgtaagatgtgacttgcttctccttgccttccaccatgattgtgaggcctccccagcctcgtggaactataagtccagttaaacctttcttttgtaaattgcccagtctcgggtatgtctctatgagtagcgtgaaaacggactagaacagataacgttattttacctcccttctacacctcatgtaaaatgagggtaataacagctcccacctcctggtgtctttgtgaggattaaaaggataatctgcttaaagaatttagccttgattcaggaatgagtacagctgctcagtgaatgttaggtaaatgaacacacacacgcacatacacatacgggcacagtggatatttatgctattaaactttgactgtttagagaccagctttctgaaacctgggctcttctgaaacagtctaagcagagaggtcaccccagccccacccttttgacagggaagaggcagttagttaccgagtgcctagtgagaaagaaacaacagagtagatccaaagccaaagtctcacctcacacagtgggattggtcagtgtatcctgtggataaaagaaaggctgggaattatcctcctgtgtgaaaactgaggcacataggaagggtcagaagagaaaagcgagggaaaagaaggggcaagagggaggagctcagatgaagggattctgcatggccagtactcagggtggacaaaagacatagcaagaagagtatgcccgcagtccatccatcctaagaattttataattacaagcaattttccaagtctgtgcctttcttgggagttttatattgaggctgggagcaagttctggttgttctgtgtaaaaagctctgattggctttttggttggaccattggttgtttcattcactcattcacccattcattcaattctttctttttgacatcctttatatgattattaacttgttcctagtaagtgttgggtactttgtagtacttgcagtaactgattagactcacttctttatccatattaagatcttaaactacctctctgcaagtgacaacattattttctaattgtttaatttctcactgtcttaacattaccttttgtgacagcgcttatttcattggggattttttttattctcccagaattcatgataacaaccactgttctgaaccaattgcttcatttgttatatcagttgtgtgcctacactataatgcatttgtcacttgtctacatattagtaatttatttcatgtttaacatatgctatataaatccatcttttgaaatctttattatcaattaaaagcattatagaaaaagaagtctcttctggaggtcgacaaagtagttcagctcttatatgaaatcttttctttctttcttttttttttttttgagacagagtcttgctctgtgtcacccagactggcttgcagtggcatgatcatggctcactacaaccttgaccttctgggcccaggtgatccttgcacctcagccttccaagtagctgggaccacaggcatgcatcaccatgcctggctaattttttaacttttttagagattgagtctccctacgttgcccaggctggtctcgaactcctgagctgaggccgtccttccaccttgtcctcccaaaatgttaggattacaggaatcagccacccacctggctaaatcttttaactatttccttaagaaaagatgtagtgcgattattaactatgtctagaataagcagactccaaatacataataaaaaagttaatttttttagactagatttttgtttcggggtaattaccttccccaacccaaggcagctttatgttgttaacagaattggttttcttgcctaaatcctattactatgaaaagaaggtctagcttaatagatagagcagtaagtgacaaggatgttctttatggaattgtaaactgtgccactttcgcatgaataagattgactttgtcaattgatcactaacatttttcagattagttttaagctagatataattacagacatatcttagtttttgtgcagaatatcgtaatttgcagaagagtttcatgcacttaatctcagttgtataatgtaggcaaggagagctctctggcctctttttaaagatgatgggaccaagggagattgtgacttgcctaaggccacgttattgacatggcttattatagacagaatccagtttttagttcagatcttcctaattcaaaaataagcattcctcccaatggtatacccatcaatgtgtcaaaactgagccaataaaaaggcctaatttattattaggtgacagattgctgtggttccaaatatatgccttaattttatttgaaaaagaaaatgttgggaatagaatatttgtacccaactttgaattttgacttggattttattgcatgctcctacgttttaattctgcattaatatttcttttgccatacttcacaaaaaatcataccatatcctttgattcccctggccttcactgataatcaaaaatgactcccgtcaagtctcctacatgatattttttaacaagttccattttatatattctatttcagtgaaatctttagccccagaaaatgttttcagcatggatttttaaaatgctaagtgaattgtatttctgcctggtgagttattgccttaaaggggttgggaagttgcaacacataaagcgtttccgttttgtagtataaatttcaggaagcccagtgtcaggttcagcgtgattgaacatgtgcatcaatctgtgttaacaccagctggaaaagcttgccactgtgtgcagtggacttcctttgatttaataggatgctaaatgtattttgccctgggagaaatgccggcagtgctaacgttccggatttaattttttttttttttaaattccagaggcatgtctctaaatacagttgttatcacctcaatacatatataatatcttacatttatgtagcctctccctttgaggcatctcctatatattatagtgttcctatgttaaaagaaaaaaaaagcaaggttatactgagtcagacccaaatggtattgcatgcgtgtgtgagtgtgagagtttctttcagagtgcagtgggagtttgaaaggagtgaagtgggtgacagttgtccctcatgttgtcaacacctgaaatctaggccttaccgtgacatcatggatcagtctttcatatttatatttagacctttccagaattcttcacattttcaactgagtattaattccctaagttgactacccattacacaaaagcatctaattgtaccatttatactcctgtgaagttttgggtgatagcattctaatattagtaaataagcttatgctcattttttcaacatacgtagagtgattttaacacgcctagtactctctgttgccttttatatttgctgttttaaaaatatcggctcttctccttggacagcccctattgaatccatcttaaccataccagaatctgacttccaaccccatatacattatatttctgtaatcagttcagtttggggagcactggttaaatgaaacatacataacccttaccttcatgaagaaaatctttgaaagaaagaaacagctgcacaaataaacattacaaaatggctgctagaatgtaagcttccccaagacattggtttaagccaccctcatctctcacctgggttgctagagtaacctttcaactggtttcctgcttcctaccttccctttacaatccattcttcaccccgtagtcaaggtgatcttagaaaattacagagtggattgtatgcctttgtcaattagagctctttaatgttccctaggaatatttaaggcccatctggcacccatggtttccatgctacttatcaccctcactcactcatgagccgctgtcaataacctcctctcactttttcatgatctttgctctctccttggaattttcacctgaatatttttgcagctcataccacacaattcatacattctaagtgtacaattcagtgttttttagtatgttcagagttgtacaaccattaccacaactttagaacatcgtttgttacctcaaaatgaaatgccatacccttttctttcccactccaatccgtccatctctcctagccctaagggttttatagtttggctcttacatttatatctttgatccattttgagttaatttttgtatgtgatatgagctaaggattcagttttattcttttgcctgtggctgtcctgttgttccagcaccatgtgtagaaaagactgttctctttttatcaaatggtcttggcactcttgtcaacaaccaattgacagcagatatatagttttatttttgtactttcaatgctatttcacttatttatatgtctatccttatgcgagtaccacactatctttagtactgttgctttgtagtaagtttttaaattggggcatgttagtttcaactttgttattctttttcaagattgttttagctattttgaggcctgtgagtttccaaatgaattttagaatcagcttgttaatttatacaaagaagccaacttgtgttttggtagaaattgcaccgaatttgtagattatttcagggattatcataatctcaacaatatgaaggcttcagttcagatccatgaacatgggatattttttccatttatttagatcttcgatttctttcagtaatgttttgtagatttcagagtttttgatacttttgctaaattttttcctaagcattttattacttttgttgctattatatatgaaattattttcttaattttacttttgggttgttggttgctagtatgtgggaagacagtggatactgtattgattttatattttacaaccttatgaactcagttattctcattgttttttagtggattccttagaattttctctttatgagagctgttttacctcctcctttccaatctggatgtctttaattttattttcttggcaattactttggctgcaacttctagtacagtgtggaatatagatggcaagagcagacatccttgtcttaaatcttaaggggaaagcatccagtcattcaccatagaatattatgttatctgtaagatttttttgtgtaaaccttgtcagattttacaaatgcccttctattttttgtttgcagaatgatttatcatgaaatgttgaattgtgtcaaatgccttttctatgtctatgtggcttttattttttgtatcttcctttttatatatttctggatttcatttgttagtattttacttaaaatttttccacgttcatgagggatattagtttgtagttttcttctggtattatagtatctttgtatagtttttgtttcaggactatcgagtctcataaaatgagtaaaatttgatagtttttcttttttgaatgtttgaaaaaattcattattgacgccatctgggtcttgaattttctttgtgggaaagttttgaattatgaattgagttttttgatataaggctcttcagattttctgtttcctctagagtcttttggtaattctcatgtcttaaaaatgtacattttggccgggcacggtggctcacgcctgtaatcccagcactttgagaggctgaggcgggtggatcacctcagttcgggagttcaagactagcctgaccaacatggagaaaccccatctcaacaaaaaatacaaaattagccgagtgtggtggtgcacacctgtgatcccagctactcgggaggctgaggcaggagaattgcttgaacccaggaagtggagtgagctgagatcacaccattgcactccggcctgggcaacaagagtgaaactccatctcaaaagaaagaaagaaagaaaatgtgtagtcccagctactcaggaggctgaggcaggagaatggcgtgaacctgggagccggagcttgcagtgagccgagattgcgccactgcactccagcctgggcgacagagcgagactctgtctcaaaaaaaaaaaaaaaaaaaaaaggaagaaaatgtacatttcttgcaaatcaaaaccacaatgagataccatctcacaccagttagaatggtgattattaaaaagtcaggaagcaacagatgctggagaggatgtagagaaataggaacacttttacactcttggtgggagtataaattagttcaaccattctggaagacagtgtggcaattcctcaaggatctagaaccagaaataccatttgatccagcaatcccattactgggtatatacccaaaggattataattcattctactatgaagatacatgtgcatgtatgtttattgcagcactatttacaatagcaaagacttagaaccaacccaaatgcccatcaatgatagactggataaagaaaatgtggtccatatacaccatggaatactatgcagccataaaaaagaatgagttcatgtcctttgcagagacatggatgaagctggaagccatcattctcagcagcctaacataggaacagaaaaccaaacaccacatgttctcgttcataagtgggagttgaatgatgagaacacagggacaacagggaggggaacatcacaccctggggtccgctgggggggtggggggcaaggagagggagagcattaggacaaatacctaatgcatgtgcggctgaaaacctagttgatgggttgataggtgcagcaaaccaccatggtacgtgtatatgtacgtaacaaacctgcaagttctgcataggtatcctggaacttaaaataatttttttttaaaaagtacatttcttctgagttagtctgtattgtccccatttttattgttaatttatgttttccatttttcccccctttgattgattggtccaaatagctgattgtagtttcactgagttattttattctttgttttgtatttcaatgatttgcttttcttcttctgagtacagctggctgtgatttttctagcttgtttaggtgaaagcttacgtgattgattttcagtttttcttctttttttttgagacagagtcttgctctttcacacaggccagagtccagtggcgctatctcggctcactgcatgctccgcctcctgggttcacgtcattctcctgcctcagcctcctgagtagctgggactacaggtggctgccaccgggcccagctaattttttgtattttttttttagtagagacggagtttcactctgttagccaggatggtctcgatctgctgacatcatgatccgcctgttttggcctcccaaagtgctgggattacaggcgtgagccaccgtgcccggcctcttcttttttagtgtaagcatttcaagttagaagtttttctccgttgttttagcagcatctcacacattctgtaatttcattatcattcagtttcaaatattttcttttgtaagacctggggcctgttatttagaaattgagaatttgtttgttttcaagtattcggagatatccgaaacattttgttactgatttctaatttaaattatgtcctgatcaaaattcatagtctatataattctagtccttcacaatttgttgatttgttttatgggcctgcgtattctctagttggtgaattttacatgcacacttaaaagttttatgtgccccatcagtgttccataaatgttaggttacattagttgatatgttataactcccagtaatattgtttttttttttccttaagttagttttcttaaataactttagagaggaggaaaaagtttttcacattgactgccgcttctctatttaccatttctgatgctcttctttccttgatgtagataggcgcttccatctggtatcatttgcctttatcctgaagaattttttcttttgtatttattgtagtacagttctttttggtcattaattagcttttgtttatctgaaatatttttattttgttttcagtttttggaggaattttttttcaggatatgaaattttaggttgacaggttttttattttttttacttctaccttgcttcaagggtgttttcttgtctctggtttgcattgttttagtgtctttcttacattgttctctgtgtctatttttctgtggcctcttaaaattttctgtttatcattgggttttagcagtttctcatgtaacatgttctttatttctttttgacagttttatggagcttgtctcatatatgggtttatagtgttcataaagtttgataaattttcagccattttttaaaattaattgattggttggtaggttagtaattttcagcctttttttttattgattgattgatttcccatctctctctcctctcctagaacttacattactcttgtgttagatcacttgatatcttccacaggtcacttatacaaaactttttatcttgttttgtttcttttcatcatcttcccccctcccctcccccaccatcccccttttggcttcagtttggatagtttcttgtgcactgtcattaagttcagtgattttttttgttctgtagtgtctaatctcctgataagcatattcagtaagatttattgtttcagatgttgcatttttcacttccaagtgtatgcaaggtatagctctttttataatttcatttctcaatttagatactatttatttccttattatgttcatgtttttctttaaatctttgcacatattttaaattgctgttttaacatttttatctggtaatgtaatttctgattctgtttgcattgatggatttttcttttgtttgtaagccacttttttcctcttactctgaatgtctagttttctgtgggtttttttgttttttggtttttggtttttactgtatcgtagacattaagaatagtacatttttggttgtatgaattctttttgtctttttttatggtctgttgggtttcattctagcaggtcgttaatttttggttagcttgattctttcagggctggtttttaatgcctgttagacttggtccttactagtctttactcctgggctagattaaccctaatcttaagacttctgggattactgcctcttgaccagggtgcttagtaacatcgttactctctggctgatcagagtgtgagtgttttctagttctgtgaaaactccagtgattgtttagcttatatcttccttgtaattggtctttccctggtagttatatcttccttgtagttggtctttccctggtagtttttgttttttctttcccagcctttaggagtcttgtcctgaacattgtagttaatatttggcaaagattcatgggaattcctgtgcagctttctgggcctctttttcttcatagctcctttcctgctatgccctccttgccccacaaattccagctccttgagtagcctcaaactctgatttctgtcctttcaattcagcattgccactgtattgtttgatccactcttgcacagctgtctggaaatgcttctcagagaaaaccagagtgaatgtggagttttccttactcattttccttccctcatgcatcatagtcctgtgctgcttgtttcctgatacggtttggctgtgcccccacccaaatctcatcttgaattgtagtttccataatctccacatatgggagggacccagtgggagacaaatgaatcataggtgctgttagtccatgcttctgttcttgtgatagtgagttcttacaagctctgatggttttataaaggggtttttccccttttgcttggcacctctccttgctgccgctacgtgaagaaggacatgtttgcttcccctctgccatgattgtaagtttcctgaggcctccccagccatgctgaactgtgactcaattaaacctcttccctttataaattatgtagtcttgggtatgtctttattagcagtgtgagaatggactaatacattgcccaatatctagaagcatttctattatacattttgtccagttacttcagaatgccagaagcaaaagtctggattaatttttgataactgccaatgtggaaaggtataattatttttctgctcttttcttacccatttacacaaccgccagaggttatttttgctcaggtcattccctcaaccctgcattcactggctggattccatagcagacatagcggtattaggatgcatatcagacttcatgttatgtacacatgttctttaagaccattttcatctttattcttggtattaacaagtttttaacccctagaataatttcttggtctttattgctttttaacttatctgttaatgcactattatagccgagaccaactgtattagtttgctgggtctgccataacaaagtgccaaagactgggtgacttaagcaacagaaataaattttcttgtgttcgtggagattagaagtctaatgtcaaaataacagaattggtttcttctgagggtttaagggaatgattttttctagacctcactccttggcttgtgggtggcccttttctccctgtgtcttcactgtgccttccctcagtacctgtctgtgttcagctttgcccttcttgtaaggacaacagtcatattggattaagatccactcatatgacctcattttaactaaatcatctctgtgaagtcaccatttccaaatagtcacattctgagatattgagggttaggatggaattcagcccataacaccaaccatttctcatgtttcttactttttgctgctgagccttggtgtaaaacttgatatcctgtgatactgttgcattgttcacctgcttattcatgtcatcattctttttcattattgcaacaataagtcaagttaccttaagccattatttttcatcttttcagaaatctttgagaaacaagtgaaacctatggagataacccccccaatatatattttcacatatgacattttacatctaatttggagagttttaagatgcccccatatccacgcatgtgccctttagtgcagaattcccgccccaaatattcatcattgtaaccctttattctaggttccatccactgactggtatagatgtcattcatgtataactaccagatttccccctgaatcacatgcagatgaagaagagtgtgtgagcacaggattcatgaatgcctagtgcaggaagttataggtattgaaagggaaaagcaatacatcactcatttgatctgctctctttcagatcataggatgtagtggtagatggtcacatattaaactttaaagaggtgttggctttcttcccccttgcatttaaaaggtgatgtgctgcaatgtgagacaaatcatgattcactacaacagtgttgcagtcagttatataaattgccaatgaaacactaaatctgtcactttgtgtgttccgacagtttagcaattggagtcgtgttggaagagggctgactgggaacaaaagaagctgatatagtggcagatgcaattagcaagatcaatggttagtgttaaaggttcattgtttggtcattttggttgactgaattgaaagcaattgctatctaaaagactttgccagctgtaatttgctataagagaatgcagaaaagttagttgcccaactttataacatcttggagactgttatttctcaacttgctgtgttcctaggacagtgaccaaaagattcagcttgttcttctcattcaagctcattcaagcttttaatagatactctagaatttctgcatgttcagtatatatacgttttttactttagctgttcacctacttctttcacaaaaatttttgggtccgtgttatagcctttataacagttctttgaaccctaatttattacagctttctgttgcttcagactatgagagttttcgctgatcactacttgaactatagcaaacaccactttgaataacattgggttttctgtttttgtttgtttgtttgttttgcgacagagtctcactctgtcacccaagctggagtgcagtggtgtgatgtcacttcactgcaccctctgcctcctgggttcaggcaacactcctgcctcagcctcttgagtagctgggattacaggcacctgccaccacgcttggctcatttttttttttttttttttttttttattgtcgtagagatggggtttcaccatgttggccagactggtattgaactcctgacctcaggtgatccgtccatctcggcctcccaaagtgctgggattacaggcatgagccaccatgcccagccgggttttctattttaataagatttatataactttgcatttcagtgccttaaattgaccagtttttagaaatgaatataggtgaaaatatttgcctagtaatgatgatggctgatgatactaatagtccatttatgagtgcttatcttccctaagataggtcatcttaaataagatatttctgtgagctggagttacttttttcccattttacagatgaggaaccttaagcttagagtaacctgtcaaagccatgcaggtagactttatcaaactccatccatgcttccaaccttggaagttaaccaagagcttttaaccacttctgcagaagtggttaagaacctatgaaatgtttattaaattcttatctaatatcttcgtaagcctttctgaaaggcacaaaaggtatgacccagttctgtttctaacagagctactaacctagtgaaacttgaagaatagttaacctgttaaattggaacaccaggtgtcactgcagtagaaatgtagcctgggcagaaatcatcatggcttgagatagtctaaaaaagcttctgcagtatcttagtcagcttgggctgctataacaaaaataccatagactgggtgacttagacagcagaaatttatttctcatggttctttgggctgggaaatctgagatcaaagtgctggctaattcatttcctggcaagagctctctttctggtcccaggtgacacatcctttctgtatcatcacatggcagagagatcatttttcttgtgtctgttcttataagagcactaatcctatttataagggctccactctcatgacctaattctcttccaaggaccctacttccaaataccatcacattagcacttagggctttaacatatggatttggaggggtcataaatactcagtccacaggaagtagaggtgagattttagctggcacatagcagaatcaacaatggtaagagaaaatgcaaagcagtggtatatattacatttcatgacttgaatataaatttaaactgttgttaggctatggtctctgtccctttgtgtacttcccatgagcactcatcagaactgcttttcattcagttaggtcttctgtgactagttgggtaatactgaggcatcagtttggtggaagctactgatactgtacttcctcatttagcccagttggttctcagagtttataagtccattggccccttaaggaagtcaatgaaagccatagattctgtctaggaaaaattgtatatacttgaccatgggacctgggattaaatatctctgccctgtcccaacaatatcggcttatcttaaccactctcaaaagcgttggagataaatggcagaaagctactttttatacctcagtagaaaaaaaaaaatgagcaagaacagatatttcacaagagaagatcaatgaccaagcctataaaaaactggtcagccttagtagcagtcaatgaaatgcagattaaaacaagttactattttttagaatatcgattaacgaagattttaaaaatgataatgcaaagtgatagtaaaggtttggtgcaatagacattttcatgcattgctgttggattgtaaattagcgtgttaattctagacccatttttggagtatatgccaggcaccgtaaaagcttccaaccttttgttgcagtaagctcccttggaattctatcatcaagaaataatcaggaactcagaaaaggttagtataaatatgtttcttgccacagtatttttttttttttttttgagacggagtgtcgctctttcgcccaggctcgagtgcagtggtgctatctcggctcactgcaagctccgcctcctgggttcacgccattctcctgcctcagtctcccaagtagctgggactacaggcgcccacccccgcgcccggctaattttttgtattttttagtagagacggggtttcatttgccacagtacttttaacagtagaagctttgagccaccttgatataaaaatggttaaattaactagtagatgatggaacataaaatgacacgagaatacttataatagcacattataagattgcatttacaaggccgggtgccatggctcacgtctgtaatcccagcactttgggagtctaaggcaggtgcatcaggagttctagaccagcctggccaacatggtgaaaccccatctctactaaaaatacaaaaataagctgggcgtggtggcgggcatctataatcccagctacttcagagactgaggcacaagaatcgcttgaacccaggagacggaggttgtaatgagccaagatcacgccattgcactgcagtctgggcgacagagtgagactcagtctcgctgaaaaaaacaacaacattgctttacagtgtgattccagttacagagaatattcacataggtgcataaataaatgaaaaaattattggttaatgtctctgtatgttgggattctcagtgattttatttttctactttttattttttataatttctccagtgtgttggtgttagctttatagattatatcaagtaaccttttgctgcaccaaaaaaccccccaaatctagtggattaaaacaaaaccatcttacaattttgtcagaactgtctaagctgatatttactgggctctctcctgaatgtggggtcagctggggggttggctaatagggtaccctaggatggtctcactcatctgtggtggttggcagaccgttgtccaagacactgcacttctcttccgggtggcttctcacgccttctgatgtgctagcttgggtttgttcacatggtggtctcttccagggatagtacaaggtacagctcacgtgcatgaggtgcaagttgatacagtttggatgtttgtcccctccaaatctgatgttgaaatttgatccccagtgctggaggttgggcctggtgggaggtctttgggacattggggcggatccctcttgaatggcttggtgtgtcctcatggtaaccagtgaggtcttgctttatgagtccccaggagagctgattcttaaaaagagcctagcacctcccttccgtcttgccctccatcctctcgctgtcatctatacacaacagctccccttccccttctgccttgagcggaagcttcctgaagccctcacaagaagcagatgctggcgccatgcttcttgtgcagcctgtggaaccaggagccaaataaaccacttttctttgtaaattacccagcctcaagtattccattatagcaacacaaaaatggactaagacataagcccaggtacacaagcactttccaagtctgttacattcacatttgctaatgccctctctattgaccaaagcaattcacttgattaggcccagagccagtgtacaaggaaacaccaggggcatggaaggtacagaggagagggcgggatgatcacagctgtttttgcaaacaatctttgacataaacagtgatatcaatgccataaaaaagaaaaataaacccctaacccatctgaatcctagtgcagagccttctgagagtgatagtatctttatgttttgactgcttcagaggtctccatatcttttcatgcctttgtggttacaaggagtagcgaagacgggggcgggcagatcagtgatcaccttccttggccttccttggccatctagcatacagttaaccttccttgactatctagccttcagttcccctaccactcccttttcagcctgagtggccaggtacttgggcttatctgttaatttttctttctctttcactgaaacttcctgccacacccagaagaaaaccaatagcatggtactcacagggaggtgaatagaattataatcgaagagtgctcattttgtgggtctgaattggaagtgtatttttgtttttgcaatatcactaataatgtttcctagccttgtgtaagaattaaaatgtgttgcatttcattgcaaattttctgtgccaagacaaaagtagattattctactctcactttgtgtaacaggaggcaaaagcttccatagatgctttatgaatagtattttgaggcctagaaaaataagttgcagagtagctgaaagtgctaatggagataaatacgcggcatatgtttgcatagtgccttagtttcctattgctgctataaacaatgagcacaaacagtggctgaaaacagcaccgatttattctcttatgcttctggagggcggaagtctgagatctttttcactgaattagactccacatgtcacccaagtcacttccttcaggaggctctagaggagaatggctccttgcctttctcagcttctagtgagtgcctgcattccttggcttacagccccttccttcatcctcagaacctaccacatcattctctgctaccgtcatcacattgcattctcctctcactctgattcttctcccatccctcttataagcaccactgcaattatatcaggcccacccagataacctccccaactcaagatccttcacttatccacttcgacaaagtcccttttgcctcatgagctgatatgcgcaggttccagggattgggacagaaatatatttggggagccatcaccccgcctcccacacatagtaacacacctatgaacctcatagttccgttgcgtttgtgaaagtggtttctttcccctgcttcatgatgggcctatgtgtcatcttctggatgagctggctggtctgcagggttctgcctcacttcctgatcctgattccactgggatttgggtctgggtatgatgaagggtgtaggtgtatatgtgactgatttttattcttcatattggggagaaatgaagtttattttgctctcctccctcattctatatattgatattatgattaatagcttttgacaccaaactattttgaaatatgagtcttttatgacgtattttgacagcagcaatggcatgcttttcgctgttgtaacaggagtaaatgacaggggccactcgctcattattttatacccaagtaatcaaccaaagatgtcatgtccagaaataacactaaaatgtcaaccacccaaatctcttgcaaatagtctcattcagagggttggaatctgccttactggcagttttgaaagatacaatttgttgaagacagggagccctaagtgatttctttctctctccgagatgccagatgggtgttgaatgaagtccagtttttagtttttctgtagataatttttttaagtttgtggtggtgtttcggatcttcatccgtgtgttctccctcctctagccccccacggctacccacagcctggcagcggtatggttgccttggtacctgttcctgaaggctgtctgcaatgaaatttggttgtctaaatagcacgacttgtcatctaaaagtagaagtcattagcacgatgccgtttggctagtggtatcttgaatgctgttttaaaaattttcttattttatcactttactgttactgtttactcatgtcatcactggagatttcagggcctgcttcacactatggatccggagtgaaaaatacgaaatgttctccctaagagtttcccagaacttgcgccaaaaacagtggcccgagttggacattttgtatatttttagagacacagattttgaaattccagccgttgttacctcgcgtgatcagtaatacttgcatattggtagcggcaatccatgattgaacagccttctgctgtttctgagggaaatgaaatttctgccagcttctgtttgaactttaattggccttcactgtggtcgtgaatttgccagaaacacgtatttatctcagaaaaggtagcatgttttttaagtttgatataaaagttgaattgggtgctttgggaggatttgtgtccatttgcctccaatcaagttatctcctctgtgaaattataacaaaagatgcagccaggcggaacatcgtcactctttccgcccaggtgagtccactctgaagtcaatgactcctgtcactataggtaagatgggaggccacatcctgttcccttgtggtaggcatcttggcaaaaaccaccaactggcagcctgtgttgtgaggaatgcacattaattagttccttgaaactcttccctcattaacttcaggtaagttgttaaagcaaatgttctggagttcagagtgttgcttttgataatgagaaaacaagtttagtcatcagaatctgtcatcttgtttataaaacagtcaaaccatatgcaacgcccttctgcatggtggattttgttttgttccttgaacctactggctcgcttcatccaatgcctacagatagtaaataaagaggtccatttttttaggtacattaaatactacaaattttgggaggggaggtagagtaggagggtggtgggcagaaggcagccgggccatttttttggcaactaattcaatatgagaaaaaagatggtattgctctcataaaagtaatttatattcattgttttcaaccaactgaaacattcagaaagctaaaaacatttcagtcaaattcccaccaccttgaaataatcagaagtatgttttggtgaccatcattcaagatacgttcttggccgggcgcagtggctcacgcctgtaatcccagcactttgggaggccgagatgggtggatcacgaggtcaagatatcgggaccatcctggccaacttggtaaaaccccgtctctactaaaaacacaaaaattagctgggcgtggtggtgggcacctgtaatccagctagtcaggaggctgaggtaggagaatcacttgaacctgggaggctgaggttgtagtgagccgagattgcgccactgcactctaacctggtgacagagcaagactctgtctcaaaaaaaaaaaaaaaaaaagatacgttcctaagatagacagaaaggtaggtcaagaagcaggtaactatattgacaaatgaagaagcataatatttttaaatgtaaatttgaatctaagaaaggaaaatcagatgaagtaatttctgaacttttactatgtgagtccaagaatattaagctattacttcctaaaatattactgtaaagtaaaaataacaattattgacaatattgagaagttttatatgtatatacacatatatacgtgcatatgtatctacattctatgtatgttttatacatatataactgtattttaaactgtaattttcaaaatagttttgatagctttttgatttgttgcttatttggctagatttaattgccaagaattttatttttgtttatttcaaatatggtttatgttacatatcctttgttcctgcatactagatgccttagtccattttgtgctggtttcacaaaatacttgagactgggtaatttataaataatagaactttatttcttaccattctgggggctgggaagcctgagatcaaggagcggacagattcagttttctggcgagggctgcattccatctggtgacactgcatcctctggagaagagaaatgctgtgtcctcccatgacagaaggcagaagggcaagaggaatgaacttcccttcttaagccctgttataagcgcaccgaatacctttcacaggggtttaggtgtgcttgtaaacatcatgacttaatcacctcctgaaggccccccgctcaagatgctttcgttgataattaagtttgaacttgaattgtagagggaacagaagcattcagaacctaacacttcagagtatctgttcctttctcatttaatagataattcgtctaggtataaaaatctcgagtcaccttttcttttactggaatcttgtagatactgtctttgggcattgaatttccttaatgtgatactgggggctaacttgagttgcccacttaatgatgacttgctttctctgctaggatgtacataggattatttatttttatttattcatattctctctctcttctcccatctctactatatttattaaagcatcgtacatgtacacaaaagcgcatataacataagcttatagttcagcgaatgatcaacatgccaaaactcacgacaactattcaggtgaagaaatagaacaccactggagtttcagagtttcctctgatctcctttcagtcattaggcaggccttcctctctgctcaaaggtagctacttcttcagcttctaatatcattgacttttgctgttttgggattctacatgaacggaaccattcagtatgctttctggcttctttcactcaacattgcttcttgagattgatcccgattgttgcatagagcagtatttcattcattttccttgctcccatgatatgtgaattatctgtgtgtcagccctagttctcgtttgagctacttactggcttaagcaacagccttgtcacttttgagtcattccccactttgggactggcagtgaaatagaggctgtcagtgggttgatgagtgagcactatgtcccctccctcgttcctgtcacctccttctcggacagtaaagtcactgttcgtgattcccccttctgctcctcttctgccacgtgctgttagcagggtttctctggggatacccactgctgccccttttcttttagtatgttctcactcagatcttagccctttagccaatggctcatttcagtggtcttttaggacggagaaaaatctgtgtcatgcttgcgttccaaggagccatgtgttcattgctaatgccctccctcattttggtccagtttccctgtattcagctaatgttcattatagtttgtggtgttggagtaataaccatttatttatgaaaccattttattatattttattcttttctctttcacagtagattttagggaaggagaatatacagaaatgtttttgttccttcctgtttaactgcatgtctcagctgggcccggtggctcatgcctgtaatcccagcactttgggaggcgaaggcaggcaaattacctgaggtcaggagttcgagaccagcctggccaacatggtgaagccccgtctctactaaaaatacaaaaaaattagctggacatggtggcaggtgcctgtaatcccagctattggggaggctgaggcaggagaatcacttgaacccgggagatggaggttgcagtgagccgagatcataccactgcactccagcctgggcaacaacagtgaaaccccatctcaaaaaaataaataaaaaggcatgtctcataaattagcttaggaataagtgcatttaacaacccaggactgataatgtgaggattactaacatggtgaatatttaccatgttggtatatctctgcacgggtggactgagtttccttttggggccatctcagtcaccttcttccccctcatttgtcccagcgtcctgccctccaccctctagtccatcttcctgcaggcctggctgtccactgtcctgtgttagccctgacacctgccaagccatctgaagcttcccattcttcttggaggctgattaactcagaagaatgctttaaccagagggggtaaactatagtatgcgactagctttatgttcctttataggtttttaatatcagcgaatggagaattattctatactgcctttgagtatgagcttaatctcattcatcatcaaaaagcatctggaatctgccattggagctcttgctcaaatgcttgactgaactgtagggaggtgctttttgttctagtgtgtataatgtgtataatttggtgccaacatggcagccccttcagatcagagccataactttacagaaggaacagtatctctttaaaaatagacacaggtttaagatttaaagtgacagcaacatttttgagaaaattttttatctgaaggttgaaaaaacgttggatcttatataattaaagagaaatgtaacctttatgtctgactgtatctttgctttccagttcaccaaaatggtacccacagttgaaaacactcataagaataatgaagtcacattgcgatggactttgctctcccagctcaaattatgtgccaactaatacagcaaatcgtatgatatatgtgtgtatatatatatatcacatgatatatatgtgtgtatgtatgtctatatacatatacatatatgtgtgtatgtttgtgtctatatgcatatatgtatatgtgtgtatatatacatatatgtatatgtgtgtatatatacatatatgtatatgtgtgtatatatacatatatgtatatgtgtgtatatatacatatatgtatatgtgtgtatatatacatatatgtatatatgtgtgtatatatacatatatgtggctgtatacatgtatatatgtgtatatatgtatatagacacacacatacacatatatacagatatacacatatgtagtttgagttatataaaaagtgtgctcttaagacagatagcttgcttttctctaacctctattgtctggaatattgtctatttggcccttctgtaaatgctatgtagacccataatatccttaactttaattttggatttcttcactcatgagttctaactccatatccccaacctagctagacctctcacctgataccccagatgataaatcttattgcttggtggatattttcactttcatgttccagaggcacctcacattgtaacagacctgaggttgggctcctccactcctcttgaattctgtgcttaggtcgatgacaccaccattcatacatccaccagctagaagcctgggtgtcagctcccatgcttcatcaaatccttttcctggatcagaggttcttacttttcatctgttttcttaaacaatattcccacctcattagtgtgggatatgttccaagacccccagtggatgcctgaacctgcagatagtactgaaccctagaaaaacagtactctgtttttctgatacatgcatacctttgataaagtttaatttataaatcaggcacagtaagagattaacaataataatcaaatagatcagttataacaatatactgtaataaaagctatgtgaatgtagtatctctctctcaaaatatctcttcatactggactcaactatttttggaccatgagtgactaaaaccaggaaagtgaaaccacggataagagagaactactatgatagtacagtggcagtagcaatagtcacggtagtaattaataataaaaatttctcttgtacttgctatgtagccggctttgttctaacagctttacattgatgttttaatcccttagtaaggtaagcacttataatccttatttttagatgaggcaactgagatgcagagagggtaaatatgaacttgtccaagttcatattgctagtacatctgggattctaatggcaatgtatggaaatggagaaggaataccagggcgtcgattttccattgcagttatcaagtgatttgccacccacgtctgtcccactcagaaaagcctattgcaatgcaagagaatgagcgtgataccattaaagggttgatcttggatctagtctaatttgtgaagaacattttataagtcactcaaccatcatgagtaacaaatcgctggggaagtggcttaggcctcccagccacatgccaggaagcctgtgtttggcaatgactgttgctctgtacagaatggctcaagtgttctattggaagcagttggaccttgtggctttcatgctgtcacccttgtattatttcttggtgtgtccaggtaaagctggagctccttagcccagccagaaaggcagctcatggtgcagcccctgcctgcctctctggactcatctcccctgcttccctgtttgcattgtggtttttgctttccgcctccagagatattggagactctgctgtattcactatgatctggttaagcatctcctccagaaagtcattccgagcctcttcactgttctctctacactgggtcaagagcctgtggtgttctcatgagctctttcttcagtatccatatgaaccactagaccaagagcacctgacggacaagttatttatcttcatgacacaaactgtactaatggaatgtttgtgaatgaaaatgtactttgatgaaccagaaccagatactctatttatttatttatttgtttgtttatttatttatttatgtgagatagggtcttgttcagttgtccaggctggagtgcagtggtgcagtctcagctcactgcagcctcaaactctcagggctcaggtgatcctcccacctcagcctcccaagcagttgggcccacaggagtgcaccaccatgcccagctaatgactgtattttttgtagacgtggggtttcgccatggtgcccaggctgtcatggcagccctaacagatgaatccagtggcatatgaaataactgctaagaaccatgtgatagctggatgggggtttgtctgtgcacatatgcacatacacacaagacatccacatgtgtgaaagagggtgttgcattccttaagagtagtatacttatttatgtattctgtgtaggatacttatttatatgagaaactctagcgcatgagaaaatgttgaacaagaatttaagaggattttctgtttaccctgagtttaactataaaattagagttcttccctaaatattattgttaatattatacatgttgttttttgctgtaaaatattcagagattatctaagtaattctgccactatctgtcatgatgtagtgactatgtgcatttctgttggacatttaatttctatttgataatttatttctgttcaatatgtatatttgtagaattatttctgagatatagatgttcattgctatccagaatattttatgtaataaactctatgttttctgtcataactatggttaggtactggtttagggataatcagccagttgccttgaccccaaagaacatcaagatttatttgccattgccactgtcatgtttctttaaagggaagagacggggaaaaaggaaagattggaaagagttgcgggaaggaaagcaaatgtcccttcagacatgtgattgtgccacataggaaggaacagaccctggtttgaatcccagccttactgtgtattgaccctgtgacctttgggagatgagttaatccttgcaccacattttccttggctgcaaagcacctcaatttgcaggttcctttgagggctgagattatatacataaagcatgtgggctagtctcctctggtgtatatatgcagaaagcattgtccccaatcttgaattgttagatattcatttaaggcaaacatttttgttttctttttccttactgaatgagagaagctggtaaggaaacggtgggatgtggccaggtgataggagcgcagacatagcagccattgatgcagacagagcttagagaaggcgtcatcaccacgcatcacactgagcaagtctgtgcggcccctgtgcccatgaggcttacagtgcagttggaaaagcagaccaaagggaataaacgtgaacaagataattgcaaaatatagtaagtactgtgaaacaaaccaatagattctgggagaaactaaaataagaaggagcaacttttagtggagacatccaggaggcgtctctgaagaggtgacagcaaataagttacgttttgggaagcagaggggagaagagggtattgggtaggtgaagaagcgcgacagcccatggtgtgtttgggtgatacaagtgagccaccattgtctgatggaaagggactggaaaagaaactggattgctgtaagaatgattttgaatgacattggggtttttctggtttgtttttgtttttgagatggagtttccctcagttgcgcaggctggagtgcagtggtgcggtcctagctcactgaagcctcaaattcctgggctgaagtgatcctcttgcctcagcctcctgagtagctgggactagaggcatgcgccaccacactcggcgaattttttatctttttgtagagataggttgtcactgtgttgccgaggcttgtcttcaactcctgccgtcaagcaatcctcctgccttcaagcaatcctcctgccttagcctctcaaagtgttgggattacaggcatgagccttacgcccagccaacataattttttttttttttttttgagatgaagtttcactctctgttgcccaggctggagtgcactggcatgatctcagctcacttcaacctccacctccagggatcaagcaattctcctgtcccagcctttcgagtagctgggattacatgtgtccgccaccatgcccggctaattattgtatttttagtagagacggggtttcaccatgttggccacgctggtcttgatctactaacctcaggtgatctgcccgcctcagcctcccaaagtgctgggaatacagatgtgagccaccatgccgggccaccactttttttgttgttactttattttacaatttttaaatacagttgtataaaatttgagccatgagtctgaccattctgagaaggcctacttttgtttctcctaagatgtgccatttaccgttttaaattgtcatcattggctaggggacctggctctccattagattagaggacaccatttgttcacatttgttgatgtcagactactaccaaacaaaaatttttgcccttgtgaccatctctttgactttccagatcaggataatcaaataaaatgataaatacaaataatgtataacatgtcacatatagtttatttactgcctaaggttgttattttgtgtttaaaatgattcttgctactgagtataaattctgtgtacccttttttgatgtcaatttttattatattaatgctaaggaatattagaatagtctggaatttgggaattgatagtagcaagctggaatttgggtatggaaaatgctgtgtaaaccagtagcaagaagtgccaatgcttggagtcaagccagggcccagatattcaagctctatttctttttcttttctttctttctttcttttttttttttttttaaataaattgagctttggaaacaccttcacatttgaaaatgactttgtgtttgttgattgttttctttcttgagtagagtatcatagtactttctttttttgttatttgttactgtgacagtatttcatatttttaacccaagacagttggctttccaaaaatactggaaacaaatgcatgatgtaatcatcctcacccgcgtccaaaattgtggtagatctccactttcactctgttatttatagtaatgcgttttttttgtgttaggactggtaagttgcctaagtagatccttgagaggcgggatagacattttttcccttgagtcatatagttaatttgctttcatttttcttgagtcctactgttaaatttttgaagtacaacagtttatgtccttggtctgtgcttgactgtggagtaatactagacaataaggcatcctttatttatattagctttggtatgttgtttttgcttttctcagatttctccagtcctaaagaaggttatgtacatttatctgtgtgtttacatacatggttatatggaaataattgctttcagatagttgtggttttcttttcattgtttcttctgaaatattcttgttaaacctgagaacaagtgaaaatgtttcatgaaaatgcattaaaatgcattgttaatatataacctaaaaactattggattggtttatttttagcatgaagaattttgaattcactggaatttaagttacagttgttgcagtttttatgtagacttggcagttatgtcacttatacttcttaattatctttgtacatattttatatgacataatatctgcacactcaccatctccagcctctgtagagaatgtaacacatagcaccaaagtaataaaaatataagccccagagcgggaagcaaagctgaaacaagccatttttacatataacttaagtttaggttctgtatagtaggttgatcccttacttaacctttaataaaattggattcaagggtatttatatgtaaataaaaaaataaagttaatttcgtttcatacttccctatgagcaagtgtctagtaatatattacaatgacatttaaacttcagtatttgtcctattggctgaaaaaattcccatacttttttagcaacagggtttgaggttagacattaaaaagggaaggttcttaagatgaatattaagattacgtgatcatatgcacagtgatgaaatcagtctgtatttgtttgacctcttgtctcctatgaaggtatctaagaagtcatttcctcctattacatattttagaaattaaaatttaataacgcttcataccctccaaacttctctgaaagggctctttagttgtacaggcatctagatcatggtcagactccttttctaagtaatgttatcaatagtgtatttgtatacgtggttatagatcaaaggttgaaatacgcttatcagtgcctcctgaagaggcagtcccctggagtcttcttatctcacctgatgagtgtggtcttttggtgctcatatcatgtatggaaggaggtggcagggatcaggagggcatatcccctttgcctctcattccctacccgacttcccagagaaagcagcattttcaaacttgcagaaatatgtgagggctctcagaactgcttaggatcagccatgtacattgtgaaaagtgagtcatggctttttctctgcaatagtgtagacgtttctactcttaaaaataaagatagattaaaatataacacctcaactccaagagctccaagcctcccacagaacatcgtagtcctgctacactcagttgaacatttatgccctggccctggcacccacctcccttagcctgcctgtgaaggcgtctctctgatgccctatctagacccgttcttccttttcctacatttgaactttttctgagatagtttcagtttccataatctctgtgtgatgattttcatcaagaattccgactaaggagattttattcttttaagaagatttgttcaacatatacttacatgagattttgttctttttaaagactgtgtaaataaattatctgattaagaaaaatttttctactttgttttgactcttgaatagggaaatgcttgcctatatttaaatgcaacctgctaaaaatacttgttctgacctattagtgaagtatatcacactatctaaagcaatctgtagatttaatgcactcgctatgaaaatctcgctgatgttttttgcagaaatagaaaatcccaccctaaagttcatatggaattgcaacagacctcaagtagtcaaaacaaccttgagaaagaacaaaactgaaggatttaacaattcctgatttcaaacttgctacagttccagtagtcaaaacagtgtggtactggcctaaaggcagatatattgaccaatggaatagaatagagaccccagaaataaatccttgcctaaatggtcaagtgattttttgacaagtgtgcccaaaccactcaatggggaaaagacagtcttgttaagaaatgatgaagtgaaaaactacataggcatatgcaaaagaatgaagttggacccttgcctaataacatatagaagaattaactcaaaatgaataaaaaacctaaatgtaagaactacaactataaaaattttaggggaaattgtaggataaaatcttcaagacgttggactttaagatgacttcttggctatgacaccaaaggcacagacaacaaaagaaaaaataggcaaattggacttcatgaaaatttaagaattttgtgcatcaaaagacaacatcaacacaatgaaaaggcaacccagagcaatatggccaatgagagttgcctagtgctcatccctcccccaaaaggggatctaaacaacaagtaaacaactatatttcaactagagtgacgaggaagtatgctggaccgcactaggggagcagcaaacttcctgtggtgcatggaaggccaggacagcaccatggacaggtgagcgaggcatcctgcctctgccacagtctcccccagtggagacttggcagtcatggggtgctgtttatggggaaatgtatgctggtgattcccagcagtccccattgccaccagaaatgctagcagtctttgatataggagtcccctaaacttcacaggcccccaatccagtttggagagtagccgggagctcacacagatgcaatgcctcagtgtccacattgaggacccgcaacctaagcagcttcaactctgtcccatcttgaacctttcccactgctagagtgcatcctgccctgcgcaccagtagcaattgactcttttcatcctggaggcctagctgtccttataccacattcacacaggtacctgcagcactatgaccatagctacccaaagcataggtcacatggaatgactgagaccccagtgttcaaacccaagtgacacaccacatccccccaccccccagggaacaggcagatctgtacggtgctgaagtcactgaacagtcagccaattacctctcctgcacgtacctgcaccatagccacctgtcccaccaagcgcggtgcatccatagctggtccaactgttggtcctgtggcagcctcgttcccgcatacagacacccaaagagcagctgaatgctgctattctatgtctagcctgacagctggtccagtagcagccctccctcccaaataactgcaaggctgcccaaccccatttcacactggcatccagcccaagagctgggccagtggtggacctgctcctctagacagactcctacagggccacctgacacagctgcacctatgtgcagctggcacagcatcagaccagtagactcttcatccatcctcttgaagagacagccacgtagctgctcagctagccacacccatatgcacctaagctcagcccaacagccagactagtggtggccccacctccctgaaaagcctgttggagagccttttcgccctccacacccatacatattcagcccaacagccagcccaacacccctactcccagcaaaaccacacactacgaccaccacaaatacctacagcataggccattgaggcaattgcagacattgctgatgaagattgcagctgaaaaaactacatgtagaccatgctactgagtccacccagaactaaagctaactcaccacactcaaatgacaccttgggacctatctacaggaagaattatctcctaatgaaagttacttcataaacctggaaagggtcactattccactagatgttcagatatcagcatagggacacaagcaatgtgaaaaagcaaggaaatgtgatacctgcaaaggaatacaataagtctttagtaaaagaccccaaagaaaaggacatttatgaaatgcctgaaaataagataatcttaaggaaactcatggagatacaagagaatacagcaaataattcagtgagatcaggaaaacaattcatcatccgaatgagaaatgcaacaaagataagtgtcataaagaaccaaacagaaatcttggagctgaggaattatgaatgaaataaaaagtgcaagtgaaagcttcaacaacagactagatcaggcagagtaatttctgaacttgaagacaggcctcttgaattatcccagtcagagggaaaaaaaaataagaattttaattgaagaaagcctgtgggactcatgcgataccattaaatgaacaaatgtgtgcattataggaacttcgtagggagaagagttggagaaagacacagaaaacctatgtaatgaaataatagatgaaaacttccctagtcttggcagaaatacggacataggaattcagcaagttcagaggtccccagttagattcagtcctctctgaggcacattataatcatactctcaaaagttaaagacagaattttaaaagccacaagaaaacagtgtcacatcacacacaagggaatgtccattagactactagtagatttctcagcagaaaccttgcaggttagaagagaatgggatgatatattcaaagtgctgaaagaaggggggcttgtggggaggaggaactgtcagccaagaatattatatccaacaaagttatccttcagaaatgaaggagaaataagaccttttcagacaagcaaaggctgagagaatttgtgaccagtaggttggccttataaggaatgcttaagggagtgctaccactggaaaagaaaggacaataattatcatgaaaacatgtgaaggtgtaaaactcactagtagaggtaaattcataaaatactctagtgatttaatggtcctatgtaaatctctcaatcctctagtatgaagacttagaagtcaaaaaggtcaaaaacaacaacaaccacacttagtggctacaaatatataataaataagtagattaaggcaacaaaaatattaattgtgtatggggttaagtctagaatattttcatgcaaccagatttaaattgctatcaggttgatgtagtctattgtaactacaagactcttatgttagccccatggtaaccacaaagaaagaaattacgacagaataataaacagtaaagagaaagaaaacaaaacttcgcagcacagaaaaccaccaaaccgcgaaggaaaataacatgagtaaaagaaaggggaaaaggatctacaaaacaagcagaaaacaacaatatggcaggaataaatttttattgatatgaccttgaatataaatggattaaagtctcaaatttaaaaacacagagtggtcgaacaggttttaaaaataagacccaactatctgctggctacaagaggctcacatcatcattaaagacaaacataaactgaaagtgaaggaatggaaaaacatattccatacaaacagaaaccaaaagtgagcaggagtagctataattgtatcagataagacagattttaagtcaaaaactggaaaaagaaaaaaggtcattatgtcatgattaaaggataaattcaataagagaatattgtaacaaatacatatgcactcaaccctgaaacatacagatgtacaaaacaaacatgattgcacataaaggtacagatcaactgcaatacaattataaaagggaagtttggcaaagaaatatcagactaaaactacatcaaagacctaatgcacctagcagatatttacagaacattttaacagctgcagaatacaaattcttctcaattacacatgaaacattctccaggatagagcacatgctaggccacaaaacaaatcttaacagatttgagatagagatcctatcaagtatcttttctaaccacagtggtatgaaactagaaaacaacaacatgagcaactttggatactttgaaatacgtggaaattaaacaacatggccctcaacaaccagtgggtcaattaaattaacagagaaatgaaaaattgctttgagacaaacaagaatgcaaacacatcttaccaaaacctgtgagacacagcgagagagcagttctaacagggaattttatagcaatacacagctacattagaaaagaagagagatttttaatgaacaacctaatgacgtaccacaaggaactagaaaaacaagaacaaactgaacccaaaattgatagaaggaaaggtagaataaggctcagagaagaaataaagacaaattaacattcaaaagatcaagaaaacgaagagttggtttttttgaaaagataagcaaaatcaacaaactttaagctagactaaaaaaaacaagactcaagtaaaatcagagatggaaaaggagatgttacaactgatactacagaaatacagaaaattatagagaatattatgagctgctatatgccaacaaatttgataatatggaagaaatagataagttcttggacatatacaaactactgagattcaattataaagaaattaaagatctgaacagactaataactagtgagacaattagttataaaaagtctttcctggatagagaaaatgtggcacatatacaccatgtggaatactgtgcagccataaaaaagaaagactttatgtcctttgcaggaacatggatgaagctggaaaccatcattttcagcaaactaacacaggaacagaaaatcaaacattgcatgttctcactgataagtgggagttgaacaatgagaacacatggacacacggaggggagcattacacactgggacctgtcggcgggtagggggtaagaggagggatagcattggagaaattcctaatgtagatgatgggttgatgggttcagcaaaccaccatgacacatgtatacctatgtaacaaacctgcactttctgcacatatatcccagaacttaaagtataataaaaaataaaaaaatttaaaaaaaatgtttcatcaaagaaaagcttaggacctgatggcttcactactgaattctacaaaacatttgaagaagaactaataacagttctcctcaaactattccagaaaattgataagtggggagtatttgtaaaattttatgaggccagcattaccctgatcctgaaaccagacaacgatacaacaacaacagcaaaactacaggtaagtatctgtaatgtgaacatagatgcagaaattcttaataagatattaacaaactgaatccagcagcacattaaaaagatcattcactgtgatcaagtattactcataccagtgttgcaagggtagtttaacgtatgcaagtcaataagtgtaatacatcacattaacaaaaagagacaaaaacaatatgatcatttcagtagatgcagaaaaagcatttgacatccttcaacattctttcataaaaactcaacaaattagttatggaaggtatgtaccttaacacagtaaatgtcatgtatgaaaaacccacagctgacatcatactgaatgaggaaaagctttcttttaatatatggaacaagacaaggatgccaacttctgctacttctgttcaacatagtactggaagtcctagcctaagccattagggaagagaaagatataaaaggcatccaaattggaaaagaggaagtcagattgtcctgtttgcagacatgatcttacatatagaaaaccgaatgggagaaaattttggcaaccttctcatctgacaaagggctaatatccagaatctacaatgaactcaaacaaatttacaagaaaaaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcgttaaaaagtcaggaaacaacaggtgctggagaggatgtggaaaaataggaacacttttatactgttggtgggactgtaaactagttcaactattgtggaagtcagtgtggggattcctcagggatctagaactagaaataccatttgacccagccatcccattgctgggtatatacccaaaggactataaatcatgctgctataaagacacatgcacacgtatgtttattgcggcactattcacaatagcaaagacttggaaccaaccgaaatgtccaacaatgatagactggattaagaaaatgtggcacatatacaccatggaatagtatgcagccataaaaaatgatgagttcatgtcctttgtaggtacatggatgaaattggaaatcatcattctcagtaaactatcgcaaggacaaaaaaccaaacacctcatgttctcactcatagatgggaattgaacaatgagaacacatggacacgggaaggggaacatcacactctggggcctgttgtggggtgggggaaggggggagggatagcattaggagatacatctaatgctaaatgacgagttaatgggtgtaacacaccagcatggcacatgtatacatatgtaacctgcacattgtgcacatgtaccctaaaacttaaagtataattaaaaaaaaaaaaccaaaggactctactaaagaactggtagaactaataaatgaattcagtagttatgggatacaaaatcagcatacaagaatcagtagtctttctatatattaaccattattaatattggttcattaactatctgaaaaagaaatcaagaaaacagctccatttacgatagcttaaaaaaaaaaagataatagaaacaaaaccaaattgaaagctctctatattgaaactctaaaactttaacaaaagaaattgaagaggacacaaataaatggcaagctactttgtcttcatggtttggaagaattaatatagttaagatggccatattacctaaaataatctacagatttgatgcaattcctatcaaaatactaatgacattctttacacagatagaaaaaaaaatcctaaaattcatatggaaccacaaaaggacccaaatagccaaagcaaccctgagcaaaaagaaaaacctgcaggtatcacaccaaccaagttcaaaatgtacagttgactcctaaagaacttagatttaaactgtgcaggctcacttttatgtagattttcttctgcttctgccacccctgaaacagcaagacaaatccctcaacaggaagcctactcaccaggaagacaatgaggatgaagacctttataatactccacatccacttaataaataataaatatatttactcttccttatgtttttcttaatgacattttctctagctttattgtaagaatatagtatataatgtatgtaacagacaaaatatgttaattgactatgttatccgtaaggtttctgatcaatagtaggctattaatagttttttgggggaagtcaaaagttgttcaagggtcactgctactacaaagttatgggaacctaaacatgttactggctttaaaaacagacgcataaaccagtggaacagaatagagagccgacaaataaatttacatacctatagccaactaatttttcataatggtggcaagaacacacattaaggaaaagacaaatctctttagtaaatggtgctgggaaaattggatatcaacatgcaaaagaatgagtctagacctctacctcttaccaaaaaaaagaaaaatcaaaacagattaaaatgtaaatgtaaaacccaaaactatgcaactactggaagaaaacagagaggaaacttttcacagcattgacctggagaagggttttttaaacaagacttcaaaagcagcaggcaacaaaagcaaaactagacaaacaagattacatcaaattataaagcttttgcacagcaaaggaagctattgacggagtgaagaggcacctaaagaatgagagtaaatatttacaaagtatgtatctggcaagaggttaatattcagaacataaaaggatcataacagcaaaaaaaaaaaaaacctgattaagaaaatgggcaaactaccttaatagacatgtgtccaaagcagacatacagatggccaacatgtatatgaaaaaatgctcaacatcagtaatcatcaagaaagtgcaaatcagaaccacgataaaataccacctcactccagttagcatggctattgttaaaaagagaaaataagggttggcaaggatgtggagaaagggaaacacattgttggtgggattgtaaattaaccattatggaaaagagtatggagatccttcaaaaaattaaaaataggactaccatacaatccagccattccattactaggtatatatccaaaagaaattactatgttgaagagaaaacttcaactcccatgtttattgcagcactgtttacaataactaagatacgtaatcaacctaagtgcccattaatgcaagaatgaatacagaaaatgtatatatacataatggaatattattcagccatgaaagtatgaaatcttctcatttgccacaattggatgaacctgaaagaagtcatgttttgtgaaataatccagacacagaaagacacataacacatgatcccactcatatgagatctttttttcttaacaacaacaaaaacagagttggtatccttgaaacaggaagtagaatagtggttaccagagactgggaggggcgggaagagatggaagggtgcagagatgttggccagtgggtacatagttacatttagacagtaggaataaattttgatgttctgttacacagtagactgactgtaattaacagtgaaatattgtatattaggaaacagctagaagagaggctttcaaatgttcccaccacaaagaaatacgtgcatgaggtgatgaatactagccacccagattggataattatatagcatagataggtatcaaaacatcaaattgtacccccataagtatgtataattccactgtgtcaattaaaattttttctaaaattttctaaaattattttttctaaaaagaccacccacggaatgagagaaaatatttgtaaattgtatatctgataaaggattaaaatttagagtatatagagaactaaaactcaacagcagcaacaataaaaaacacaacccagttgaaaaatggcaagggacttgaataactttttcccaaggaaggtacataaatggccaataagcacatgaaaaaatgttcaacatctctagtcattacggaagtgcaagtgaaaactacaatgctatataatttcatatccattagggtggttactataaaaaatttacaagtattaaaaagatgaggttgggaacccttgagcactgttggtggaaatggaaaattgtatgacagtttctcgaaaaattaaaactaccatacgacccagcagtttcacttctgagtatattcccgaaataattgaaaatggtctcaaaaagatatgtgtacagccatatttatagcagcattgttcacagtagctaaaatgtgaatgcagcacacgtgtacatcaacagatgaatggataagcaaaatatggtgtttacatttggcccttcgtatccacagagtctgcattcatggattcaaccaaccacagatcaaaaacatttgggctgggtgtggtggtgtgtgcctataatcccagctactcaggagactgaggtaggaggattgcttgagccaagaagtccaccaccagcctgtgcaacagagacagcatctctcaaaaaaggatcagccaataaataaatacaatgtgtgggggctggatgcagtggctcactcctgtaatcccagcactttgggaggccgaggtgggctgatcatttgaggtcaggagttcaagaccagcttggccaacatggtgaaaccccatctctactaaaaaatacaaaaattagctgagtgtggtggcactcgcctgtagtctcagctacttaggaggctgaggcaggaaaatcgtttgaactgggaagcagatgttgcagtgagctgagatcacgcctctgcactccagcctgtgtgacagagcgagactctgtctcaaaaaaataaataaaatgcatggggaaaaaaaacaaaaatagcagaacaacaattttaaagatacatattttaaaatatagtataaaatcatttatgtcacatttacattgtattataaataatgtagagattatttaaaacatacagaggatgtgtataggttatatgaaaatttacactattttatatgagagacttgagcatccgtggatttttgacatccacaggggtcctggaacctgtcccccatggatactgagagatgactgtatatacagtggaatattagcctttaaaagcaagttaattttgacatatgctacaacatggatgaaccttgaggaaattatatgaagtgaaataagccagtccaaaagaaaaaatgctgtgttattccatgtatatgagatacttagaacagtcaaaatcacagagataagcggaatggtggttgccaagagataagggaaaggagaaatggggagttattgttgcatggttttagaattaaggttttacaagatgaaaaaaagtcatggaggcagatggtacagtggtgtttgcacaaaattacaaatgtattaatatcaccaaaccatacccttaaaaatcatgaaaatgataaattttatcctatgtgtattttaatgcaaataaaaagtgggggaaaaattaaccagtcaactaacaaaagcagagtattttatttttttaaaaataaccaatttaaagtagaaccaaaaaaactaatcaaaaagaaaagaaagtgtattcacctaatgcattaccccactagggtgttttaatttaaaaataaaatttctgcaggtaatagggctttcagcccaaagggaatgattctgatgacagaattctgggccctgtgagggaggtgagtgacttgtttttgtgtataactccccagtgctcctaaatcatctcacattattgattataccaacaatattcaataccttttgaaaggagggagaaaatctgttaagtgtcatgtactggaaagaccaaggcctctgaaagagccagataaattggtttttaaatacctgcctggctgcctactagtcacatgaccttgagtatgaatcctaaacccccaaaatggtagttgctgcttcttaattttaagatgagatcataataatgccttccatgcaagattattgtgacaccctggaataatgtatgcaaagctcctgaaatgacacctggtacatggtacatgtataacaaataaaaaccaatattattatgataatgatgattctccagttggtaggtttttatcctttgtagaacttgtgatagtatctaaaaattcagatttctttttcagtactcaaaatagatttaattttttcttttatttaaaattttaaagttctaatgttaaaaattttatccttgtgaaagaaaagggattttcttttagagtgtggtccttcgaccagaaacaccatcatccactaagaacttgttagaaatgcaaacactagggcttcacccaagacctatgaaactaaaaactctgaaagttgtagtcactctgtaaaaaatattctgatgcacactcaagtttgagaacgcctgcttcaataaatctgggaaacagaaaagggtagcatttatgatctgtcatccaaaaataaccactttaaattctgagatttttttccagtcttttctctgttcatatgcatatacacttatatgtgtatttcttctagtctttttcctatacacctgtgtatatatttatggtgttttaaaaagttaagatcatgctgtataagttttacagccttcattttgaccttcaatattatgtcatgaccattgccccatgtcattaaattttatttgaaaacatttttaatcatatggctacatattataccatgctctgagtgtctcataattatgaaccaaccccctagacatctgagttgtttctagttgttcagaaggacataagcaacactcagttgaaaatctgtattcataaatcattgttaatatgagtgattatttcctccgcataaatttattactagggtggaattaccaggtcaaacagtatgaacatttttacaactcttaatagaaatcgccagattgcttttcagagaagaggtgccagtttggattctaaccagcaatgtagggaaaatgtttgtccattcctctaacacaaccaacgctgctgtattagtctgttctcgcactgctataaagaaatgccttagactgggtaatttataaagaacagaggtttaattggctcagagttctgcatggcgtataggaagcatgatgctggcatctgctcggcttctggggaggcctcaggaaacttaaaatcatggcagaaggcaaagggggagtgagatgactcacatggtgggagcaggagcaagaaaggaagtagggaggtgccccacacttttaaacaactagattttgtgattactcgctgtcactagaacagcaccagagggatgttgctaaatcattcatgaaggattactcttatgatcctgccacctcacaccaggcctccctccgacattgaggtttgcagttcgatctgtgacttgggcagggttgcagatccaaacgatatcattctgcccctggcccctccaaatcttgtattcttcttacattgcaaaatataatcatgccttcccaactgtcccccaaagtcttaactcattccagcattaactcaaaagtccaaagtctcacctcagacaaggctggtcccttccacctgtgaacctataaaataaaaaataagtttgttactttcaagatagagtggaggtataggcattgggtaaatactcctgttccagtagggagaaattggccaaaagaaaggggctacagctcccatggaagttcaaaacccagcacggcagtcattaaatcttaagacatcaaaattatctcccttgactccgtgttccacatttagggcactctaattcaagagatggccttccaaagccctggatggctccctgtggccttgcagtgtttagctcctgtgactgctctattgggctggcgttgagtgcctgcagcttttcccggtgcagggttcagcctgtcagtggatctaccattctctggtctagaggttggtggtcctccactgatagccccagtaaggcggttcctcagtggagactgtgtgtctgggctccaaccccatatttctccttcacactgccctagtagaggttctccatgagggctctgcccctgcagcaggcttctgcctggacatccaggcttttccctacattctctgaaatctaggcagaggcttcccgtcttcaattctttcactctgggatttgcccaagtcagtgaatagttcttgagatcaggagccagatccaccagagttttgtccattatgtcctaacattacctgagcaataaaaaggaaatctggcaaggaaaaacaagattgcctcccacatttagaagaatgattgagaaatcctaaatgaatgccaggtttaaaacataaattatttacttaacagccatttcaacttgcaacataaggcaaccttggaggtgactgttgaggatggcactgttctgttgctggttaattatatttataagcaactgagagcttcttctatcccttcttaacctggaccacagatatcaaatggccaagaagagcatcagatggaagcaatgtaaaatgctatttttcttcattggcataaggacttctgggcctcttcacaccagcacacacttaaatcaggtgctgcttgtgttggaactatttggtagggtggtggttttctctttttaaatctttttgtgtgtgtgtgtgtgtgtaagttgtactatcttccccgactagatccgaagagtagccgtttattttagtatgtatcttaaagcagcaatgcaatgcatgcattaaatgtacagaatgcctcttttaaaaatgtgttgctggaaaggccaagcagacagttgccggaatgacagtgtggccttgcattccccacagaataaatttgagagctgtcatgagacatcccagcttacattgcgttgatgatgtacagaaagaaaagcaacttcagacctagattctcattccacttaggtttttagaccgtcatctattacgcagacagaagagaatgggccacaagcgtgatgttcactgcaataggctatacttaaattaaaggatactgttttgtaccaattagtgtgcaccatgtgcttttaatttgtttttgaccattccctttcaatgtactttaatcttttttaattatgagaataatccatactgttaacatggaattctccaaatcggtaattaatgtttatcctttgctctgccagttcaacctcctgccctaccttaatttgagaaaaccaacattaatatttcccttatttgagaaaatcaaccttaaaaacttaatattatccttttcttcttttacacataaacatttagtcatatacatatatggatttctactgtattttttcaaaaattggttgatagcaagcttggtagatcctcattgttttaattatagttacagacctccctccaggtcagtgcatacaaataactctgttttaataactgaatagcatttcacagtatggctatagcacattattctgcttatcacctggtaatgaaatttccggttgtttacaatgtttagttactgccgacactgtctattacaatatgagcattttataggccttctgatcattttccactcagtaaagtgtgttcctaaagaagtgaaaaagtaggaactttccagagtcggccacttgtctgtaatcatgcactgctataattagtagcctagcacatgataatgagaattatggagacttatgtgtagaatctttgtctatgtgggagagtccctaaatgtagcttttattttgtatcggagtcatttgtggttagcttccatgtgaggattcgccgcagagaagaggtgatctttcagctgttattatgtcccatctcgatcctttctgagcaaatcaattgcttggttttggagaaatctagtatagtaatgatgggctatacccaatcagccacttttttttagttttaccttgttagaccacaatcttagatatttatgagtgaatgagagagcgtggcttttggagtgcattaattttaaaaagctctctgtggtactattttgaaattaggaagggagggaatgctactttgatgacgtgaaaaatttgcccagatcgcctcgattgcttactatgtgataaatggtgccgctagccacatgtttcaggattttgaatactcaggaagaattcttagagtgtgattatggaaacaaccaatttccataagtgaaaatgagcatgcttattaatggggctgcaattgtctattgcattcagtcacatttataaccagcaaggagaatgagtgttttgcatgatttaatgtttacacaattgcagttgcatggcaaagcttgctgtactagaggctttggaaagaagcatatgtggtcgttttgcaggtaataaaatggaaaatccaatttgcaattgcagaataagcctctgagtgatatacgatcttcatagcagcatcggtcagagggtcactgctaatcacggcgctgcctggcttccccagtggcctgcgccttccaactgaggagtgagcaaagtgaatctgtgtctgggagccagccagcgtgtctgtagatgcaccactttctagcttattagatcctctttgtcacagtgcttaatcctgctgcctgatccttgttagaacaccaccagagcgccgctcagccttctaataaaggggatgggtgagggctcctaactcaacgcactgaagcgtgtggcgtcagagcgattgcaggctgactgacagcggggtgagatgcttcctgcatgttattacttaaaagggaacctacctccgacagctgacagacgagctctgccgaggcaatggtaacttgttgctaggccaatatgagtcgggtgtcatcttttcacacaatataatggccagctttactctaattatattaaccctcttctgaaattgcttcatccccaactggtgcagagtgaggcaagagaacccagagacaaatcgcttgctgggagggttgcagcgctacagaaacaggtattgtgttatccaccggtgacattaagttgaaaaacaaaacaagcatgccctattacagcaagtcccagttctaactccaaagagacattgctctgtttcgctcgcgcggtttccatttctgtcatttataatagtttcctcctttaaggtttgccacggacattatacctgggtttcatggctctttgttaaaaagaaagaccaacatcatacaagaagcttttttcttttcttttttttccccagggaaccctaatcattcttttctattaggctcttaagttcatgtagctttaggaagcacttggggatttaatttagtagcattgcttgatactgaagtaagtaaatgagggtggggagggtaacccagtcatctgtaccctccttgccactccccatcccagctaaaatatgcagatgggttggaagtgatataagtgaagatgatcgtgaatagcctgtggtcctttctgttaactctgacttgtagacatcagcgtgtgactccttttcccttaagggagtatgtctagcttgcatccagcgtctcctgtgtgctccagttagcagccatcattagcaatctgtgatgcctctgccgtctccactgacagcacctaaatagagacatcacttgggattgacagatctccagggggttacaggcttcagacaaaagggcccagagaacatggctgacctttcttggcattattctccttccatgagtggcagtcagggagcatagaactttagtacattattttcagaggattaccactgaaaagactgcacacttagtaagatgctgttaataagttaacaagaggctgtgtgcgttccagagtggttttgcaggccgtcagtagtagaacacgagtgcttctttcccgcagaaatacgtccctattccttaagttcaaggaggggtctttaaaaccagctttactcataacataccttcagtttcggatgatcgagcaaggcttgggactcggcggaagggagcttgtgatgcaggctagaaaagaggagtctcttcccctcattatcccaagcaagtcttcccagggaaaatttgaaatagctgagacttgtgtgtgtcatccttcccggatcctttccctgctccacgttgttctcatgcttgccaagggccctgaaaatacagtgtggtgagaaatgctgctctgtgcccaaatgtagctgacttccctcctcttctccctcttcccaaagtaaaaaaaaaaaaaaaaaaaaaaaaaaaaaaaaggtgtgttcctgcaatcacccctctgaaccagatgttaaaagcaaagcagttgtgtaaatgattgaaaatcctggacgcttcttcaacagagtaaaattctaccaactagaagttccgactatatttctcattaggataaccaattttgcagaagaaggaaagatatttaggggaaaatactcactaactagaaaatccccttagcttaggaattcatttctgtgctattccataaatatgtagtttatacttttcatggcttctgctgcttttttttcatctactttgcaatacacatattttttctttttctttttttttttttaagacagtcttgctctgttacccaggctggagtgcagtggtgccatttcggctcactgcaacctccgcctcccaggttcatgcagttctcctgcctcagcctcccaagaggctgggactacaggtgcgcaccactgtgcctggctaatttttgtatttttagcagagactgggttttgccatgttggccaaattgccttgtggtctggaactcctgacctcaagtgatccacccgccttggcctcccaaagtgctggcattataggcatcagccaccactcctggccaagaatacacatattttttccaaacacctcaagtttatttttttcatagttgattcatgctgatgtctgtgggcagagattagaggcatgaagatgacaagatgtaagcataggttgtttctcaggtgaatgttttaagagagatatattgagctgcagcactaccattcccagctgatgagggcattgctgcaccgtggtcactgttgtccagtttgtaaccccttcccttactagtcctgcctcctgtgcacaatgggcaacataccatcgtgcacataaaatacgacacatcagaaatagacttgtttttaaagggatggcttctttccaggaatgtatattatattcatttttaggaaaaggaaaaattagagaaaaaaaccatgaaggaattatatggaagacaagataaattgagtgcagcaaactagattttaagaggaaataagaattatagagaaatgtaaacaaggggtcagtttcattcttgggactctaaaaaccccctccctaagtaaagataaaaacaaagatcaatggcagccccttgccaacaagatgaaacccaggtgagatactcagctaagcagaatgcataccacccctgggttttcattcgccctaggcagctttctgactcatggtttagagaatcaagctcactaatttcccaagtgacttaatatctgactaacgatgtttaaccattaagatgaggaaattgacaatattgataatcttggagagaaatggatctgcttatttttgtaccaagcgccaacaaattcttagtagctttggaaacatgatgaattactctctcttgatatttagtagtgtgtattttcttaaaaagattttgtgaaattgtagtcgtttttcttttgtttttctgaatagttgcaagttcatagaacaaaaaggaaagattcaaagtatctattattttgttttaacaagcaatattgcattatcttcctcataaaaaaattcatttatcctttcatttccaaagctcagatcagctaggcaatgatttgctttgtacttgcgtcccaggatatgttttcattgtcctgagttaccatctatgaaaacataggcagtagaacctgggaacagcaacagcacgtaacttcggttgtgtcttagcaaaaatctttgctgtgtctctaggttcaaacagtaccaggccatggatgagaagtgtgaaaattgatttcctcagtaggacttttagggacagaccttcacatatatccctgctgcctaacttctctttctctgcttcttgctttcataggcgagcgcattttaggaagttctttcacactttgccttttccatttttgaatatatcaaaaagaaaaaaaaacagtcaactggtcattaacagaggatatccagatgaggggtgcttgctggcttttttatgctaccttcattaaatcaaccttatctaaattgatatgtaacctgatggcctcaccagacactgtagaaggtgtatgagattgagcatcagcttgaaatcttcatgctggctttttctgatcttgggcatattagttaatttccttaagtttccatttcttcacctataaagtaatattagtatctgaccttccagattgctggagaatgaaatgaggaatgattttaaaaggtaattagtctttatcactgccatgttaatgagattcatttagggctgattccgagatgtgcttatgctcttatacttgagtaacaacggtttggcttgggtaatattcctgtctttctccattcatacgctgtcttgattggtgaaaaaagtggtgttgatcagattgggcccagatcagccaggacaaggcatgatgcatactgacatggtcaagatagaattttaaatggttttcatattatcacttctcttaattttgaacaagtcatttttgtctctgcagcaaatacctccttccctctgctctgctttccttttccatctgtcttctttcttccttcctttgttcttaatttctggggccaaggtactgtcatgactgtgtacctgtgatgacttgggttaagaaatttaaaagacatcaaatgatccaagaggcacttagggtttgatttagggtacttaggctgtgattactgagaaggacttcttagacctgatctgtattggatgaagtgaccttcactttttttttccccccccccaggaaacttggatttaactggccagaagcaggtattcaaagcagagaacaatccctgggtgacccccattgcagaccagttccagcttggcgtgtcccatgtttttgagtatatccgttctgagacatacaaatagtaagtagactctgattttctgaaatagtagactgtgattttatagtatttataattacgcctttaaaaatattatgtgacagtatcctattgatggcagttagcacttagcattttaagatgttttattaaaaactgcatgtcggccaggtgtggtgtggctcacagctgtaatcctagcatttggggaagtcgagactagaggattgcttgagcccaggagtttgagaccagcctgggcaacatagcaagaccccgtctctacaaaagaaaaagaaaaagaaattatccaggcatggtagtgcatgcttgtcattgtagctattctggaggctgagttgggaggatcacttgagcccaggacattgaggctgcacagagtcgtggtcatgccctgcactcgagcctggatgagagagcacgaccctttctcaaaagaaaaaaacaagaaaaaacagcatgtggtcattgtctctatttgtaaattgttttttattgatattttcaaggggatttttactgattttctttagagaatttttgaggtattaaattagttgaatattcatggcactaaggaaattcaccattcagatcagaacatattttttttcttctgtgaatgcaaagaattacaagtgttctgaacaaaattgttaagcagtttatttataaaatcagtagagagtactagcaatgcgtcattctattatagagaagcttgtactgtagtgagatgataatctcttagagaaaaggggaaggcaggagaggaagcggaatctgccagcttaaagtcacagcatccaaatacctcaagtcctcactccaggtgaaaggagtctatgcaaaactgtcccaaaaacctcacgattcctgcttctttcttcctccatgtgtcaaggttgaaaggaattctgccacttccacgtgcttctgttgttatatgtaccgtcattattttcctaccttatcccagcccccagctgcaaaacaaactgtcatttatcaaatacttgcctgaccccaaatgctgagatctagtataattttaagcatatacaaaaaagacaaaaacatccctactcaaatgtaatctgtttttgtgtctgacatcaacttttaaaatttattttttaattaattaattaattttttttaagagacagggtctcactgtattgctgggctggagtgcagtggcacaatcacggctcactgcagcctcaagcgcctgggctgaggcaatccttccatttcagccttccaagtagctgggactacaggagcacaccaccatgcccagctaatttttttaattttttgcagagacggggtctccctttgttgcccaggctggtctcaaactcctggtgtcaagcaatcctgctttcatcttccaaagtgctgggattacagtcatgagccaccatgcccagcctggcaccaacttttgagaatctaacatcccaactattggaagaaagctagaagattgctaaaggtcacatttagttaagagtttcttttcttttttttttttttggtatcagaaatatgtcccacactcaagaaaaccctgtgaatctgtgccaggccagtgggtcgggattgattggcagggcagagcctctgcccagaagtggctggctgcatttctgcagtcttgcagcctgagcgccatgctcctggtcaaacatttagcacttgctgtggccatgtttccaccagacagaaacagagaagacaagctgtaaagaataatggccagccggagcatggtggctcacgcctgcaaccccaacactttgggaaggcaaggcgggtggatcacttgaggtcaggagtttgagatcagcctggccaacatggtgaaactaaaaacacaaaaattagctgggcatggtggaggggcacctgtaatcctagctattcaggaggctgaggcacaagaatcgcttgagccagggaggcagaggttgcagtgagctgagatcgtgccactgcactccagcctgggcgacagagcaatattccatcccaaaaaaaagaaaaaagaacaatggccttaaaatgaaatacactaaaattgccaaaatgataccgtatcctcctatataaaagcaatgtaaagcgtggtttagattactttagacaatactatgacacttacagtataagtctaaagacttaccttaaggataaaatgagataggtataggatgtgtattaattgtttcataagccatatagatatgtacagttattacagattcaattttttttaaaaaaatacgaatgtagctcacccttagaaattagttaattatgaaaatgtgtgaaaatatagtcacaaattagcagatgattgtttatcttcttctttgtaaattgttaatcattgctatcgtgagttttagatggggctctaattttttcttagtaaacaggaagctatttagagcttggtttgtatggtatcttgaaaaaagtcattctgtatatgatagtatacagaaaaatgcatgaacaaactcctagccatctggaattagaggaaattctctgtttattattctggttaacaatttttagttttccatagatcactttataatttatagaggatgagaatacattgcatatgaaagtgcttttaattttaaaagattaaattgtgagtttctggattttgtattacctcaaagtaattattaggcaattaatcaccattctgcactgttacagactattttaactgatttgaatgtggttaggattctggataaatgagaggtatctataacataattggtatatctgtttttatgtctgttattagcatcctattttggggggttggcgtagtctaagcaatgtgtctgctaactttttctgtttcatttcctcatggagccttggattaccttttatgcagttaagtcaacattaaaaagtttcagtaggctgggtgcggtggctcacgcctatgatcccagcactttggggtgaattgtggggtgattcaccatgaggagggtgaatcacttgaggccaggagttcaagaccagcctttccaacatggtgaaaccccatttctactcaaaatacaaaaattagccgagtgtggtggtgggtgcctgtaatcccagctacttgggaggctgaggcaggagaatcgcttgaacctgagaggtggaggttgcagtgagttgagatagatggcgccactgcactccagcctgggtgacatagtgaaactgtgtttcaaacaaaaaaaaaaaaaaaaaaaaaaaaaagaagcagcagcttcagtaagcaccggagagccattgcctcctttccacggggaccagctggttccataacagctgcttttaggggcatctacatgatgctctgctgggaggtcacaaggtacatgagctatgctagggcaggggcctgctgtgagttctcttctgtcctccttgggaaggagaagaaggttggttactttgtgtatttcagtttttttgtccttctgtcattctcctgtagcagctgtcgtcacccctttgtcaaacatactagcccaaaatatggactgttagctgataagacaataagtcaaactcttaatcattaaaaaaaaaaaaaaaactgcacaaaaatgccgctattgtgtttcaccagattaacacaaactgattttcaaaattaagggcctcctttatatgaatagatctgtattatattaagtatatcctcatacaattagaacccaactcaactctttgtgtgaagcagccatttcataattaggggatttttagtatcctatctgaaaaatattatgcgaattagcaggtatttggctactttttaaaaacgttttacatgtggcagccttcaggggaggcagtttattcatgatactcatagtttttttaaaaaagcaaatttcacattcattgccttagtttttgatcttctagtctaaaacttattatagttcctaattttcacttctttgtctctgttgtttaagccgcatacttcccctttattaaaaagaatccttacttatatatttatcagtgtctgtgtgttgcggatgtgtatttgtctatctttaaactaccatgaaaacatacttttggttttggcacttaaaacgcctatgaacctcctcctccttcccccaccccaaccgcttttttctaaccagttaacccattacctaaatgagaggaataaagaactaaaaaacttaccggaatgttttcttttcattcatgtctatgatcggcgttcacagtgaccttcctcagagcacgtcctcaagttcttctgagtctagggcagagaggatggatgatctgatttataggctctaatggactccaagaggagacatggatacttgaaagaaaacaatgaattcagtgtgtcaacagaattaaaatacttggagatgacttagcttcatgaagatgggaacttgttccattaagcaggaggggtgtggctggtaggatggtgaggtatagttcttcagagattgctctttggagtaacattctgggcattaatcacggccccttcatcatgtctcaggtggaagctgctgtctcttcatctttcgtgccttccacaggggaacttgttggctgatgtcactgagttgccggttaacatgaaattatgagcttggttgggtcgttgaagcttacatcctacatgctccactgtgtttttaaactgtcgctgagttatacaattacctgttaactctttatttgatggtggttgtctcttcgacctcttttatttctttgaagcagaattatgatggaatactcatcacttaagtttccagaaggtagatttttttcccccaggagaggcagtcaagttgaagtcagcacccttgacaagattctttgtgaaagggggtaactcacactttgcacatttccatcaaggaacgtggataccaactgcaagccattttaaaagctgacaagttaactcttgtcaacaagttaacaaaagaggtttgacaaatgttaggctggaaatgcttcccttgaaagaggtatttggcaaacaggcgtcatcatgaaaactgcaatttgccaagcatggcagtcctaaagcctcatttccagcatggcatcactcacaggatgcttcctcgtcattctgcctgtctttttcacctttcttttctctctccggaaaagttccccactcatttgtgttttgtgtgttccgtttttttaaccttaaatgaaagaccagccatactattattcatattagttaacaaaaacattttaacaaagcagtctttggtgaatggtgggaaaccatgagataaaagctgagaattcctctttattagaaatctagccaaataaatcatcctgtttgatttataaggaaacattcttttggctgttggttattgtttttcacattgttttacttgtggaattaaagctaattaatgttttatttttcttctgcatgctgtgcaaacctgttacaagctgtaatggacgtacatgggctttattaaacaactactatatcctctagtgactgctgagtcagtggcctagaaattctttaaataacttcactgatacaaccagtccaccacaaggctagggcatttcaaacctaataggtgagcccattcattttaaaacagcccttcactgtaggaaattatctctaagaaaaacttaataaacatctgatgaagtataaatgggtgcacagagctagcaggtgattttataaatatcttcacaaagatggaggagagggttaaatttccaggatctttctagtggttagtaaattgaacatagtgacaatcagtatgtagaacaatgtagactcttctttttcattgctgtatctgaaaatagctcaaattaagccacagaaaaacaatttctgtgtagtagacatgaaaatgaagaactgtttttctttaaagctttttttttttttccttagggacacagtatcactttgtcacccaggctgcagtgcaggggcaccatgatagctcactgcagccttgatctccagggctcaagcaatccccctgcctcagcttccctagtacctgggactacaggcacacaccacaacgcctggctagttttctattttatttttttgtggagactgggggtcttgctatgttgcccaagctactctcaaacccctggcctcaagagattttcctgcctcagcctttcaaagcgctgagattacaggcacgcaccacggcacctggcttttaacataaaggtagtttttacattttacaagttgactatgtattctcttcctggtgatatatattttcttcataaatggtacatatttgtattattttttctttttttgagacggagtctcgctctgtcgccgaagctggactgcagtggcgtgatctgggctcactgcaagctccgccttccgggttcacgccattctcctgcctcagcctcccgagtggctgggactgcaggcgctcgctaccacatctggctgattttttgtattttttttagtagagacagggtttcgccttgttggccaggatggtcttgatctcctgacctcgtgacccgtccgcctcggcctcccaaagtgctgggattacaggcctgagccaccactactggcctatattttcttttttaaagttgaaaatgcattatcacattttatccataatatgtgattcaaagttttggcatctgtggacctatttgcaagaaaatatgttgcatttaaccagtattgctaaaaagtatcagagaaaagggaaacccatataatatatttggggtatattgtgtcacatctcttatttcatgttaacttcaatgataaaattaggtagcatcacattttaaaacacaaaaaactccagaatgtttattctactgaataaaagtaagccaatatgtaatactaacttttgaaggctgggtgcagtggctcatgcctgtaattccagtactttgggaaggcgaggcaggaggatcacttgagcccagggagttcaagaccagcctgggcaacatagtgagacttcgtctgtacagaaaatgaaaaaaaattagccgggcatggtggcacatgcctgtagtctcagctacttgggtggctgaggtgggaggatgccttgagcccagaaggtcaaggttgcaatgagccaagatcacaccactgaactccagcttcagtgatagagtgagaccctatctcaaaataataataataataataatttgattttttgtttaattgctcaactgttcctgtatgtgatcatgaggtatcagttaccctgctaaattgatacctccctctttaatatgacaggaggaatacagaggatgtaaggaagaatacgtaagttcttactctcttccaaatgttgtgatagattgcttagtgtattttgcatttaaaggatttttttttctgccttgtaacttggttaacactattattcatatatacttcacaggtaactagtatttttcccttttttgcattttcataatttattcaatatatgatgttttcacaggcttttgaggctttacttttctgtaattttatagctcatgcaaaatggttcagttttttaaatggaaggtgcttgttcccatttgatatttccaggacacttggattctgtgagttaagttgggaacttccatcccctaatcctatgaaggtcaaaggtgaaactctactagggcttaaaaaccagcttcaggagactagctgtattcctgaagacatctagtaagactccattgtatacgtgtcctactctggagtgtttttcactgtgatatgcaatagatgcaaataaagacttggaaaatgtaccctcccatatccacgttgctttcttcactacttccctctggtcctctaatgtggttaatcctccagcactctgtgcttgcctgggagctctgactgggacctggtaggctcaggtttgaccagtgagaaaaaaccctatgctccttgccttttttactcaatgcaatttgcattttattcaatgactagtgtacttatctttgaagagttgtggataactattagaggggcataggggaaaaaaactacagctgcaacatcaaagggagaagagagatttatcctgaaccttgcactacaaaaggcttttccgtaggactttaaagagtaaaactatctcagtctctctctgtgtgtgtctctctcctcctattccagtcccctctttcccctgttcccttctccatccccctcacttgattgttgactatcaagcctgcatttggcatgccttatacagctcctaaagtggagcatgatacattacagtatcaatttaaggtaaatagaatatagataatttgtctcacttgacagaaggaaaataaatatcagctagactccatccatactccaaaaaacccataatgtgtcaggttacattctcttcaagaggagctattctgagctccttttttttggatgctattcatttgatataatcatattgaactattggatattgacctcactgaagtgaaattggtcacctctacatattgattattaactcccaggagtcttaaaagttcaatgcttgatgctttctattcagctgagatgaattattgcctgcatttgctgtttttatttgagagataaatttaaaagtggcgcttttataatcaaacaaaactgtttgtggtttctaatctctacacagtaataacttgttttattacatgctggttttttattgaactctggtttcttatcctggccaggcattgttggaggttttgtggggttttttaaatttttaattttgggcatttaaggattcttctgtgttgtcagttattttagattaaaatgcaaaatgctatgaaaggagtttcaatcaactttatcagataaaaaacttaaatgtgagttatgttcacaggcatttatccatgcctcaatgtattcatcaagcattaaggaaataactttccatattttgttctactgtgtttgcatattatttgtttataagactcttgatattttttaaaatgtagtcaagaataaaatattattttccactttaatagttctctctgggacgcatgaaccagagcgactccatcttcaatggtaactgagtaaaatgaggctgagacctgctgggctgcattcccagatggttaaagcattctaagtcacagggtgagataggaagtcagcacaaaatacgggtcataaagaccttgctgataaaacaggttgcagtaaagaagctggccaaatccaacaaaaccaagatggcgatgagagtaacctctggtcgtcctcactgctaccctcccatcagcgccatgacagcttagaaatgccatggcaatgtcaggaagttaccctatatggtctagaaaggagaggaatgaataatccaccgcttgtttagcatatcatcaagaaataaccataaaaatgggcaaacagcagcccttggggctgttctgtctgtggagtagccattgttttattcctttactttcctaataaacttcctttaactttactctgtggactcgccctgaattctttcttgtgtgagatccaagaattctctcttagggtctggatcgcgacccctttcctgtaacagttcatttttaaataatcttatttggtgttgtttggttttgagacggagtcccgctctgttgcccaggctggagtgcggtggtgcgatctcggctcactgcaacctttgcctcccaggttcaagcgattctcttgcctcggtctcccgagtacctggggttacaggcacacactaccatgcccagctaatttttttgtgtttttagtagagatggggttttgccatgttggccagactggtcccaaacccgtgacctcaggtgatccgctcacctcagcctcccaaagtcctgggattacaagcatgagccaccatacccggcctaaataatctcatttggaacatatacaatactgtcattgtcaaaatgcacatactttatattctctatccaattaggtagtgtctatttggaaattaaattattgaagttttggggtttttttgtgacaggttaatgaataagtacagtggcttttgggtgtttctttttcttttcctggtgacagctgattttgtctttactatttgtattcgtttgctttggctgccataaccaagtaccacaaacggcatggtttaaaagcagaaattcattgtctcatgttctagaggccggaagtcccagatcaaggtgtcagcaggattggttttttctgagggcagttagggaagggtttgtctaaggcctctctccttggctcttttacccctgtgctgcttcacatcatcatctctctaggtatctctgtctctgtgtccaaagctccccatttcacaaggatatcagttatccggggtgagggcccaccctaatgactgcattttaacttgattatctctttaaaaacgctgtctccaaatatgaccattgaggactaagctctggtttttttatcttgccaaaattcgtatctagagagttggggagtcatgccctactaaccataaattcttatcagatgggttttatttaaccctacatatcctgacttactttccaatctgactctggcataacattatgtgacaaagaagaaaataaaaatcgtttaccccaaaacatgtttctttgctatattttgaaatggccctgcacagccatcctttgtgggtgaaaatgcgcatctgtaaagaatctctgctagcatagctagatctttttctttcaccaccctcccaatcctgaggagatgaactgagtgtctagcaccttgtataggtctgaatagggaacatttgtcatctgttgtctctaaggacagccagtatgacacttcaagaatcttggtctccacaatcttttatcttaacctgagcatttcctttctattaatcccaggtcttagacaaactcaaccaattgtcaaccagaaaatgtttaaatttacctaaagcctagaagacccagcttcgaattgttcgaagttgaacaattgaattgaagttgaattgttgaaccgcctttggaccaaaccagtatatttctcaaatgtatttgattgatgtctcatgcctccctaaaatgcatgaaaccaagctgcgccccaaccaccttggacatatgttctcaggacctcctgggggctgtgtcacgaccgtggtcactcatatttagctcagaataaatctctccaaatattttacagagtttctcctctttttgttaggaggttaggacttcaacaaaaaagtatttggtaaatttgccatataaaataactaaaacttcaatgataatttactcagtctccatataaacaacatcaatcaaaagtatgtgcgtgtcaaaggtgatagaattgtctgtcttcccaatgagatgatttacaaattaaccattatagtggaaaacagtatttcctgggctattttttaataccatgaaccttataaacacatatgaaataatatacaaacacaatagaatgaaatatttattgttactcaaatgcccagaaacggcattgagttgtttatgaatttgttccttcattttcctctcttcatctgtagcctctacaccttcacagggagacacgttctgtttatgagccagtgtgtttaaatggctctccaagtcttgatccacacccctaccacaacacacacacacacacacacacaccacacacccattcctctcttaaggcttgggtttcaacatcatgttattctccagaaatgcacatttaccactgtttcattgtaaggaatggcagaggggtctgttattgttaatcttttaagaatggaccctgttaaaacaaaagctgctttgaattcgaagatgcgttaggaatgaaaggtacctaacaaaccacctctttgtcctatttggtagagaattcatgaagggagggttccacagagcaccaacccctattgtgtccttcactcataaggagggcatgtgcggtgtggagggtctgtgtcatgtgatgggaccccctccagtaggtgtggatcctgggacctgtgtggtcctgtgtaatggctcttggagttttgttacaggaaaggggtcccgatccagaccccaagagagggttcttggattttgcacaagaaagatccagggtgagtctgcagggcaaagtaaaagtaagtttattaagaaagtaaagtggtgaaagaacagctactccagagacagagtaggtgttcccgaaagtaagaggaggaacgcatgtccaccctaggtaacatgcatgcatgtgtgtgtgtgtgtgtgtgtgtgtgtgtgtgtgtgtatgaatgattttaaaagaccatggagagatgtgttctgctacaagggtttctgataaaggattaattttcttaattactatattttgcaagaatcaatattatctttaaagcaaaattaggaatgcctttgttttccagatatcgggatatcaggacactcccaagtctgggtctgtttagtcaacattatcagtctgttcccgtaactataagcatttagaggctaggaatgcctagctgcctgggagtgcagcccagcaggtcccagcctcattttcctagccctcactcaagatggagtcactctggttcgaacgcctctgagggttttgccctatagagtgtggagtcagagattccctgtcccatcttgggactctggtcaccacatctacagccttcatgatttttgtctcatttttcctaccttgtcccaggagatctatggattggtgggtagcatcaagaggcacagaattctcttctcatgtagttaaagctggcttgctttctcagcatgccaagagaggtatcaaagatggagtgcttattttcataggatgcaccatgctgtaaagacacagtgactcttccgtgaaacactaaggaaaaaagaaggggaaataaggaatataggacttgttagaggaaaaaggctccaggtagagatggattgatttttattataaatttgaactttttaaaatcaaaataacatttttaaaaaacatacagcacatatatatggcatatacataggacttgttcttagattactcatcttagaggtggcttctagtgtcagttttctcatggcaaatgacctcatcccacccacctcagcttccccatctgcacagctcaagtttcaaactagatcatctctgagggtcgtcccagcaatgatttctaatcctcagttctttatttttctaggaaacatattttattgacatcaattcattatttttttaattcaatttaattcttaaatttgcctcccatctggatttgctttatcgatttttttaaggcaatagaagacaatgatgaccctgaatacaaattgttacgggaaaatggatccaagataaaattaccagatcaacctttttattccatattttatggaatatctaatggatgtttggcagtaacttattcttacacacgaattcctgacagtttcgattcttcagacttattaatcagtgtagtcagcaccagagcaattttatgagacttaacagtcatcaaaaatttattatcagataaatcagagaaacaacgagcatcttaataggttagagaaagtggcatgtaaaggatcatttaagatggtgctttttgtcagttgtgcgttatatttacaaccaatatctaagaacttactcataatttcatgcaaatagtcagcagggtgatagttgctgtcttaggtcaaccttttctctttgtttttctccagcagaatgttgtgtttggtgtaactataaggctaagactgctaaatagacacacaataggaagcatcatttcccaatgttaagcctatagcatttattttaatgcagtatctccattttcttctggattttattagagttgtcatccaaaattaagagttactgagctcagccctttcccttgggaacaaggtgctaaacttgagctctttgttttgttttgttgtttcattttttcctgacatagtttggatatctgtccgcacccaaatctcatgttgaaatgcaatccccagcattggaggtgaggcctggtgggaggtgtttggatcagaagggagatccctcatgaatggcttttgccgtcctcttggtgatgagtgagctcttgctctgagttcacacaagatctggttgtttaaaagtgtgtgccacctccctccctccccttccctttcctcttgctcctgcttttgccacgtgacatgcctgcacccccttcatcttctgccatgtttgtaaacttcctgaggcctccctagaagcaagcagatgccagcactatgcttcttgtacagcctgaagaaccatgagcaaattaaacttcttttctgtataaattgcctagcctcaggtatttatagcaacgcaagaatgaactaacacagtccttgttttttatttttcttcttcttactatttttttaaacttgagctctttggaatgtcatgggaaaatggtattcagattgcctttcttatgtccaggcttcacgtgtacattctgtcctgagacacaggcctgtgtctgctgtattctcggcactgtttttgataccccgttaaaggtgtaataagagaccagatttcttaaaaatccggtttttggctttgtgcgatgtctcacacctgtaatcccagcactttgggaggcgagggcaggcagatcacttgaggttaggagtttgaaaccagactggccaacatggtgaaaccccatctctactgaaaatacaaaaattagccaggcatggtggtgcacgtctgtaatcccaggtactccggaggctgaggctggagaatcgcttgaacctgggagggagagattgcggtgagccaagattgtgccactgcactccagcctgggcaacagagtgagactctgtctcataaaaaaaaaaaaaaaaaaaaaaaaaaaacttgagtctttattgtgccagatgaggggagtttttccatcaccgtatctttgccctgagtgttcctgcatcacagtatcctctagggcagaaggatggtgatggtgggccacgtgggagctgagctggcaatagagagccttcagacagagctgctgggaatggacccagaaagacaaggccgggttacatcccagcagagatacaacctgctttccacctcacgtccacgtgtgctgccttgtctgtctggaatgctctttcttcacatctttacctattaaatgcccagttattcttcaagtgtcaggttaaatatcgcttcctcagagatcttttcttggaaggtttccctactgcccatcaactctaagctccttttatcatctttctttagggcctctactttcattagtagtaattttaataataacagtggctatcacttctttcccaggtgtcagacattgtatgccttgtatgtactgtatgtaagtttctcactcaatatttattggtgtgaatactacctgtattttagtagttaagtatgtgtttttttctcctgtaagagactgaagtctttttgaaagcaagattccttcttgactgggctttgcacatgacatccccagtgtcttatataacttctgacaggtcaccctaatttctgaaaagtaagaccattctggggtctggagtgttccaagttatacagttcattgtttttggtggtaggtaataaaaagtactggaaacattaaaatgtgttctcactatctaatactcagcttagattatgacttccctatggtgcttcgttatttttatagatctttttaccacattactcttatggtgcaaatgaaacatttccttaaccaataaactaattatgtttgaaagcaagacttttttttttttaattcaaatctgagggatctgtgattcacttgtctgccttctctttttccatgatggagtagtccatggggcatgtggaatgcgtgattgtgcttgtaagtggatggaatattcctgaaggataggcaataaactagtaatgtagtaatggtggttatctctagggaaagaaactggatggcaagagacagggaggagtgggcacatcctcttcactctttatcctgtggtacctattgaatgtcctattttcacatgtattcactattgaaaagattatttcttaaaaaaagaaaatactccccagtaggaagtttttacttccccatgaatgtataaaggaagaaaccacaaagaatgtggctttgtaactggttttgtctacactatctcctattttcattcatttgaagattgtgtggaagtcctcctttttagtctccctttgatcaggtacactaaaaattttcaaggtgatatcacctcgtaaaatgagtcccgaatcttggaaagagacaatttgaaagacagcttgagagaaggtttctcgcttaatgcatggaccatcccaattcttggctgaagcattgtgaaatcttccactgtttataacacctgtcagataacattaggctttcctatgttcttggaagaatctgtggcagtctgtttttccttgagaatcaaatgagaaaagatggtcattcatgaagaccaacaaaagagaagaataaagaaaaagcaagaaaatggatttctacgttgggtttgttttgttttgttaggggtattttcccacctaagactttaagtgagagaaaagcttttctatttttgaaagggcatgagggtttgaaataaggaagaatggatcttgaaagaattgattgtgtcttaaaggatggaaatgcgcttcggattcctacagtgagacaaggattttttttttgtttcttttctccttaatttttttaagctgtcaactaagatgacgtgtgtgtttcagactgtttatgtgggattatgagcatgtttaatctgttcttgtgcattcccaatagaaactgcgtgagtggtgtgatcttttaatagaatgtgtcttgcaactaacaaatgtattttggtgctaaattctggataattcctaagaaatgtaaatgttgtcaataaaagtttttgttttgaaatacttataatcttggagctatattattttaagttttctgaagacagtctctgcttcatttttctaagtttagttgagacagggcaacaagaaaaaatactggccataaagtaaaaatattctctataaatttttggaacatggttagaagagaactgcaaatggggaaacagctccttgcaggccactgtacacatgcatgatacaagacgacttgggtttactctggtttcagtactaagagtattgagtggcttttactagaaaaattcaggacctgcattataaagtcagctactcccaacttcctacccccatttttattttcttcatgtagattagtgtgtgatacagtttgcctcaattacactaaggagagagaattgacatttattgacttctgtgttcctaccatgcacatccaggccctggtgaattctttacagaattcatctcctgtaggttcacagtttgcctctgctttcagacgagaaaacggacagtcatcgtttaagtaaaacaactgaggacaaagccagaaatcaagttctggccagtttaaaagaacgttgtctcattttccatgttgctttgagtaacatctgggaagaaaataagaaaatgttaagtttatgttgataccctcaaagggaagccagtgtatgaagtttaggggaatgtacatgatcatttgacttttctggttcttgaatcaaattcagcttcctacaaggcctcatcctcatactagggttgcaggcacatgcgacattcaagggtccctaacagtattcctactgccagctccttagtccctcagggctagcttcctgcaattcaccctgattctaatttagcaaccccttatctgagtggttctggtacaacaagtacaaatctatctttctgctagatacaccctctgattttgggattagggatactcaacctgtataactgcagcccacagtggatatataacacacatttatacaggttgagtatccctaatccaaaaatcccaaatctgaaaggcaccatatctgaacctttttgagtgctgacgtgacactcaaaggaaatgctcattggaacattttggattttcagactagagataatgcactggtaaatagagtacaaatatgtcaatccaaaaaatctgaaatccaaaatacttctggtcccaagaattctggataaaggattgatatggtttggctgtgtccccacccaaatctcatcttgaattgtagcttccataatccccacatgttgtgggagggacccagtgggagataattgaatcataggggtgggtttttctcatgttgttcttgtgatagtgaataagtctcatgagatctgatggttttataaagggcagttcccctgcacacagtctcttgcctgccaccatgtaagatgtgcctttgctcatccttcatctgctgccatgattgtgaagcctccccagccatgcagaactgtgagtccattaagcctctttttcttcataagaagtttaatttataaactactcagtcgtgggtatttcttcatagcagtatgaaaatggactaatacagggatcaacctgtgttattttgtagtcgggcttcagtctgttaatgcatattaaagggtatgacctttctctagaatacttactagtatttgtctcttttggacttgaggatggactcctggcttttcttggctcatcatgtaccaactgactgtaatcagattggccaggacagtctttaccaagctttctgcgtgatcccttctttgtctttgttttattagctctagactcaggctctaattctgttgcccatccaagaatgagcccttctccagggagctcttatccactaagtggaaaatcatattagcatccaaatctgaggcccaggaaagttttagagcatggaagcagaggcagggtgatgtcaggtctgccagctatttgagtgacaaagcagaaaaattactttctactcaaaggagcacgcgttcatgttgatgttctccatttacttctatcttttttacatttattttgtccttactatattaccagaatttattaatccagtccccctttgccaagccatatgtactaaatgaaaccatgtgtttatgtgaatagtgatcccatatttccaaattttccttttcttgtctcttcctgacgctggtctctagtgttctggaattggctgccaagtgtgtaagctcaggaagttccccttgttactgtccacagagcaatacctgcctgaaaagaaaaagaaacagcgacctccttctaggttttatactttaaaaaagaaaaaaagaagtgtgggccactcagtagtagaaagccttaggtcacctgatgtctaggtagaataccatttaattatggaacaataacagtgacatcgggaagacataactacaaaaccttttgaagtctgttacctcctgattttcttgggcactaatgtttgtcttttaacactaacagctttacacttttttttctttctttttttttttttttttgagacagagtctcgctctgttacccaggctggagtgcaggggtgcaatctcaccgcaacctccgcctcctggattcaagcgattctcatgcctcagcctcccaaacagctggggttacagtatgtaccaccatgcctagctaatttttatttttatttatttatttttgatacagggtctcactctgtcgcccaggctggagtgtagtggcacagtcttggctcactgcaacctccgcctcccaggttcaaaagatgctcctgcctcagcctcccgagtagctgggattacaggcgtgtgccaccacgcctggctaatctttgtatttttagtagagatggagtttcgctgtgttagccaggctggtctcgaactcctgagtctcaagtgatctgcccacctcggcctcccacagtgctgggattacagcttctggccggctttacacttatattcagtttctaaatgaccttaggcttgctgtcttatctcattcaagtttcagttcaaatgccatctcagcaaagttttttccattatcactgtatctaaagtggaccccatcgcccaccacccactcctgcctccaattttatcgtctctcttatgcttagaatggagtctcctgcaagagcgggagacgtagttttgtacactgctctgtcctcaggagcttcagacattgcctggcacctagtggactctctgaatattcgatgagagctgttgttgtttcaagcatactttgtcacctgcagtgtaaacatttctgttagaggatttaaaaaaaaaaaaaaaaaaccttccgtgacacatccgtgacacattttcagtgtttcccttttccttgtgtctgagttgctcagatttcatattattactgccacttccatcaccataaatgttgctctgatgtttccaaggctgcagcctttcccaaccagctatttcccatcaaatctagtcgctctttttagctaggctttgaaagaaactcctgcacacagaattttaaagggcaatatcgggggccagggggaggggaacaaaacaaaaacagacgctttgtttgacctggactcagcccacttgccttatattttgttttgtttttgagtcagccaggcctcccatcccctaacagacacctctgtgtgtaggacctagatattggctgctgagagcctcaggatgcaggtgttgcttttgtgttccatcacgatggtgtgaaagagcctataaaaggtaaattggcaggctttgaactatagtaattgcttgaaaataaacagcagaggagaggggaggggaggcagctcttcttcccagcccttaaaatatgtgcgggttacgttggcaagtcagaaaaagtacttagagcctgatctctgaacctaaggacctaggcagaagcgagcataaagagtccctcagtcatcacgcagtctttgggtgccagaggtctcctgatcagccccattgagaagcatctgtgtgctgcaggaggctgtgccgttgctcatccttccacctgcgtcatttgagatggagcctgacctgttgaacacagggacatccagcgccagtcaggcatgatcacgtgcttcaagaaacatttggcttttctccacacagaagaatcctgtcaagacagggcttctccatttgagcttaaattttctcacagatggaattaatttcctatattgctaagaaaaattctcccagtcaaattcccattgttaattaagtgttgaggagaaaattggtattttgtttctttctcctaaaatgtggaaataacatggtttcattttaattatgtatggcaccagtaaaaagaaaaatttgtagctgctctgttcatgttggagcaaatgtcctgcttttgagaataagtgtggctgcatgctatacaaaagagaaacagggactccacagcaattgtcagaaccacagtatcacagcgcttctggtctctgagtcctaccaggtaccggagatgaacgcttctcccagcgggacttatggaccctgaagaagcatttcaatggggtcaaaggacttctgaataccctctaaggaaatgtacaaaaactatgaagtgccttttaatgaggagcaggtgtagccttggagaataagcttgccctaggagacatgctaggttctcttccacctgtagaccagtgggtgtaagcctggccctggaaacaggctgcctgggttcaagccctacccttaccttttgctagctttgtgacattgggccagatagatttgtttttcttttaacatctttatttgacaacaattggcatacaacagactacaattagggtgtacagtttgatgcatttgataaatatatacatctgtaaaacaatcaacttaagacagtgaacaaattcctcatccccaagggtttttttatgcccatgtataaaccatatttctcatttgtgcctctcccttcatttcccccatccccaggcaaccactgacctactttctgactgtatgtttgcattttgtagagtgttcgataaatatagacatataatgtgtactctatttaaaaaaaaacaactggctcctttcattcagcataagtattttgagagtcattcattcttgttccatgcatcagtagttgatatcttttcattgctgatttgtagtccattgtgtggatatacctcagtttgtttatccttttgcctgctggtggacgttaggcttatttccagttaggggctattagaaataaagctgctgtgagcttttgtgtaaaagtcttttgttgaacatgtgctattgtttctcttgggtaaacacctaggagtggaatgcgtgggtcatatggcaggtatggatttacctttttttttgagacagagtcttgccctgtcgcccaggctggagtgcagtggcgtgatctcagctcactgcaagctctgcctcccgggttcacgccattctcctgcctcagcctcctgagtagctgggactacaggcacccgccaccacgcctggctaattttttttttttttttttgtatttttagtagagacggggtttcaccatgttagccaggatggtctcagtctcctgacctcatgatccgcctgcctcagcctcctaaagtgctgggattacaggcatgagccaccgcgtctggccagatttacctttttaagtaactgcaaaactgtaaaataagataatcctggattatctgatatacaatttctcacttaaaagcctttgagccagccgggcatggtggctcatgcctgtaatcccagcactttgggaggccgaggggggtcgatcacaaggttaggagattgagaccatcctggacaacatggtgaaaccccatctctactaaaaaaatacaaaaattagctgggcatggtggtatgtgcctgtagccccagctgcttgggaggctgaggcaggagaattgcttgaacctgggaggtggaggtagcagtgagccaaaatcgcgccactgccctccagcctcgcaacagagtgagactccatctcaaaaacaaacaaacaaaaaaaaacacctttgagtcaggtgtggtggtatgcgcatgtagtcccagttacttgggaagctgaggtgggaggatcgcttgagcccaggagattaaggatacagtgaactcagatcataccactgtactccagcctggacaacagaacaagaccctgcctcaaaacaaaaacaaaacaaccccctttggggcctttgaggaaatgactaattgcaggtccctatcaggagaatgtagaacaaagcctcaaacatcttaacaatccagaaagcaagggagctatcaaagattgtcaaaagatcacacctgtaatcccagctctttgggaggacaaggcaggaggatcacttgaacccaggagttccgagactagcctggacaacatagtgtgaccctgtttctaccacattttcttaatccagcccaccattgatgggcacctaggttgattccatgtctttgcaattgtgagtagtgctgtgatgaacataggagtaggtgtaaattgttctaccacaaggttctttcatttcagtcatttcaggagctttaacagggttctggctgggtgtggtggctcatgcctgtaatcccagtattttgggaagccgaggcaggtggatcacctgaggtcaggagttcaagaccagccttaccaacatggtgaaaccccttctctactaaaaatacaaaaaattagccgggcgtggtggtgggcccctgtaatcccagctactggggaggctggagcaggagaatcacttgaacctgggaggtggaggttgtagtgagtcaagattgtgccgttggactccagcctgggtgacaagagcaagactcaggcttaaaaaaagaggttctgtggcgctatccatggtgctgaccagtactgaccaagggaacaccagaagaaaaagaggcaaagcagggagcatgaaagatgagtttggtcttatgtgcactaaatttgaggttttgggagacccttaagtggagagatatctaattgagaatgtcttatgggcttggaattcaggaagcaagtttaggctggaggtagaacttaccttcctgtggccaagtcctcccagaaaccctgctttgattagtcaccagcctggcaacccctcattatggtgcagcccagaatactgcagcaacagaatattctagcttcagggccttttgctttgaagaggtaggttctcagtttatcaattcatgtctgtgggtatgcattgctagctgctttgaggagttttgtttatcagattgagtggccatatcttggatcttaccatggaataaaaaggggtctttagcatgtacgattatgtagcaagctcagtgaacactgtcgaaatctatctcttttcattttaggcaccaagccaagtttgctagcccctgcgctttcttctgtaatttaaaatgttctacgtttttcctccttagttattctccagcataagcaatgggaagtaaacaattcacctggtcagcttagaaaacaacttactgaattgatttgcactacatgggcctgagtagaaactgctttatctagatcttagttttataatttgggagaaaagatggacctagacaccatttgtgagagactacagtttctatgaactcctcttaatcagtctataaggtaagaaagacatactatatgctattaaataccagtacttttgccttcttgctctgactttgggcatgtaagtatgaataaagaagagaagatgaatttacaatagcaaagacatggaatcaaccccaatgcccatcagtgatagactggataaagaaaatatggtacatatacaccatggaatactacgcaaccataatataggaatgagatcatgtcctttgcagggacacggatggagctggaagccattatcctcagcaaactaacacaggaacagaaaaccaaacaccacatgttctcatttgtaagtgggagccgaacaatgagaatacatagacacagggaggggaacaacacacacacataaaacaaacaaaaaaaagaagatgaagaaatggcagcttttgtagatgagtgtcactgttaggaagagggaggtttctctttgatgatgtggaaagaagacattggcttggctttccctggggtgggtaagtagccaaacacggtgaaagatcagcagctggtagaaattccaaaaggggaattaatgaaaaatggttaaaaagcagtatggtgctttggggggggaaaaaaaacagaaaatgttaatttcaagaagacaatacaacagaaatcacatgggccttttagagtgaggcaggcctgggtttgaatgacagttctacattctgggtggtcacatgatcgtgagcgcattattttaatgccctgaattttttttcttctgtaacatattaggagttgcacgtttgtaggtcacactgtgcacagctctggtctagcatttgttttgggaaaaataagatctgatagcagaattctaacatttgtataaatgttcctcttaacagaaacttacaaagactctttgtaatagactgcaggtcaaagtagtgaggcttgaaccgctacagaaagcacaacagtattaaaggaaaagtgcaccacctcttggtgaatgaacatgtctatggccataactatatataagattatctgagaagtttggtaaccttaaacatataaccagccatatttgtacacaacaggctttctgaggagacatagttgcctggaatcatgtcagtggctgatactcttgaaacggcaaattgacatcacagtgggaaaagtgtaaaccaccatcaaagacagaaaatgaggtcactgcagtgtgcctccttttatttacagatctaggaaagttaataatgagggagatcagaggaaggggagtagaaaggagacaaaataggaatgctcttgaaatttatatctgaggacctttgtgactgcactgagaaccagggaaagcagtaaaacttggggggaaaaaaaaccatgttcaattaaatcctatttcaaatgttttatgatgttcaaattttatagaattataaagttcaggaaaccatagaaatgatctcattttccttgttactttttagatgatgaaattgagttccaaaatgattaaatgaccaacccaagacgatctagctaggtaatatattttgctcacaggatcttctcaaccactggtccctctgcctgaaacgtgtcttctatacaatactcatcgtccttcattgcacagttaatttccactgttctgcagattttaggtcttttatcactttcctttgggagtctaccctgatcactgcccccacatctcatcaaggtcaaataatgataataacagaaaacaacctcatctaatgttcattgaatacttattaatcatgataactctatgaggtgaatactgcttatccccattttctcaaaggagaagctgaaatacagggggattaagtaacttgctcaaggttacagttttaatatgtagtagagccagaattgaaacccaagcatttctcactgcaaactccaagctcagtcctagtctaccagttattctattatcagaataccttgctcctcctttagcatttattgttctcatatatttatatttatttgtgtggttatttgattaatacgtttttttctactagaatgtaacttttaggctcagattacgtatctttttgattcaccaaattttgcttagagcctaagtacctgatatctggcaggctcattgaatatagttcatatgtaaagtagaggtgataatagcatattttggccaggcacagtgcctcatgcctgtaattgcagcaccttgggaagccaaggtgggcagatcacctgaggtcaggagttcgagaccagcctggccaacatggcaaaacgctgtctctactaaaaatgtaaaacttagcccggtgtggtggtgcacgcctgtaatcccagctacttgggaggctgaggcacgagaatcacttgaacccaggaagcaaaggttgcagtgagccaagatagcaccagtgcactccagcctgggtgacagagggagactctgtctcaaaaaaaaaaaaattaataaataatagagttaatggcatattttatggtactatttaattgtaccctagtactaattgcattgtttggagaattgagataatatatacagagtagtcactagttcatgtcactcgctagtactcagtaactgaaaggaggttaattgtaataaatagatttagcttaagataacaagacagaatctgaatccaaatgctcagtgctcttaacttttattccctacccctttgggtacctataatgaacattattagaaaagtgaatcttagaaaatatattgcttcccagagatgatttcagattaactaacagacagctaaagtataagttccctccttggtgtcagttttattcttgagctggagatagacccagagtctttatgactcagtggtaattaacagataacttgtttttttctttgttttttgttgttgttgttgttgttgttgtttgttttgctttgttttggtttggttttttttgatgcggagtctcactctgtcgcccaggctggagtgcagcagtagcgtaatctcaactcactgcaaccttcgccccgcaatgctggggttcaagcagttctcctgctttagcctcctgagtagctgggattacaggcatgcgtcaccatgcctggataatttttgtatttttatataaagatgaggtttcaccatgctggccaggctggtcttgaactcctgacctcaagtaatccacccaccttagcctcccaaagtgctgagattacaggtgtgtgccaccgcacccggctgatggctcattttttaacaccctgagtttaaggtggctgtgagcccacctagagatttcccaggggcagttaggtctatccttgcaaaacacaaacttgttataatagttttggactatttttaaatactttagtgcaaacactatgtgatccacctgcctcggcctcccaaagtgctgggattacaggtgtgagccaccacgcctggcccagataactctctgaaccagcatctcaagctttggccattaggaaagtctaaagtaagtatcttcagatcaacatgttatttgagagtgcagttgtgatgtccttgttcagttactgcaggagaagggtacttgcttctttaccctttctttgaccttttagatgtatttgtttctacacgcattctgtggctttctgtgtatatttcaaagatgtagatatgatctattatttcaaatcatatccttgaagttcagcagtgctatctctaggtataaaagtacttgtagtaagggatcatcaatgtattctagtatacagacctagaatagctgtagaataaaaattgagttatattaataacctgtaaaatagtcacagataaaatggtgaagagatcaaaattaatcttaaaaaagcataagccaaaaatgcagatatcatagggtcaaaaatagtgatattcatgaaagttatgattaattatttaatcccaaggacacagtatactttaaaaatatatttcaggttcacaattgactagctattttatgtggcagaataccagctttgcatatttattaaaattattcataactgcatagcagcctagttgaactgttgagtccttgttcctttgtccaatatgttaccttgtccatttatcatagcactgtaatagaaatttgtctaaattttaggatgatccgtggaatatcttcagtgtcagcatgtcttaaatattttattctttccgttttgcctaatatgatctttttacataggtttagaagatatctccatggggaaaaaaatgcagtttttttaaggaataaattttagacagaagtctttgttcaaaacgaaaagttattatatatcattaatatttatgtgtcaaaatatttctcttacataaaaatctggacaagatgtgaatgctttttgtggaagaatggaagtttgtgttcttcatgcagattttgagataactatgtttgctttgagtattatttgttgagaatttaatgcattgctgtggtcattcaatttaacagtgtatttgggtggtgggttctggagtcagacttcctttagttcaaatcctgagcccaccacttagtgtttatgttgtttaactttctgagcaccagttatctcatctgtaaaattagatgataatagtgttcttcttggagggttgttaggaaagagtgtatgagataatgcatataagagcacttagaacgtgaccaggtgtggtggctcatgcctgtaatcccagcactttgggaggctgaggcaggtgggatcacctgaggtgaggagtttgagactagcctggccaacatgacgaaaccccatctctactgaaaatacaaaaattagcccagcgtgacagcatgcgcctgtaatcccagctactcaggagactgaagcaggagaattgcttaaacctgggaggctgaggttgcagtgaactgagatcgtgccactgcattccagcctgggcgacagagtgagaatctgtctcagaaaaaaagaagaaagaaagaaaaaagaactgagtcagacacataataagcattcaataaatactaggtgctgtcagtgttaataatagtatatcatggaatgcctcagcaagcataggctagagttttatcaagaatatatggtaaagagaagtttatttccggtattatgtctctaaactgctaaagacttcattagaagatgatgttaggaaagaaaagttgtacaactctttagctagaatattaattaaattatagtagagttcaaagaagtctcagataatctagtttaatgacctctctttgcgtaggtaaaaagtgtagttcccataggtcaagtgaccactgcaggatcacccatctgggactgcagactctaacccaggtctcctggttcaaagcctagtactcggcctgttttgaaacactcatttattagcaagaagcattcatcaatgttgtcttagatgcagcaattattttgggaaataagcagtacatgaaattttaggcagtatgtaacacttccttgcttctctgggtttggtgtcctagtgacttttaagcctccagaaatatctttccacatacctaagagtcacacagaaagtgattgactgtcgcagagctagagccatcatcagtgcgtgtgagcagctctccctgaattcctcattgggacgatagtggtcgttttggtatgggtacagaaaatggaatatccgtggagtgatctgtaatttccctcaagacctcataaacttctaaaattaacataaagcctttcttccttataaaatagagtcatgtgttaaaggagatgcattagatgcttctgtgcagtatattttagtaggttctataaaatttgcaataaaggaaaggtcagtgttggtaccataaacagtgttcgtggagtcatatttaaccctagtcccttctgtgactcctggagtgtagagtaattgaactactcttctttgaaaatgcccctgtacccgtcactgcccaagaaagaccccactactacccagcactcttttcttagaggcactacctgctcctggctctgggacccacctgtcaccaaagggcagtctgaaaagagggtggatttcatctcatttacagcatgggagtggaagcttcccttctggctcagccacagttttgtagttgaggtgaaagtgaaaagactgtcgtcacactgatctgtggggtatgcagagcagagtcctccttctgtattttggtgatcacatgtgaaactaagagagtgcaagggtgacctctgcatactgacgacacatgtagttgtactgcgcggcgagtggctattcatgtgacctttctggctgtaggcgtagcttcccagcctgcagaggctcctgcactgtataatggcagagataatggccctgggcttgttccacagagcagttttcaagcttaattgaagaatatttttaacccattatcaagagcattaggaggaaattttcgaagagtcttgcttgatacagctctttcaattgaagaaagtagactcccaagtaagcaaattacaaccttaaatagtaatccatctttatttgcaatcccttcatctttccaggataaagactcctctcttcactctgaaagcatgaaaaggggcagatccagacagagcatcacacatgcttcttcctcctggtgtacaggagcacgtagggccctttgtttagaacaggatgcctttgaatggactgccttgaaaaaatttttcagaacgatcctaaccatgtctgccaggctctcatggcgcatacagatctggttggaagatatttaaaggtgttcaggcaacgtgaagggaaagcacccatctgagacaccatgaatgggcttttctttacgtcattatttctagctcctttctgtttctacgctgagcaaatttgctctcatcctttcaaacttagagggtttttttttttttttaaagattgctgagagatgcccccgaaattatgattaccacagccagtttctcactcagtcatggactatagtcaaatttaatcttatctttaacttcacagaatagttaatgttatcacacgcttgatttcttggattattttgtcttttacttttaaaatggcaggagaaaaataacccgatttttttctgtaattaaaataagtctgtatgaattagcatatgagtgatcagataatatctaaccagttgaagtttggaagttcctttcgtttaaacaaaaatagaatttcagcaccattttcatttattgattcttcttttcctgtatttcacagtttttaaaaatgtgtttgaagtcaccaaaaatatacttctaatgctgtgactaaatttgccacaattaagacacccaagagtccatcagggttaaagtaggctacaatatgtttataaggacaggcaaaaggtgtcagtgtaattttattaggaaagtgaaaaagagaagtctatgggcagtcaggaacaagctgagttatttaccaaaaatatatggtaacttctcttttaggtgtgtagtgtgtatctcaaagaaacacatgttagttcacaaggatttatgattttttgattaatcagaaatccattcaaaaaatttaccagtatttctcaaagagaagtgctgtctgtagacaccatgggcacatgaagtaaaataatctgtgaaaattctttgtcttgtaaaaataggagtgccaatctgatcaatgtattgtgttataccagctgtgtgggtgttacagaatgaattttggtctcaattttgtaacttacagaaaagctataattgcagtctctcctgcccacttgtatggtcaactaattttaaccatctctaaaaggcacttgcaaaaagggaaaaatgcccaattcttgggtgcatgggcaaaatatacatatagaaatgatagttcatgaggaccagatattctgaaaaccttctcaccatggtagactagatgcagaatgagtcagagaaatgtattttataactatattgctgaacttgtaagagtagaggaaaatcctcaaggggcagaaagaccttataataatttgaaaccaaagaaatgtgctaaaggagaccaggactgtctcaatagcaatgcccatgtaaggaactcagaacttaaccactatggaaaaagatgactaggcctggggtttggttgcagttggaggacgaaactctttcacaaagctagcacattcaaaggggctaccccctcagagaaagtcagagctgaaaaaattagcctaccaagaaaggaagcagatgggaaaatgtgtctgcttttgccattgctctacatcaaggaaaaatagtagtcatcatagtcatcttctctcctctcctaaccatttgtgactataagcttaatgttggatgggcatgcagtataagtatacgctacttgccaggtcatggaaactacatttaaaaaatgtagataatttgtttccaaattggtggaactctgtggcatttggtagagataagcataaatctggagcaaagcattaacaaaatcgtgtcctaaggattcctacagattcaactgatatgaagtcatcataaatacttacacacacacacacacacacacacacacacacacacacacacgcactctctacatatcacacatacactctcagggaagcaatgaaaaattaccaaacagggaataacataagccaaaatttgcaagactcagcagaaacaagaaacacagatctacatcccccatgccttataacattggggtgcagaatactgcatatagaaaaatacatgtgagctatatagagaaaaacgttgagcaaagagtcagcaaccatcaaaaacaaccagaaagatctgaaaaataatagaataacaagaaatgaaaaatataatcattgcaattaaaatttcagtagataggttaaaagggtattacacataaatgaagagagagtaagtgggccaggaacagtggctcacacctgtaatcccagcactttgggaggtttgcagtgggtggatcacttgaggccaggagttcgaggacagcctagccaacatggtgaaaccccatctctactaaaaatacaaaaattagctgggcgtagtggtacgtgcctgtaattccagctactaggaggctgaggtgggaggatcactttgagcccaggaagtggaagttgcagtgagcctagatggtgccattgcacttcagcctgagtgacagaacgagagccttcctcaaaaaaaaaaaaaaaaaaagagagttcaagaataaatgaactggaaactcatgaaaaagataacacaaaacacagagtaacgagatgaaaaacagtaaagagagagtaagacatagggatgacaaattgaaaagatttaacatatgttgattgaagatccactatattaaaatactgaaaatgagagaagttaagaattgggaaaggtttgagattttaccttccttccaagctcataaattagcttcccacagtttcatggatgctgtttgaagacacaacattcctgggtcaaacacaaaggactttatttctcaccgcacaacaggtagcgtgaactttatgttcaagccaattccccctgctccccaagtcccatggggatgatgtggccctgatgcacactgggcgtgcagtgagtttgggtcatgcccaaagacacctgagcttcggaagcccaagccttttaaaatggtctgtaagcaaatgtgctctttaccttggagggagacattatctttagtattatttatcgtagtagacagtattaccttactagacagtaaacaaatctgctgtctgctccagagagacactatctctatcttccaaatatccttgaatagttttttctgaactgatgctgtcagggcctctgctcacaaaatatgcaaaagtttgtgagtcccatggagaattatttcccactagtggagaaacaatttaagactgagacgtttcagaacgctagaacattggaatcctctgatacagtttacactttgtataccaagcagcactaatacatatatagttagacctatcatggtggacaccaaaaacaaaagaggagacattaaaaacaaccagtaagaaaagagttcaaattgacaagctaattctgcagttatttggaagagtgaagggtcagaaataacaaaaaccctcctgaggaagaaccaaagtagtagagatgggctgtcttgccttagagacattaaggtctgttataaagctataataacgaagacagcctggtattagggtgccagtgtagttacagacaaagagaccaatggaacaggataaaaagcccataaataatctcatgcatatatgcacacttgacttacaatggaaggagtattgcagatcagtggggagagactgaactaatcaataaatcatgcagttacaagatcatacatgtggagaaacaaaatgaaaccagatcctgaagtacacaaaaaatcggttccaggtatattgaatatttgtatttttaaatcaccaacagaaaggttttaaaggaaaggaaaacagtagaactttcaaagaactaaaaaaaaaaaaaaaaaaaaaagaatataacctcagagtagagaagggtttcttaccccaaactcaaggaaacacagattgtaaaggaaagattaataaattcaactacattaaaatgaactttctctttatcaaaggataccattaataagttgaaaagatgcaagccacaactgagaaaagtggtctgcaacacacacattgctgacagccgattagtatctaaaacatttaagaaagataaattgataaaaggtatgaacaagcatttcaaagaaaggaaaacatgacttgctaatatacatgaaaaatggtcaacttcagttgtaattagagagctagaaattaaaaccatgtgacagcattttatatgtaccaggttggcaaaattaacatttggaacaatacagtttgtgggcaaggatacggagccacagaaactctgatggtctcaatctaattccctgcaaagaccaaggcagacatgtatagtctaagttctctagggttttatcaaacataagaagaagctgatttaacaaaaatcttatctgttcttcttaacgagcaccaaaatatttttattatttatttattttagagatggggtctcactctgtcacccaggttagaggtcagtggcgcgatctcagcttactgcaacctccacctcccgggttcaagcagttctcttgcctcagcctcctgagtagctgggattacaggtgcctgccaccacgctcggttaatttttgtatttttagtagagacggggtttcaccatgttatccaggctggtctcgaactcctgatctccggtgatctgcctgcatcagcctcccaaagtgctgggattacaggcatgagcccctgtgcccgtccacaccaaaatattttcaagccaaattgttctctggtcaaaccttgaatattgagatagatgtgctttatattttcaaggggaaataaatacctgcagagaaaaatccactgcatcccagatggataccagttttgtttatcttcatcccaatttccaaggttagataattcaaaagagaaccttaaggaatagccctcttagatatattctgcttttatttctattgcaaatggaaattgacaaattgacatacaaaatgaaaaattaaaacacaaaatatgtagtgattggaataaaggaaaaggcacaaactgctaaaattctccatgtttgagagagaaatcaagcaactgagccctgttatcccctagaagaatcccccggggcatcaagttgcatcttgtcatgaaccaatgagacaggattacagaattttttattatttttttttgagacagattctcgctctgttccccaggctggagtgcagtcgtgtgatcttggctcactgcaacctccgcctcccagtttcaagcaattcttgtgcctcagcctcccgagtagctgggatcacaagtgtgcaccacatctggctaatttttgtatttttagtagagatcgggtttcaccatgttggccaggcttgtctcgaattcctggcctcaagtgatctgcccgcctcagcctcccaaagtgctgggattacgggcgtgagccaccgtgcctggccctttggattacagaatttgacgataatgggttcaaagctgtctggaggcataacctccggggcagctgaacaagattataggaaaggaataataaaatattctgaagtctgtctatgcaaacaaacacagatgtctactctggaagaataaaatgtaccctagaattgcttttttttttttctagtatgattgagatgttatggtaatattaaaaatgaaaaaaaaaaatcccaaaagtctaacctagaataactgcactgatcatattgccttgttctttaaattcttagtatccaaataactttcagtatttagtgagacatattcgtacatactcttactaccagacagcctatttattaaacattcttaattcttgaactaaactgaatggtcaagtaagttacctaattagccagggaagctaaaggaagtactaggagttaccatcttagggaaaaatttccacacttggatttgaatacttgtgaaactcggtagcagtgaactagatctgaatcaatatctctgcctgcaagtcatataacctctatgagaggttaatgtggctcctgtttgactctgtgttctccatcagctaagcatgtgcatgtgtcattcatattttgttttcagcttgttacactgacaggaaaatctctgcggaataaagaaccagttttctcagcctctaaagctatactgtatttgcatatttccaagatttaaagagaacagtgttttccttgtgtggacggttcttctatttgtactgtactggaaaacactgacagctaccaaactgtctctcattttgttcctgctcattactaattttgttgattcaatagtggaagtggggaattttttaattagatggcatatttcaaaaccattttcttaaaaaccctgaataaaatgtccgacttttgttaaagccactttgctttgtgcattacatgttgtgtttatgaaaggattaatatatataagccgattctgttaggtagataagaccttctagtttagctctgttaattccatacatgattgtgcatatgcttgtgcatacttggttggtcaaggatggaaaggaatagcgaagctaactgagaatcacttgtttaaatacattgattttatacaatctcactttgcaggccctggttgacaccttaaaataaaatagaattctttagctggtgttctctttattttgtacgtaaggtaatccccttaacaaacaagcaaacaaaaacttaatctcatttgtaatactaacaattggaaacaacagaatgccctgtgagatttgattgattaagtaaataacaatgcaacaatatgattgaatcctaggcagccatttcaagttgcgatgtataagatggtttaatgactttgagaattttcataacatactataaatttgaaaagccgagagtctatatcccaaggcaaatctgtatggaaacaaaaaaaaagctttgaaggatacatgtcaaatattaatagttttcttaagtggtaggattgtatgtgggttttttctctctttatgctttccagtactttgtaatttttctctaattattatgtgcaacctaatttatttttttctaacaacatgtaaatttcaataatttattattttggctaaaaacatagaaatgttttaataaactttcataatgagaaatatattaagaaaaaaatcacatttcttgtatttttattatcacagtagtattcaatataattacaggcaggcctcaaagatatctcagctccagaacacagcagtaaggcaaatagtgcaataaagcaagtcacagtgcatgtaacagttacatttatactgtactaagatatattgggcgtgcaatagcattgtatctaaaagaaatagtggacatacctcaatttaaaatatgtgctgctaaagatgctgacgtggaaatacaaagtaaacacctactgttggaaaaatggcacccaaaagcttgcttgacgtagggttgccacaaactttcagtatctccaaagcataagaaaacaaggtatgcctgtattataggcatatgctttaaatgcatatataattaacaattttatgaatatgaattatataataagcaattatattactgcatacatatgcaaattgtatataatatataattatcaaacagttattgtatatcacatactctgctaagctctttatacaagttttcaggcaggcagaaaacataatcatcgccactttgtaggtcagcaaactgaggatttgatcaagtgctttgccctcagtagtgttaacctctaagtgacagatcccagctttgacctggagcctaagtcccaagcccgtgctcttaagcattgcccttttgtcttttactttatttaattgttgtcaaatattagcagtggttttgcctttatccctttcttgtcttccatttctcattgcagaagaagatgcaaaattcatttgagagagaattataaagattgtcacaattgaattgaagcaagtgatatttttaaatatctattgactaattattagattgcatttcacttattttattgaatgatacagaatgcatttctctctctctctctctcttttttttttttttttttttaagggacaaagtctttgttgcccagcactccaggcacattcgtggctcactgcagcctcgatttcctgggctcaagtgatcctcccacctcagcctcctgagtagctagggctacaggcacgtgccaccacacccacctgtttttcaaaaaaaaatttttgtagaaatgaggtctcactatgttgcccaggctggtctcaaactcctagcctcaagtgatcctcccaccttggcttccaggagcgctcggattataggcatgagccactatgctgggcccatttctctatttagaaaggaaaaggtgcacttgggctgtgttaaaggttgtgattcttaaattcacactaaatcatttcctttttttttttttttgtttttgtttttgagatggagtctcactctgtcactcaggctggaatacagtggtgcagtctgcctcactgcaacctccacctcccgggttcaagcgattcttgtgcctcagcctcccaagtagttgggattacaggcacacgccaccatgcccagccaatttttgtatttttagtaaagacagggtttcaccatgttgctcgggctggtctcaaactcctgacctcaagtgatccacccacctcagcctcccaaagtgctgggattacaagcatgagccaccacacctggccaatttcctttttttttttttttttttgcaaatttaggtgtaggcaacaaaccaaatatggcacacatttgtgtttcagggtcacaccatatgagcggtggcacacacttgtaatcccaatgctttgggaggccgaggtgagctgatcacctgaggtcagtagttcgagaccagcccagccaacatggtgaaaccccatttctacaaaaaatacaaaaattagctgggcgtgatggtgtgcgcgtgtaatcccagctactcaggatgctaaagcaagagaatcgcttgagcccgggaggcagaggttgcagtgagccaggatcacaccattgcactccagcctgggtgacaagagcaaaactccatctcaaaaaaaaatgaaaaagaagtcacagttaccctcttactgtaggcacttagggttacttgggggtgtatggagaaacaggcattattaatgtagagcctttacttgtgtgtttataaatctagggattagctctggtgtcacattgggcatcagtgaaattctgtgaaattcctttgataattcaatctcccctctccccaattttcgtaccatttctagaaagcatatgccacttattaatgcacaggtagtatgctcttgtccgatattatcttctttctgctcttatgaaatctagtacagctggcttcaatcaaatcataatacaaattgcatactgaaataaaaaataatactcagtgtttgtagccagagaccccttttggccctaagtatttagcttatatgtatttttaggcacaagtattacttgttgcagaattttcaaccaaggagtgaatgaatatttaagaaaaaaaaatctcgattgtttcagttcatgctctcagtcaaagcacatcccggcacatttatactcatccatcctgtgtgggcgaggagggaaagccgtgttactaccatgtgaaacttgcagtggtttttatttttaccctctgcacacacacaacagagtattgttttgtgagaagaattatgtgtaggagttttagagatctatttgtatcctagctctttcctaattgtatatccttagggatgtcactgaactgttctgtatatttcatcaactttaaaatggagatagtgttaatagcctgttgtaacacagaaacttgtttattaaaagtaggtaacatatgtcggagttacacagacttgaagcctgcttcttccctttctttgcttgcctcatgagcactgttagagcctttggaaagatacttcttttccaatggtgatgcaaagtttagtggtttgtctcttggctttacttgtatttttttccctagatttttttagctctcccttgtatatttttctgttctctatgtaaagaaagattcattaaaaattaattaggccaggcattgtggctcacgcatgtaatctcggcactttgggaggctgaggcaagcagatcacttgagcctaagagtttcaaaccagcctgggcaacagagcgagaccccatctctttaaaaaaaaaaatgtagccaggcatggtggtgcacctgtagtccctgctacttgggaggctgagatgggaggatcatttcagccctggaggttgaggctgcagtgagccgtgatcacaccactgcactccagcctgggtggcagagtcagatcctgtctcaaaaacaaataaataaaataagatttttagttttgtatctaatacattcaaataaacttatacatttgccatgtttatgagttcttttttaattgaagtgtaatttacatacatttgtacagaccgtgtgtgtgtgtgtgtttgtgtgtatataatatagttccctgagttttgacaaacgtgtataaccagtataccagtttaggtatggaacattccgatcatcctggaaagtttgggaaatgtttttttccacttaagaatggctcatttctccagattctcgggttttttttttttttttttttgctttggggcaggtgaatcatctcttgttatcagcgcccctcctgtagcttctgagctacagtctttctcaatcagcctccttttactgatgacatgcttcttgaagaggaaaaagtttgctttctttttctatgagaattttccagtttttcgttttgttttgtttattatcttcctagcatctctcttcctcatttccaggtgatgctggcaatctattttacagtttagcacaacctttagactctaaagaggtcatttaaaggtgctttccaataagaagcattttagtgttgtctctgaaatgtttttactctccccctgcaccactcagaatttacatagtttttgcgtacataaatgtgctctctcctcccccaaatttagtaaaatgtaaaagtctgagttactgtcaattttgagatatttaggaaatttaactcaataccaaaccagccatttctttgaagtagaaataaatatttcatttacttactttattttgttttcctcttggcaaacacatagtgttacattagtttaaactatgtctgttattttaagtcagttatttgttattttttaaaggcttcattaggtataaaagctatctgtaagtcaagcttttaaagtactattgagatttgtcagccataattcaatttttattctttgaatcaagacctaaactagtacctttagagtaatattgcaaatgagcactacttattagaactgtttttgaaagtatgcaaagtgtgtttgttctaccttgccttgtatatttacacctcttcgattttgctttatgaggagcaaaagaaactgtcactatttgctgtaaattgaagcttttaataactaagtcttttctacaacatttgtcagctttgaatattctgtcagtggaaaataaaaatagcagggaaacccagcagtggtgacactgagaatttatctgcttatgctacactaaggtaaaaaaataaaatcttcaagggtgagcatttgacatttttctttcaaacaaagtacatttgaactgacacttccttgaataaattttagatgaaaagttggcaaaataaatgaataagtttcatcattaaacacagaacaccttttaacctagaaacaagagaataaagaggttgcttcatatcattgattcaatcctgtatgccttgtttgacatgagcttgaaaaataagctttataaatacataaaaaggaacatcatagctcagtagtaaaaacgttgatgcatatggcatttaaagttttaaactatttcatagtaaaaattcatgtgcagatcatcttgaatatgtgacaataaaaattaatttatctaataaagatgattcaagtaaatcaaatctaaattccatactccacatttttgttcgtaaattgtgtgcatccgttataaatattaaaaacatgaatgaaatatacattatgaaaaactcctgctttctctttttggataaaaacattgaaagtttttcagccaggtgcagtggctcacgcctgtaatcccagcactttgggaggccaaggcaggcagatcacgaggtcaggagatcaagaccatcctggttaacacggtgaaacctcatctctgctaaaaataaaaaaaaaagtagccgggtgtggtggcgggcgcctgtagtcccagctactcaggaggctgaggcaggagaatggcgtgaacccaggaggcggagcttgcagtgagccgagattgtgccactgtattccagcctgggagacagagggagattctgtctcacaaaaaaaaaaaaaaaaaaagcttttcaggactccttattagtgctgacttccagttttagttagatctgcttcttgttcttctgcctctttcttttctttgcctgtctacttgtaagtctcttctcaaaagatgcctttatcattgtctttatgaataacagtgaacatttatggaggacctactgtgtggcaggtttgataaatgtaacaataggtcagcgctattttgaggaggaagaaaaatgttgttggaagtgtgcttaactatgctactgtataatcttcacttaaacttctgttataatagaaaggtgattaatgagaccccatgaacctgcctcctcctgtcaaccttttgacgtgtctgcaaatatacagaattttaaaaataacctctcagtgagctagagatagtctcagcttttacagaatggacatgcctgcatcttttaatttagctttctgttagcgtgattccattcttacagattgagcctgagggaaagagagaattattgtcaaaataaatgagataattacatgtgtgtaattttacaaagcgctctacaactgtgtttgtcagtgatgagaaatgcctagttctaaaagttccttgggaaggagtggaatttgaagagttttagatggcaagatgtgtttacttttggttttaaacaaaagtcctagtgtagtgttagggcctggtttttcacagtgataaattgggactttattgctgtatgaatggtggggttttttcccccaaaaattaaatctccttatgtctcttatgaaatctcatttcaaacaagattacaggagtcatttctggtaaaatttggacattaacacacattagtgatttgtgaagatggttgaattttttgtacggagaatttttatactaaattcagtaaatagttctgttgtgccgtgtgccccctagaaaaatcacgtgcctataaagaacttaatagggaaaattgaagataatgattttcctctttggcagttttgtcgctgatttgcaaggtagtaacagggcatttgagttcattttctgttttgtgtgtgccccttccatattgcaaagttacaatttttatttgcttttgtctttttttagtagtctgatttcgagtacctcttaggagttacaaagctgtcaggtacaatatttctcttttaaagactgataagattttcccctttgaatatgctttttctttttaattgtgttacttgatttggataaataagctactccaattgtttggataatgaaataagatgcatatctctgagaaggagactgatttaattcctcgttttcatacatgctgaatatgccttcgtgattcataagagccatttctaatctgcattttgttagggtatttgtcttgcttctaaataaagagaatgaaaacctttttaagttaagactgcattgatggttcaaaaaataaattaaaataaagatgagattgtttaaatctttgattaataagcaagctcataaagttcttgtgaattttaagggaaatagttaaatggatttttcctaaccatttaaaagtctcagaacggaatcattttatagagtatctactggaaagaggaaagtgaatataccacagaagtctttctttataaataaatgaaatcctaaagtcatctgctaatgacttttatactaatgcttttatagttgtgacttgggtaaactgtttaacattttacagcccacggtttcctgttcttaatagtaaagcaaagctatttatttatttatttatttatttatttatttatttaaagtatcttggttttcaacaataaactgtgaaagctggcagctctttgttctaaatcttctgaatatagtccaggtacatttaattttctggaaagcagtgctttcaagtagaatagtgaataattgaatttcccatttgattttagaaaaaaaatgaattcccattgtttactttagccatctgttcatctcccttcttcactgttgtccccttcctgccctttcaaacaagccatagacttggctaactgtagactacagcttctcctcctctctctcaaatgtggaggctcgtagcaaactttgacctatcttcgtaggcaatgtgaaggagaaaagcaataagctctctgcccagagtcagcacattagcatttgagaaatcaggttatctgactttggttgattgagctgcctttgaactgccttagtttccccaaaatgatcattctttgtgagatggaagacaaaagtgattcaaagacacttcattcagaagaaagcacgtaacgctaggtgtggaggctagtgcctgtaatcccagcactttaggaagtggaggcaggaggatggcttgagcccaggagttcaagaccagcctaggcaacatagtgagacctagtctcttaaaaaaaaaaaaaaattttttttttttttaaattagccaggcacaatggctcatgactgtagtctcagctacttgggaggctgaggtaggaggattgcttaaacccagcaggtcaaggctgcagtgagccctgagcaggccaccacactccagcctgggtgacagagcaaaaccttgtctcaaagaaaaacaagaaaaagaagaaagcacacagtttagcagtcatcccaattcctgcctatgtgccagtcaaagaatagtcagatgccaaagagctcatgtggtggtggagttttttttaaatagctttattgagataaaattcacatcccatacaattcactcattcaaaatgtgcacttcagtagctttttatatattcatacagttagcattcatccctacagtcaattatagaacattttataatccccccagaagatgccacaacccttagcatcaccgccaacttctcttcccccagcccttggcaaccactcatctactctctgtctctctacatttgcctgttctggacatttcatataaatggagtcataccatatgttagtacttaattcctttttatgtctgaataacatcatactatatggttttaccatgtttctttgtccattcacaaattgatggatatttgggttattctggctattatgagtaatgcttctgtgaacatttccgtacaagtttttgcatggacatacgttttcatttgtcttgggcgtgtacctaggagtggaattgccgggtcaaatggtaactatgtttaaccgtttgaggagcagccagactcttttccaaagcacctgcaaccactttacatacctatccacaatgtgtgaaagttccagtacgggctgggcgcggtggctcacaccagtaatcccaacactttgggaggccgaggcgtgtagatcacgaggtcaggagattgaggctatcctggccaacatggtgaaactccatctctacttaaaatataaaaaatgagctgggtgcattggcacgcatatgttagctactcaggaggctgaggcaggagaatcgcttgaacctgggaggcggaggttgcagtgagccgagatcacaccactgcactccagcctggagacagagagagactccatctcaaaaaaaaaaaaaaaagttgcagtacctccacatcctggccaacacatgttaccatctgacattttggttccagccccatttcacacccactggtatgaaatgctatctcattgtggttttggtttgcgtgttgattccagcctcatttcacaccagtgtgatgtctcgttgtggttttgatttgcatttccctaacggctttgatgctggacatcttatccatgtgcttactcacatattttaatattattagttacaatgccttgcaagctaatgcttgccaccatggtatctttgagactgttactcagaagtattgactgacatgtgccatgtagtaacccctggagctggaaggagcttgaggccctgcctcggtgacatacagggtaggaggaaggaaaaaaacactttaaatatatgaaataaagtgttcggggagctacgatggaagtgtgtgcggggaccaatgggaacatcagggtggaagggtttgattctgctggagagaagggacttgatcggggcaaaagagtcagagaggaggtgatggttcatctgtaaacaatgatgtttcagtcattgaaccaagaaggaggataccaggatgaataaaccacggctcctgactgtacggatagtgagcaggggctgttttgagtcttgattcttgacagttaagatgtttgaggccacagttgaacacagcgttcctgacctggtgtctttctcctttactgaaaccctcccaaatggggaacgggctttctcctatcactcagaaggggtgggatatcacaaaacaccagaatgagagctgtgcccagtggttccagaaactgctttcttgctgttgcttttgttgtagttgtggtttctgttttgaatgcacatttatatatgtatgtgtgtgtgtgtgtgtgtgtgtgtgtgtatatatatatacacatatatgtatatacacatatatatacacatatatgtatatacacatatatatacacatatatgtatatacacatatatatacacatatatgtatatacacatatatatacacatatgtgtatatacacatatatatacatatatgtgtatatacatatatgtatatacacatatatgtatatatacgtatatattttaaaaccttctagacaaaatgtgacttgtttttgttgttttttttgtgacagagtctcgctctgtcgtccaggctggagtgcagtggcgtgatctcggcttactgcaacctccgcctcccgagttcaagtgattctcctgcctcagcctcccaagtagttgggattacaggtgtgcgccacacgcctggctaatttttgtgtttttagtagagatgaggttttgccatgttgcccagcctggtcctgaactcctgagctcaagcgatccgcccgcctcagcttcccaaagtgctgggattacagcgtgagccaccgcacccagccacattgtgacttgtaatctttgatttatgagagatgaagtgactatcctaggtctgttgcatacatgaaagaaattttttcttttggaaaagtttattttccaatgaaatgtttggattttcaggatttttcattattatgattcattctttttctgatatcttctatgacattttggaggaaaagatgagcttttgggaaacatgcaaacaaacaaaaccacctttggtactaaatctcacctagaatgaatacttctgcattttaaaaactctccaagatatggtttaaaagatgagagtagaagtgaccttcaccaaccttgctagcccaaatccttatttatgtttacgaaatttgcaactctgacatgatattttagaaagccatataaaatgattttgcccattggttatggtgtttaatggcttaaggaaaaatatatttgtatcttgaaacttctggacccattccaacaagactgctttttcccccctttaagatatatgaggaagcgtgttgagaaatcagagctattaaatattatcatacaatttccttgatttcattttcttgcagataaaattagaccaggaatatagggttttctggaatgctttcatgaaaaaataggtgattgcagaaatgccatgaaataattaaatctcaattatttgtactggtgttttcttaaatgtaatttaacctgtcacaatacacatttttgcttatcagatcacttttattaataggattgagaaaatgttcactcttacttcctcctgctatgaatattgctctcctgttcaccataaatattccctttccttttcttctttctgcagatccatttagcgggcaaaatcagaacactgcgctatgtgtggcagttaatgccacaggtctgggagacccagagcctggtttctgttctagagtcactactttttagctgtatgaccttgagcaagacctttaagttctcttagggctcaatttcctcttccgtaacatgtaaagtctgttatagcacatatatccaagcactactttgaagaataataagatagtgcagaaaaacacacacagccaggtatctggcacgtgggaaatgccactcacgtaatgtgtaatcaccgtatttgtggttatgtctccttagggtaggaaaggggagtgtttaaattcagatccctcagactatcgagaaacatgtttgttgtggagatgactcactttgaaaacatgaacttcctatataatttgtaagtcattttcattggggagcatagtagtgagttgtagataggaattgcctcagcttatagttattgacagctttgcaggtgccaaatacagctctagggactatataatcactcttcagtaaccataggggattggttctaggacccccccccaccaccctctgcccaccttacaataccaaaatctgcagatgcttaagtccctgaaataaaatggtgtatttgcatgtaacctatgcacatcctcccctatacttgaaatcatctctggattacttgtaatacccaatatgatgtcaacgttatgtaaatagttgttacactgtattggttagagaataatgacaagtttttttaaaaaaaaaaatcttcacttgttcagtacagacgcagccatccattgttttttctttgagtattttttttatttggagttgactgggcttgcagacatgaagggctgaatatacttgcattctctactttagccttaacagcgaccctttaaggcaggtgctcttagtatgcgcatttggagaaccatgttccaagtctgttatgtagatttggaaactgagacacagaaaagttagctaactttcccaagatcacagagttaataaaggcagataggtaactctatgggctgttttgcatactgctcactttatgttatgtgagtgagagtgaatatgaaatacaaggtgtttgtcattttaattcttggaaggaggagaagtaaggcaataagagttccaatatacttgtttctaacctaattttgtatgtaatatataatttatatattttaagtcatgcattcattattataaataaagcttctgcccacaaagtactaagttaataatctagccaattttttaatgtatgagcattatttatgtactgaaaataacttttacatcttcaaagtatctactaggaatcattgaagcaaagggtagctatcatttttaaggcaatgatggtatttcatgtctcagtaacagatcacatcttccatgctcttctataaattgttatttatgtgtttgaagtcatccagacaaatccatatcacccccatagctgggcattactgagttcatatactgtattatgattattaaataaactagttctgtacagattcacaactgtccttcaaggtgatatctctacatagccgtgctgttttacaaatcccatcattatgaaaatattaattttttttgtctcctaagtaaagtaagcagtaaacacttgtacttatcaaaaaggacttgttaacatttcacctcttaaaattaacattttaattataagcattggtagttttttgttttgacttgttatttaaagaataagcatgaaattttactgtacataaattatacttcaataaacctggcttttagaaggcaaaggaatgcataactattggaaaggttgagactggcgaagaagtatgcataaattcaaaacggaatttacaaggattttgtttgatgcggtggttagtcttttggaaataggtttaagattagtgcttttacatacataatatatgatttcagggtccatttagagaatatttatctgtatgactagaagagaatgttacaaattgaattttaagaataatgctctaattttacataacgccaagcatgatgtttctttgtttacctaccatattaaaagacatgccatcctggatatcattaatggccaaaaaacttaagacgaaagtggctcttcccccagcatgcagcagacagtctatgaaaaatcactgataggaaaggttagagactcaaaaatctatcactggtaatagattcctattgctaaccagagtccaaggtgagaagctggcattggtgcagtttctgcctgcaagatgccctctgtgggtctccgcagagcagcacgttgtttttctacagcttctctggattatcctgtttggttttgcatacatttattaccatgtcccttgcctcttttcctcctccctacctgcctgccttagctcatctcactgtttttttcagtaacgttattacagagaaagtggatttcagtattcctctctatcaggtgatgcgtcaggtgacagagaaaatcagaatcagactgaaatcagactgctgcctgttatcaattccatctctgtttccatatcctaaaaaaatcaagagcagcaggatgtttttataaacctgtaataccaagtttatgaaagttagctgaatcttagattgtcagcgctaaaaggaatcctgtgggacacttttcacacttggagcagccagcttgtcagagggtcctgggccaggttccaggccctgctgcccgctctgctacatggatcaggtttctgatgccttaccctgctcagagccaaactgtacaacccagcccgtgccttcctgctctcctgcctggatgggaagtcggtctgctgtgaaagtgggcacgactgctactggatgtgaacctgggatgaatatccctgggtagtagcagaagttgaagaattacccaggctttcaggctccaagtcacattctgggaaggcaggggctgttgttggcaatggaaatctggcctgagagtttcagagagccaggttcattaatgggcccacccaagccctggctgtgtgcttgtcctaataaagatgtacttacaacaaccaattccatatgcagatgtgagtgtgggtgtgtgaataacctttttaatttttttttttttttttgagataaagtctcaccctgttgcccacgctggagtgcagtggcacagtctcggcttactgcaacctccgcctcttgggttcatacgagtcttctgcctcagcctcccgagtagctgggactacaggtgcctgtcaccacgcccggttaattttttgtatttttagtagagatgggtttccaccatgttggccaggctgaaactttttaaagtcttcaatctgctttgaggaaacaaacaacctgaaaacataaccaattagttggtggactgtagtgttgtcaggtgattccatttgtgatcctagagcctgagtgtttattttatttcattttaagttccagggtacatgggcaggaagtgcaggtttgttacataggtaaacgtgtgccatggtggactgctgcacctgtcaacccatcacctgagtattaagcacaacatgcattagctagttttcctgacgtagagcctgactttaatggtggccatggtgggaacaatgatactacaagccttcttccctaataataatgctgtgggaggacccattgttcaattccattctttcagtcgcagcattgcctcagaacctgtttcatgtttatgacaggcccttggctaagggattcagtggtgcctgaagacagggagcttcataaatagatgtaagctcaaagcatggtgaatcaggctgtgctatgagagcttgtaacaggggacccaacagccagctgaacccctgaagaggggcaggagctaaccaggtgaaggaatgagaaggcaggtaccatccgggtgtgagcctggaaggcattcccagcagagaaaagcacacatgcgaaggccctgtggcagcagggggtaaggcccatttgagaaattgactatgcttggagtagtcaccagtggtcccagggaaggtcagaatgcaagcaggggctaccttattccaggcccagtggcccatgttcaggatttttatcctctagtagcaaatgtgaaagggcaggggtgtgatcagattgactttttgaaaagattgctttagactctgtgcatagaatgaggtggagaggccggttgctaggctatttcaggagccagatgagagacagtggaaactcagaccagggggatgatgaagaggttaacaaagttacttagggttgagaatttggcagcacctaagtgatgattagataagaggaggtgtgaaatatcaagggttgtttctcggggttatgctcccaccacaggcaaaataaatacaggatctaaaattaaaaatgcaattctaaatgaccagagtccagcatttatcctctttctctccctctccttccttctttctccttttccttccctctcttcccctgtcataatttttctgattttctggtttaaactcaggcagaaagattgggtacttctaaagaaactttggaaactttggcccataactttgtagatacccaatgctagatcggttcccattaatatgaaatggaattttgatatgaaacctttctaaaatatattgtctcatttatattaaaaagcatacaacttctgagcatttatttgaagctcgctggtgagataaaacatgagctggctgggttgtttctaggtgctaaaccaaatgtccgcttgaattgcggtgttgctgtaaatatttccaggcacagacagatagatgcaataggaaaaacctgaacaaattcttaggatgccaatattgtcacaaagtctccatgcagaatgaagttgtttgacaaagtgtttccctggtgatttggctgcagatgaaaatgtctttggcaataaaatttcatgcccgagtctcagctctgtgctctcatcagtcaacaaatgacatatcaaggatcccttttgctgtattagttaatatgttggcagaaatatgtgaaacattgttattcccctccagttctgtgcatagatttgtttctacctttaaacccgcattaattgtaccaaaatattttgccagctataatttaatactaatcaataggattgccttagaacagagataaaaggttctttattacaagggttctcttacttcaccagtattagaagatataatagtaagggctgctgttttgccatcgtttgaaaatggtttgagggaaatttaaggattggtaaggcaattagtagtgaagcatattttaattatagtaactggataagctgctttcagctttatggattaatacgttattgtttaataggccggagtcacgtgtgattttgatcacacttctcactgtagccacagttttattagcagtggtgttttataacttaataatttatacataatgagttcagaagttccatttacatgatatccaagaaataatttaccccatacattaccactcgtcaacaggaaagaagtccttcaggatcacaacgaaataactgtccgagattgttttgcattaaaggatacttttaataatgagatcattttacactgcattatgttatttctgttgatgccaagtctgggttttacaaagtcatttaaaacacaggaggaagatgaatcacaataatttcacacatatttaataagcatgaattatccactgaagtctacatccattctttaagttgtgaaaaccataaggtgtttgagttaatgctctgttgtagaattttctcgtctagcgcggccctcctccgtgcaccccaccattcccgccaggcctcctcgcatttcagaagctgttatatggacgagattgagctgtgtgtattttaatgacacgtgtgtcatggtttagcttagggtttgcaaagcctctgtatatgctagcctctgggcatccattaccatctccgagaacacagtctcatctcatccaaaacgaacctctcaaagagccccctgtgaggacaccttggggcccctgtccttgtgcggaagcaaagaaactaacactcggtgattgactactttacagcagatgccgtgctagtttatacttgtcattttcctaaggattttttttgaactcataaacccactggggtttcagttctgcaaagtcttttgaggccacgatgtgtgatattgcagaatcttttggcggggatgatctgcgtaagacacaaggatgttaaaaggtactacacacatgcgcgcgaaaaaaaggcattacgttcaaatgagcttggaaaccttggcgagactgttttctgatatgcagttgtacatcatgagtgtccagggagccgacccagcttgcagcatttcccaaacttaattgaccatagaaccctttttggaagagtagcttaacttcaagttctttgcctataaaatatataaatctaaatcaaaatatatgaaaaagtacatcgctacaatcttctggccaccactcaaattttatcagggcagaaaagacaaggtatgttcaggtgatttacaagctggaaagtaccataaaaatgcaacagatgatgatttttttctcctttggtctttttggaaacagtgtggaagaaatgatgtgcccatgctttaattgttcagagtctagggatgcgggtactgttctttgtgttcctttattcttcctatccaactctcctctctgctaggaaaatcactttttttttttttgaggatccatattactaattgcagaaaattgccgttagtcagcgcttggtcttgagttctcattttaagtggctttactagtcatgtttacgcggtcatctaaatgctcactcttataatgcctagaatggcttctcttcataatggggccctatgattatctgtgtgttccctctgttttccatgctctgcttttccagcatggcctaaggtttactaaaagaacaaaactaaaaaacagggagtcttgtgtcttacacagatcatccccgcctaaggattctccagtatcacacatcatggcctgaaaagacttcgcagaactgaaactccagtgggtttatgagttaaaaaaaaaaaaaaaatccttaggaaaatgacaagtataaactagcacggcgtccactcttaagggagtcaggatgggggagcaaagttcactgcagattccccgctgcacaggttggtagatggcaggcccctgcgtaaaccccattttggtccaacctcctgatccctcctgtctaactagtttacactcacagtggcatgttcatgaatgtttactgaattaacagataactgtggatatcataaaagtgctctttttatttcatgtgggggcaagattgaatttcttcatggtttgatttggtgcagttgaaactgcttatggtggcttggagagcagtggcctcagctagctaatttgttaataatgtggtttatctgtaatgctttggttgcaggaaataaaggaacatgttccactcaatacaagcatagccgtttttttattattcattcatttattcagccaatatttatagtgcctgtttcttacaaaagggaataaaatacagaatccctgtcctcatgcagtttggagtctagtggggagacaaacagtgaacagatggctgtgtattgtgcccaatggtgggtgataagaatgtgaggggtaggggatgtgagggaaggagattgcgcagttatagcggatcaaagaagacctcagagacctaaaggatgtgcagaaatttagagaaagaatgtttcagacagtgggactggcaagtgcacccaccctgccccccagggataagcagcttcacacaggagagagctaggagacagatcagataggaggtctcctgcaccatttgaaggagtttggcctttgttcacaaggagacccgaaagcctgggtgggttttaagcaaaagagtgacaagatcagagtaattttttcaaaatgatcactgctacaaggaggtaaaaagggaagcgcagaaaacaggaggcaactgcaatcatccaggcaagagctgaaagtggcttggcccagagtgccaaccacagacaggatgagaagtcgtaaaatgctaggtatttattcgaagcgggagagggacagagtttggcaaagaattggatgtaggttgggagagaaggagaggagtcagggctcactttatattttagctgagcgacttgaagaatgatgttggcattactaagatgggggaatattgagagtgaacagatttgaaggagggggcagtttggggatagttaaaggtgagctgcctccagatatctaagtggagatattcagtaggcaggtggctctaggcatctggaggcaggattgagatcttggctggagatagagatgtgttgttggttgataatgatgagtctggaagagatcacttagcaagtgagtataaaaagaagagaagtacttcatacaccaagcctggaggcaccagcagcaagagaagagactagcacaggaaactgaggaggagcagccagtcatgaagaaaaccgagagggcgcagtgtcctggaaaccaagggagttgagtatctccagaagataaacgttgttcgctttgcccactgctgttgatgactggagtaacattaagagggagaggttgcctttggagttgaggatgtggaggtcctagcaaggccaggagctggctttggtgacgaaatggggctagaagcttacccgtgatgggtacaacatggataagcccttgaagagtttattccaagtgaaggcaaataaattgcaattgctggaagaggatgtagggttaaggaatggtgtttttaagaaaggcagtagcacaatgtgtcttttgtaattgcagttggctaacagagtggggacaatgaggtaggagataggaccagttgctgggacagtatcattttgcagagaaaagggattgggatcttgaatgccagtggagggactggccttggccagagtcccagcgacaggggaaaaggcagaatgtatagtagcagcatggtaggctgctaagggtgtggggaccagacagaagttctctttggagtgtttcggttttctcagtgaaatacgaagcagggttatcagctagctgagagggaggatggaggagaaagtattatcatattagagttttgcagagagaggaaaggatatgaaatagttggttagcagagggatagagaatggactgaagaagaaaagtagaaagatgataattcaagaggtgataactcaagaaaattgaagtttctcttctcattgctgcatcaggagaatttggtttggatattggcaaaagcagccaatattccattgcacatgtataccacaatttgtgtatttcatttgcctatattgggcatgattgttatttccagtaggaggctgttacgaatacagctgctgtgaacattcatttatggacgtccgttttcttcccagaagcagaatggctgggtcatagaataggtatataataacttggtaagaaactgccaaacaattttctgaagtagttgttctgtaaaagtaaccaggcaaatgtttcagccctgaagatagaaaatgagctataataaatgaaaagtagaaatttacaagttagaaatttagatagaatttctatcactatagaaagtcagcttctgtcgtttctacttagccacagctaagtcttagcaaatcttaggaacatcaccgaacatccatggactcaatttccttaggtaattgaggtaactgggtgacctgtaaggtcccttccagaccccacattctttgatttttggtggaattgtgccaaatggtaatggatagaaagacacctctgtgtacatttttatcccatgggagttgagcagcatttaatatactggacacagtaagaaaaaatctagaacataagatgcagaggcaaaaggatgaggctgctacaaagtatatacttttgtgtgaaaatcacatattctttcaaaaaaccattgtaaggtgatacaggactctactcgtgtgtaaaaagttatatacctatgaatagctccaattctgttttaattataacaaataccgggagatgcatttggatggtttgaggaaaaaaaggttgcgcatccactgtttggaatcttgtggcttgttttgaagccagcgtaacaaaacatttgcctctattacttttgcagtactgctgggcaagtgttttgtctgcctgggctctctctagccaggagagaagaaatttctgtttcctcccaccagacagagtcggtagccccagggccatctttgcgctagctctggtctgtaaatgtatctaaataagccttgctataaatctttctctgttaatcttctagctgttcccaaacttcagcactgcctggtgaaggtgtacttcgccaaagactgaggagtcatggttcacttggtggaagctgtctgataaatagaggatgctggaaaagacagattgaacgtcagtgtgagatcgtgcactgccgtaatctgtctttcaggttaatgagaattaggaattgggaggggaaaaccagttggagatagctccgaaccaggtggtgatcagtggtggaggtagatgtccaatcggtctcggtcacccttcggggtccaggggttgtgagatcctgacccacccagggcaggacaaatgccctctgcttgtcactgcctttttggaagggactctgaggagtgtgagcattgaaaagtacacagaagcccatggaatcgtggagttaagacagtggaggtcacttaggccaaactcttgacctgggtggagtccttttcacggcctccctgagctggttgtcgtctggcccctgcttgaatacccccagtgacctgggactcaccacctcaacatagtcactgtataggactcaggcattccagaacattccttgaggactcagtctcaccacaccagtgctgaataacctttcttccatgataagaagaaagactaaagctagcttggggtaacagctctggatgtttttttttcctctccccaggtggggatgggtgttggacacaataagcattttatttctgttttttcttggaggcacaaattaacattttttcctacccaggggccatcataccctaagctgtgctgatttttaaattggtctatagagacaactcgtttcccatgttcggctgatgctctccatagctacccaaaagtccatttatttgtaactctaaagcaatgactcccagccacagcaatttcacacacacccccactcccgctggggacacttggcgctctctggagacactttggttcccacagctggtgtgggggtgctattgatatccagtgggtaacagccgggggtgctgataaagaccctacagttcacaggacagccccccaaaacaaagaatgatttgacccagaacatctcagtgccaaggctgagaaactctagtctaaaggtaccataaatagccaaccagtaggaccatctgcatttatatttgtcttcagggtttttttttaaattttgttgtttgagatgggatctcactcaggctggagtgcagtggcatgatcttggctcactgcaacctctgcctcccaggcttcagagatcctcccatctcagcctccctaggaggtaggacgtgtacagatgtgcaccaccacacccagctatttttttttgtattcttggtagagacgaggttttgccatgttgctcagtctggtctcaaacccctgagctcaagtgatatgcccatctcggcctctcaaagtgcttggattacaggtgtgagccaccacactcggcctgtctttagggttcttacagaagagtttgtgtagaagcaagcagtttgctgtagaaagaattcgtggaaaatcaggtgttgtggggcatggtggttgtgataggatgcaggggcactgcagtttgccagctttcaaccataactttcctcacagattggtggatatctttgaatcataattaggagcttttttttaaaaggtctctcgggttttgtaagacacgtccaacttattactaataaaccaaggaggtatctgttaccttcaattagaggagaagacagcacggagtcccaatcaaagagttttaaaaggccttgttttttcaatagcttattcatccagtttaagaaagcaatttctttgctgtagtttatggagaattctaaatctggtaaatcgtttattgcttcataggggtttgctttggttgatctcatgtatgtaccagggaagaccaaaaatattttttttgaaaaaacatgtgaggtcatgttttttctccttgactttagaagacaaagataatgatgcaagtgttgctatatggtggtgagatgatgacagacagaggcactgggtcattcccacacccgctttctggggtagggcccatgctgagagaggaggtggaagagcttgtcagtcaaggcagcagctaatttcactgagctccaggactctacggactcttccagaatcaatcacatttgccatgaacatcaggtccccttgtcccccatccccatgaccgagaccaatccaaacttgaaaatggatgaaatcaacatttctggggtgccccctctgtgctggccttatctgtggcttggtacaagatcctagaatgggaacaagaggtgtgcactccttagggacaaagaagttggggcaaggaaggagtcctgggcctaccatgtgctgtcacttggcaacataagaccagcagtataaacaaaggactgtgggattctgaattgtcccaccaggtaaaatcctctttttcttttctggcttgtaagcataatgattgagtgacacttttcacttttaaaatgaaaatggcaaaacttaaatgagggagtttttgttaagtcgtggtggcccagttggagtttaaagatgttctagggcacagtacagggatcctcctccaattgtgtgattattttttcccccatggtaaaagtcacgccgtgtttcccctccttgtgaggctcatggaaacacacagccgaggttctgatggtggccaccgctggacaagcgcactctctgagatgtggccatgtccctgccgtgctaacaggccccagtgccagtgcgccctgggcttatttgtggcttaaatcatctcagcaccctgaattcttccctctggagacacgctcggaaccgtccccccaattgatgacattgcagctgtcatgcaagagcttgccttcacatctctcctgtggaacgtgacagttttctctgtgatggccaaattaattattagaaatggtttgctagcagacagttggatgctgattacgattggaaccttagggaccctggaacccaaatgtgttgatgtttgttgttgctgagaaaaatgaaaaaccataaaataagaaagaaatgtttttaaactgaaaacaatgcagattaagccaggaaacttttggactgagttaactgagatctgagtgaaatctacccaaacccttgctcgcagtgagaaggtttagagaagtggttaattagttgctactttctgttagagaggggattgagcttggctatttctatgtaaagcaaaaagactggcattgattaaattggagatgacatttgggaggtgttctcagaatatctaagtttgattatctaatttgccttcatactgtgtcctgggtttgtgaagcctttctagcaagtaccacccaggaagaaatattttcaattaaatggatcatgaccactgcagaaggaatcatgaaacgcacctgtagcgtggggtcatggtgtgaacaaagctgccaggctcacaaagagacagtctgggagtcggctgtgctaatgccagctttgagcatcatttcactccttcccatcaacagttccattaatgagatacagagatgaaggcaggcagatacttcatggagctgtgtgacgcaagattgatgctgtcaccagctctcattggaacgaataagaaagaggccgacagacccttgatcattagaagggctgataatctattgtgagtttgtcaaaagaggaggaagaagatcaaatattagtggagaaagaacacagagtaaagaacacgatggaaacttcctaatcattttgtgtagttatgaaatgggtagctttatttagcaacacatatgatatgatacaggcaatattccaagcatgcattctagagtaatctttaataaataagtaaacaaaggccagggcggtggcttgcacctgttgtaatcccagcactttgagaggccgatgcaggaggatcacttgagcccaggagtttgagaccagcctgagcaacatggtgagaagccgcctttcaaaaaataaaaaaaaaaatttaaaaactttaaaaagtaaacaaagagcatccataaatacttttttggggattccgtgggattttttaatagtcatttttttctcaaagagagttaagtaatttataatttcttgttaaatgagggtggctgttataacagtataaaaaataagttttgtctaatgttgcagctcaatcgttattcatcatacaggactgtctggtggcagacacagaaatttccccttagtgtcacctgtggatgcagcaggtcagtgagttcccccacttcctttagagacacgtgaaccactctaaatactgtcatttctcagggaaaatttacacagaggtaatgacagatacataaattccattgttccagagcagaacaagtatggttgagggaggaatgatgttataagaaactgctttacagtccctgagattcttttccaattacatttagggttgaattttcagatactttttgttgcatccaaggaaggaattttaggggaattatatttattaaatctcatttttctttgcttcatccagcttttccttgatacttttaattcttaccatgcagtaattcagtgacctcaattctccctcccctgagccagaaaggaaagccctctgtgtttaaacagactcagagcctcctgcctgtcctagttctgcagaaaggaagctgcacctttacagagcccctcttggcacaggtagagattggcagttcggtcctgttcaaaaggttaaggagggtaggggccggttcagcagcataaacatctgatactcaagtagggtctcccaaacagcagcatcgatatcacctggtaacttgtcagaaatgcagagtctgaggccccaccccagacccaccgcatcagaatctgcatgtgcacagggtccccaggcaattcctatgcacactgaagtgtggagagctctgcaggtctagcaggctcccaggcagactccaagctgatagacacaggaacacagcctgagtttcactccatggcagcggtgttgatagtgctgtggccaagagtgatgcatttgaggaatatatgaggaatggaggacagtgaggagggatgaaaatgacctgaacacacaagcaaagctgtaaaagtgaaaaatctctcttcatggaccttgctgcttgtgtggttgagggagaatttttttcccaccgttggagaagaaattcattctacattgattgactggaaggtcaaacaatgaacgaaaagtaagaattaatttaaaaaaaggagagagagagggaggcaaaaacttaattataaaccaaggttctcatgttcggctaaactacagggcactttgccccatattttttccctgtaagttcacatttcttataaaacaactacaaagtaaaaaaatcgtatgtgtcatataaaacaattatttgtgtctcttgttgagaaaaaatatacagcatgcattaacaaatgcctttcctttctcatgtagttgtttattgagtttaaagtgtaaaatttcttgcagtttgtttattctaactaataagtgaacttgacacctcactttcacagaaagttaaatgatgtggtcagtgatgtttttaagatttatatcgaaagaaattaagtattaggtacacgacttaaattgattagaaggtaaatcgaatctactgagaagtgtgagcatataagtatgttagcacgtggtatgaataatgtgttctgatatggaggaagatgacatagtctttgattttataatgcgctgatattcttacagaaggtcaaagcaaatcaaagtgttgcaagaatgttcaaaactatccaccctaacttctaggatcatgttctccaaactgctaattaatgaaaagtcagcttcatatattgagatgtttaatcaattggcagattgttgtcaataaatatgtgtcgtaagtggtttgtaatagacaggctaatgaagtaccctctgtgagtgtcagagctatttggaaaaatctctctcccttctgggcggtttgccatacgttattagtctccctctaactcaaggaagagtgcccttcaacatcgctggtctcgcctctggatggaggagctggagaagcagaaagtaaatttcattttctactagcagttagtcaagcaacaggaggcggaaagaagggtggctactgataatattaatgatcatcagagaagccaacatttcttaggcagttgcttctatatgtgctggactccgcagtcagtaccataattcggttacttcttttttttttttttttttttgtattgagatggagtttcactcttgttgcccaggccggagggcaatggcgcaatcttggctcactgcaatctctgcctctcagattcaagcgattctcctgcctcagcctcctgagtagctgggattacaggcatgcaccaccatccatgcctggctgattttttgtatttagtagagacagggtttcaccattttggttaggctggtctcgaactcctaacctcaagtgatccacctgcctcggtctcccaaagtgctgggattacaggtgtgagccaccatgcctggccaataattgttacttcttaatcttcactctatgagaaagattctgcaacctctcagatccttcattacaaacatttttgtcatgccactacaatgctgaaatagatcttgtagctaacataacctactctacacgtaattgttttaaaagtcattataattccccaactataacataatgaagaaataaagggaatagaattgactgttgagtacattcaatatataagttacttgtttctggctataacggagggaagtaatagacatttgcatctgtgcatagaaatcctgcgaatctaacagctgtaactgcagactgatagcgaagtgatgttctagctactcacactagaactggtcgtcctgtcagtgaagtgatattataaattggtgaatacttcttagaaaagttccccaaattcagtctcacctcatttgcacaggaatatcagtatacattcttactggccagaaaatgctttgcattcacatataaaacagatttaggttctaggcacaaatatttgtaaacaggattttcgtttccacgactacccactgggacatcgagaaggtatgcagcctgggagaccactcccaatgctccaggcctggcttattcatgaaagacatctggcatccaaaccttcattcaataaatactagtagaatcccccatacatgagatcgatcatgaactgccctatagatttccaaaagtctacagtgaagcgttgccaccccatgagaccaggccactaggattttcatttctccttttcagatgtggcaactgaagcttcagtagtttccccaaagacaaagagctaggaggtagaggagttgggattcagactctgatctgtctgaccccagaatctctgcatttaacccactgttccatcctccccagtgcatccagacaggccaacattgccacagaagagcccgagtaggcttactggatcattttttagaattgtgcttatgaaaaggaaaaggattgatcaggcatggtggcgcattcccataatcccagcactttgggaggccaagagttcaagaccagcctgggcaacatagggagaatctgtgtctataaaacataaaaaaacaagttagccaggtgtggtggcatgcacctgtggccccagctcctcaggaggcctaggtgggaggatcacttgatcccaggagttcaagaccagcccagacaacatagggagaccctgtctctacaaaaaatttaaaataacaaattagctggacgtggtggcatgcacctttagtcccagctattcaggaggcgagatgggaggatcacttaagcctgggaggatgaggctgcactgagtcctgatcgcatcattggcactccagcctgggcaacggagtgagaccttgtctcaaaaaaaaaaaaagaaaaaaggaaaaggattggttgaaatgcactgagcgcccatcccatctcttgccagctgtaataccatgccccagtgttttgtgtatgttaccgaatgttcacaacagccctgcagtgtagttagttgtgagtaatcccttttcacaaacaggaagcctgagtctgagccctttccccagtcaaccagcctatgagaagaactggattgatttcaatcttgtgttgacttcaaagcccaacctcttgctcctactccttagaccagaatgggccctcaagaggatgggtgtgtataacctgttgatgccattcacccacctcgtcttgatttccgtccactttctttctcattacctgataagtaaggtgagcaaataatttattggccaggcaaagacatttttgagactgacaggggacacttccaccaggacattgatgtgggtcactcagtgatgcctgtttcagggccttgaagcaggtagcagccttaccaagtcatggttgatgcttctgtacagagttggaaacgtgtcgtgggtttcccgatcagaacgcactggggaccctgccgtcacaggaacaccgctttgcttctttcagtgaatgcatgattatcttgaggatggtgagatttttctgttgagatcttttctagtttaaaaagtccccactgttttcgtgaggcagggataggtgagcctccggccatcatgagagtgggtaggggcgggcctggtgaagacaaaccagaccccacgagacagaagctcttcccagttggtgactgggagagagtctgcttcccaagtccagtctggctcacttcctctcaggagcaggacaagagaaggcttccttcagcttacatgaaaagcttgcagtaaaagagtacaagtgacggattctgcctgaatttccccaagtttctgcacttgtctttgtttattatattaataaatactatgcagctaatgttcccatctggcagggcagagaaaagagcataaaaatgaagttgtggctacatcacttaaatactaatgaaggtgatacccacttggcatggtggaaaggtgggtctttattttagagttcttaattaagaactgcaaagtgactaatattaattaggaagccagctgtagccttcagtttcatggtatatttcttcttaggaacctgtgacgggagtcagtctgaactttttttaatcaatcagcccatgagcaattacctattaaatataccttgtgtgcatgggaccagactatgtggacagagatttgtaagattctgtctttgccttcagaatctccacctaatcaaagagtgtgcacagatagagagccagtatttcagagagagaggtcaaagcattttcacaacactatgagtgaataagagaagtgtcgcattatgggggtcagggagcttttcaaactacactggtgcccttcctgctctggggttgcagtagtgagctagtgtaagtgatgggagggtatcatacccctgggagtctggggcacaagggtggttacggaccacctggcaggctgaaagctggagttcagagggaggattgacagtcatgggcagaaatagttgggatggctagaactgggctctcaggaggagggatcatatttccaaaaggtgaggagtgatgggcagccacagaggtggaaggaaagaggttagggcagtgggaccagaaagggaagtaactggcattgagctgggatgtctactccagcccttcagctctcagtcggtctaccagccattacattattgatattgttgactctgttcacacttacagacacacacacacatgtgcaagcttggcctcctgcagggacctgataccctgagctagagggcggggaagtggtcaaagaggggactcaatacactatgtgtagttgacatgaccacccagcacgtcataaaattgtacctagaacaatacctagttatgggtaatccctttttacaaacagaagactgaatgtgagcccttagactgagaagcagaactgggtttcatactcattttgacttcagagcccaaggtctaagatctaaggagccaggagcaagagctcaaaaagaagcaccttaaaacctatgttttaatgtctcttgacactgatgtattaatatccactgaattctagtttcttgaatctcttgtaactggagaagggttttatgaagataagttgtaatgaggggccaacaaacatgaaaaaatactcgacagcactaatcattagagaaatgcaagttaaaaccacagtgagatactatctcacaccagtcagaatggctgttattaaaatgtcaaaaaacaacatgctggcgaggctgcagagaacacggaatggttatatactgctggtgggaatatgagttagttcaatcactgtgaaaagcagtttggagattactggaacttaaaacagaattaccattcaacccagcaatcccattggtgggtatatatctaaaagaaatcattctcccataaagacacatacactcgtgtgtttgttgcagcactattcacaatagcaaaggcatggaatcaacctgggtgcccatcggtgctggatttgatgaaaagaatgtgatgcatatataccactgaatactacacagccataaaagaatgagattacatcctttgcagcaacatatggagctggaggccattatcctaagcgaattaacacagaaacagaaaaccagattactgcatgttctcacctataagtgggagctaaacattggtcttcatggacaaaaaaatggcaaccatagaaactgagggctactagaggcaggtgggagagagggagcaaggtttgaaaaactattgaaaaactattctcagtacatggtcaatgggttcattagtaccccaaactcagcatcacacattttgtccaggtgacaaatctctacatggaccccctgaatctaaaatgaaagttgggggaaaaaaaaaagattagaatgtactttttcttgatttacacagtgtgttaattattacagtttttttcaagttgagttgtagtctcacatgcagctctctcctaatttcatacttagacattcagatcattgaattgtatctgcaaaattgcagttcttttaaattagcttgccagagcgctgtgggtcctgttcaggggccctgaggccaggcagtctgtgactctgcttgctccttgataaactttcatgagtagcatttattttaaatcatccaagaacacctcaagggcaaggatccttaaccttgatcctgggccgtggtgattcacaaaggcttatcctttgtagatttaggctcatctttcagggagctcagtttgatatgcttttctctcctcgaactctgccattcaacattttttttcccatatctattctcactgagtgctaattttagttcaggttgcacctgtgtgtatgtgtgtgtgtaaaccctctgtagccctagtttatagcctttttcaataaaatcacatatccagagaaattgtttttccacatgagcactttttcagagtgttttccagaactctgcctgctgttctaaagtcaacatcagttgccctctttagaacgcttccctaatgcaatggttctgaaatccctgaatatattgttacaagcacagttctcttcagaaaaagaaaccttggaaatggtggatctatgcttttgtttttcattttggagcttggagaagtttgttgacctcacgtcatcatcagcctccagttgaatctgttaaacagccaatgtgaatagtatctatataaaaacacaaagtaagcacagaaacactttttcaggggaggtattttgtcatattgaaacagcacctgtattggggttttaaaattttaatttttgtgggcatttagtaggtatgtatatttatggggtacatgagttgttttgatacaggcatgcagtacaaaataatcagagcatggagaatggagtatccattccctcaagcaaggcacctgtattgttataatgtttttcctttaataagttcagttctcaaatttatttctaaaaaactatagcagtattctaaatgaaaactaggtttaatttgctatcaataaaattacatacatagtcattgatatggtttggctgtgtccccacccaagtctcatcttgaattgtagctcccataatccccatgtgtcgtgggagggacccagtgggaggtaactgaatcatgggtggcaggtttttcccatgctgttcttgtgatagtgaataagtctcatgagatctgatggttttataaagaggggttccccagcacaagctttcttgcctgccgccatgtaagatgtgcctttgctcctactccaccttccaccgtgattgtgaggcttccccaatcatgtggaactgtgagttcattaaacctctttttcctgataaattacccagtgttgggtatgtctttcttagcagtgtgagaacagactaatacagtcattaaaattgacaacttgcatcagtgtacacatagaatcttctcatacaacacctttgggaaccactactggaaggaaatgttacatttcagggactgaggctgggtacgggaaacagagccagtgtccatagtgttaatattcgtaggggcctcagatttaattttacctgtaagtttttcttacaccagaaattttcagccttagcactcttgatgttttgggccaggatgtcctgtgcagggtggcatgttcagtggcatccctgatctccacctgctagatgccaataacacacccccacaggcgcccaaggtgtgacaattgacaaccaaaaatatccctagacattgccaaatatcccctggcagaggcagaattgcacaggttactactgtgcctgtgtcacaaataagtcacacataagtcattttgttgctttaattcttctgtgtgtccttggtcttaaactgttacttggttaagtacgcagattgaaaaaacactgcaagggaattttttagagtctctctgcacctattctggtttcaggactgcccagtttgcattgttgttcaaaatggaaagaagagagggaggaattttttacaaaataaaattcactaccatttttgagacttttttttttttttgagatggagtctcgctctgttgcccaggctggagtgcagtggcgcgatctcagctgactgcaagctccgcctcctgggttcacaccattctcctgcctcagcctcccaagtagctgggactacaggcacccatcaccacacccagctaattttttgtgtttttagtagagacggggtttcaccgtgttagccatgatggtcttgatctcctgacttcatgatccgcccgcctcggcctcccaaagtgctgggattacaggcatgagcgagacttttttttttttttttaacattttgtacatatgccagtaactcccctcccgcaaaaatggaagattgtcttgacctctcgtgagacctgctgaggccacatctggttcccccactgtagaggtgagttaggtctccccactgaatgtcagttcccaaagaaatctcatgtgtaaatgaaagagcagatcctccctcccctcctcactgttttttgcttatatgtagatgtgattcctttcaagaaaactccgtgagaaattacttcactatcatccactattgacatcaacagcagcctacattttttcaagatacttaaagtgcattttcgcttttaactttcacaacactttaatgttgctggttaatattattgatccctacttttttatgagaaaaactgaacctcagataggttaaataacctgctcaaagccacaccactgacattgctattctgataaagcagaatatttgaagcagtttcccccaaaacagagcaatgttcacgttaattatgaaacatagcatgaattcataggtagcctgtcaataattatgagtatgtggtatactgatgtcataatttttatataaatgtataaacctgttggcaccctgtgattgttactggtttgtttttttaagtaccttggatgaaaacttgaaagaaatatacgaaaatagaagcagaagttatgtttaagtgggatacttctgcagttttcttttgaactcccttgtgaatttctaaatgggttgcaatatatttttacttctttggaaaatgaaatttgtaagttaaaagtgaagggagatagatatagctaacataactgccaaagttgctttttctctgtaactctagctaagaaatgaccatattctgtccatgtgtccataagtctaggctcaggagtctttcagagtttatttgatgtaccattgagctgagggctctgtcctgccaccttttgttcaaggaaacacacgaggcacttccttagggaacccagtgaagatacctactgatgggaagcaggacagttgattcattccctctgtttctgttttaatgctacactggggtgagattaagtggtacctcccaagagaaagagcagggaacccgatgtgcctagattggttcactgtgaatcacagcagttgttcccgttgacatcacagaggggacattgatggtagatcatgtcaccatcagctctccctagtgaagactcctatctggaaccacgtggagaagactgtgaggtgaaaacatgctactctctgtcacatactgccaggtagatgcttgctgctggcagaaggcatagaatattttgtaaactacgtgagtattctatcaagtaatatttttctgaagcaggcttccatctgtcttgccattcatttttaatttcttagcacttcatagtagacgtgttttgagtattttggtcagaattgtaaacattgtcctctaagggaatcattctcaatgaggtgctaagtacctgatgttcagtcctcataactactctattaggtagcaggtggaatgcccattttatttataatttttttaaagttctgggatacacgtgcagaacacacaggtttgttacataggtatacatgtgccatggtgatttgccacacctatgaaccatcatctaggttttaagccccacatgcattaggtatttgtactaatgttctccctttccttgtcccctaccccaccacgggccccagtgtgtgagttcccctccctgtgtctttgtgttctcatcattcaactaccacttatgagtgatagcatgtggtgtctggttttctgtttctgtgttagtttgctgagaatgatggcttccagcttcatccatgtccctgcaaaggactttaactcattcttttttatgggtgtatatagtattccatggtgtgtatgtgccctattttctttatccagtctatcatcaaagggcatttgggttggttccaagtctttgctgttgtaaatagtgctgcagtaaatatacgtgtgcatgtgtctttatagtagaatgatttataatcctttgggtatatacccagtaatgggattgctgagtcaaatggtatttttggttctagatccttgaggaatcgccacactgacttccacaatggttaaactaatttacactcccaccaacagtgtagtagtgtgcctatttctccacagccttgccagcatctgttgttccctgacttttaaataattgccattgtaactggtctgagatggtatctcattgtggttttgatttgcattctctaatgaccagtggtgatgagcttttcttcatgtttgttggctgcataaatgtcttcttttgagaagtgtctgttcatatcctttgcccactttttggtagggttgttttcttcttgtaaatttacttaagttccttgtagattctagataatagacctttgtcagatgggtagattgcaaaaattttctcccatttgaaggttgcctgttcattctgatggtagtttcttttgctgtgcagaagctctttagtttaattagatcccatttgtctattttggcttttgttgccattgcttttggtgttttagtcatgaagtctttgcccatgcctatgtcctgaatggaattgcctaggttttcttctagggattttatggttttgggttttacatttaagtctgtaatccatcttgagttaacttttgtataaggtgtaaggaaggggtctggtttctgttttctgcatatggctagccagttttcacagcaccattaatgaaatagggaatcctttccccatggcttttgtcaggtttgtcgaaggtcagatggttgtaggtgtgcggtgttatttctgaggtctctgttctgttctattggtctatatatctgttttgataccagtaccatgctgttttggttactgtagccttgtagtatagtttgaagtcaggtagcatgatgcctccagctttgttctttttgcttaggattgtcttggctatatgggctcttttttggttccatgtgaaaggtaaagtagtttttttctaattctgtgaagaaaggcaatggtagcttgatgggaatagcattgaatctatagattactttgggcagtatggccattttcatgatattgattcttcccatccatgagcatggaatgttcttccatttctttgtgtcctctcttattttcttgagcagtggtttgtagttctccttgaagagttccttcacatcccttgtaaggtggattcctaggtattttattctctttgtagcaattgtgaatgggagctcactcatgatttcactctctgcttatctattattagtgtataggaatgcttgtgatttttgcacattgattttgtatcttgagactttgctgaagttgcttatcagcttaatgagttttggggatgagacaataaggttttctaaatatgcaatcacgtcatctgcaaacagagacaatttgacttcctctcttcctagttgaatactttccttctcttgcctgattgccctggccagagcttccaatactataggagtggtgagagagggcatctttgtcttgtgccatttttcaaagggaatacccgttcagtatgatattggctagagtttgtcataaacagatctttttgagatatgtgctattaatacctagtttattgagagtttttagcatgatgggatgttgaattttatcaaaggccttttctgcatctatggagataatcatgtggtgtttgtccttgattcagttaatgtgatggattacttttattgatttgcgtatgctgaaccagccttgcatcccaggggtgaagcctacttgaccttggtggatacgctttttgatgtgctgctggattcagtttgccagtattttattgaggattttcacctgttgatcttcatcaggaatattggcctgaaattttctttttttgttgtctctctgacagtttttggtattagcatgatgctggcctcataaaatgagttgaggaggagtccctctttttctattatttggaatcatttcagaaggaatgatattagctctttttgtctctggtagaatttggctgtgaatccatctggtcctggggttttttttttttttttttttttttggttggtaggctattaattactgcctcaatttcagaatttgttattggtctcttcagagatttggcttcttcctgctttagtcttgggagggggtgtgtgtccaggaatttatccgtttcttctagattttctagttttagtagaggtgtttatagtattctgatggtagtttgtatttctgtgggatcaggggtgatatcccctttttattttgtctatttgattcttctctttttctttgttagtctagctagtggtctattttgctaatcttctcaaaaaaccaactcctgggtttactggtttttttaaagggtttttcctgtctctgactccttcagttctggtctgatcttatttcttgtcttctgctagcttttgaatttgtatgctcttgcttctctagttcttttccttgtaacgttggggtgttgatttcagatctttccagcttactgatgtgggcatttagtgctataaatttccctctaaacactgctttagctacatcccagagattctgatatgtcgtctctttgttctcattggtttcagagaacttacttttttctgccttaatttcgttatttacccaggagtctttctggagcaggttcagtttccatgtagttgtgcagttttgagtgtttcttaatcccaagttctaatttgattgcactgtggtctgacagactgttacgatttcattcttttgcacatgctgaggagcgttttagttcaaattgtgtggttgattttagaataagtgccctgtggcattgagaagaatgtatattctgttgatttggagtgaagagttctgtagatgtctattaggtgcacttaatccagagctgagttcaagtcctgaatatccttcttaattttcggtcttgttgatctgtctagtatggacagtggggtgttaaagtctcccactactattgtgtgggagtctaagtctctttgtaggtctctcagaacttgttttatgtatctctgtgctcctgtattgggtgcatttatatttaggatagtttgctcttcttgttgcattgatccctttaccattatgtaatgcccttctttgtcttttttgatgttttttagtttaaagtctgttttgtcagtgactagaattgcaacccctgcttttttttttctctccatttgcttagtaaatattcttccattcctttattttgagcctttgtttgtctttgcacgtgagatgggtctcctgaatacagcacaccaatgggtcttgactttttatccactttgccagtctgtgtcttttaactggggcatttagcctatttacacttaaggttaatattgttatgtgtgaatttgatcccatcgtgatgctagctggttattttgcacattagttgatgcagtttcttcatagtgtccttggtctttatattttgttatatttttgcagtggctgttacaaatttttcctttccatatttagtgcttcctcaggagctcttgtaaggcagggaatgcccattttagatatgagtaaatgaggctcagacctgttcacgattcttgcctcggtggctctgcatggtgatctattccttagtgagtcctcttgaatttggggtaagtctatttattgtctgtcatctaaggcagcttgctttttgtcttctggtgcatatcaaaaagtggctgtttcctcttttaaaagcttatttttaatttttgtgggtacacagtaggtgtatgtatttatggggaatatgagatactgtggctcaggcatgcaatgtgtaataatcacatcttggtatattgggtatctatccttttgagcatttgtctttgttacaaacaatccattgatactcttatttttaagtgtaaattattgattacaattctcttgtggtggggggactatagtgcctcatttaattattgttcattctatttttttttttaaccattaaccattgctacttttcctcccagccccctactaccccttccagcctccggtcaccatccttctcctctctatctccatgagttcaattgctttgatttttagatcccacaagttagtaagaacatggactacctggttcttgatttaacatctacaacattttcagattatttttgcttgtttacagtttttatatgttatacctaatttgaaatttagatattggtgaattaactgctaagcatgattatttccattaagtacgggggagctttgcttacctactttgtacttcttgttcctaaatgttagggttatatagctcatctcagcactaacattattccttacccatgttttgaacttttatttttctggcgttaatgctattgcccacaatccctgcgagtacccctgaatccgacccagtagttttgccttgtaacctccaattcccaaggaatatagcctggcaatagattgtttcatgtatttttacacacatgtgatcttcatatccatcagtagttagtcttctgcactcaccagaagcaagatgtcatgtctggggaaaggtttgttttttttgttttttttttttttaaagagctgtagacattttaataaaagtttcttctcagcttttctctgatgcatatcaggaggaaagtatagtaacagagaatatagcattactgcaacatgcctgtctgaatacatttcagttcattgagctagatttccctgaaaagggaacattcccagccaagtctgccctaaaatcacaaccaaggtggcaagcccagattcttgatgtctgccagtgtcatttttgtaatattttattctccagcacagtggcaaccaggatcagagctaatagtctaatcaaaacgaaagatgcccaggctcagatggggatgggatgaagccctacaccaagttagagtggtgaagtccactagtgtttctgaacaaggtgccgactcttggcatgaacccacacagtctctgaaccattgtgctggtcatgaccactgaggcgtggcaggaaggtggtctctgtggagactcacagcctgcttacaagcaattccaggagcaggaagcacagagacatatggaaattccactctcatgcttaatatacaacgtgcaaaatgaatttttcatattggcttttttaaaaaatggaagagttccagctttgcctcactggtgtgccttttggagttagtgtcctttaaagcagccagagggggaataactgtaatgtaagcagagtggtgtttgcaagtgagagctgggggagaggcgatgatgattttggaaacattattctgggtgttgaattgaacaaagagttattactgaaggaaaaaatacccagaaatgcattgttaatgctctctcagatttgggcctggagaaccatactgtgaactgagtggaagataaatagagaggaaaatagcaaattaaggggacaaataaccagggggaagaggaggggggaaggttgcctgctggcatcaggagaggagaatatataaccagtgtctgatgcatttccttaagaatcagtgtgtttgcaaattgctccattgcatcttagcagaatctaatctgggtaacgaagagctgactagcgaacatagttggatgaattccccaagtactcctgaaatataacagagcaaggaacagtataatgaaaaataacagagagtgtagctggaggcttaacttatgatcagtgttcattacaacaaatgacattttcactgcagagttaccgtaagattattgactcttacgtaatatggttcccatctgaacagattcgagaacagcttagcctgtgaatgggagagctgcagaggactgaagatatactcagtccccttattcatgttttcagttagtccttgggagctgcctgttcaggaccatggacagagcaaaaagagtttgcaccttcctccaggcagaatcttggtgattgtctttggcaatgactggcatggtcatgtgtaatattcagtgaaaaccaggctcagaaagtgactaaacttgttggtagtttcatatccaaggcctcctccttatgttctctgccatttgctattttcctcaagcatacatattgcaacatttaaaaaatatatatctctttggaaagaaacagtgttttgtctaaaacgttgggcacacaaccataaggcatattgcaactctatggcttcaaccacatttgaatggacaaccccagttctgagcgtagtgtggcattgccttggtttattgagcacctgtttgatacctgctgagcactctgtatttctgttattttgtcctcccaacaaccctattgagttatgtgctattattatcagtcctgttttatggaggataaagcacttttatcagagaggttaggtaacttgtctaagggtacccagctgccaagaatcacgaatgaatttcaaagtcatttctaccagtctgctgtacattataactttcacacaggtgctgaacataaagagagattcattcatattcattctctctcactctctctcgctctctggaaaagcagcctggatagtaagtctatccagaagccttgctttcacccagtattcatgagtcataccagcgttgcttgctgtgtattttaaaagttaactctatacaggtgtctcccatgagaaagggtttactgtcactattagctggaggtgcagatgtcagcccccagtacatgggagttagaagcagagcaagagaacacaaagaggccagtgggtgaggggctgtcttgttgcagggaaagaagcaaagtggtatttggaaacaaatcaacagttgtcaaaagaataatgaagacatctatgggaactcagtagtagcgtcttcggatctcaccttttctttagttttcagttgtgtatttctaaattttatgggaaaaaaattcctcaacaaagaatggggaagttaaaaaatacagttagccctattataaccaggggatttctaagcagtttattgccttgtttataaaagcctgattgggacgtccctcctcctggccactgcagcctattctggagacttccctgcagcccgtcttccctggcaatgggcccagaggctagacgtagtgtggccactcgagaaggatcacagctgagtgaggaagtctggtccaccctggaaacggcaaactcatgaatgcacccaagctgtagtcactgctgcttgagcccccagggagggcctcatggataatgcactctagccagccgggcgctggggacctttggctcttaaagctgcttttatgtttttgtgctttgggggaagagaaggactgaacatattttctccaaccaagtagcatttacgggcttcaggagttattcattttggcttaaaaacctttccaatatcacaactattacaaataaggacattgggaaaatctctaggtaaacgggactctagataacagatttcctgtgtgtatccttccttactcgaaaccagcagtttccagcctttttggcaccaggcaccagttttgtagaagacagtttttccatggaccagcagggttgcggggagatggttttgggatgtgtcaagcactttacattatagtgtgccttatttctattattattacattgtaatgtataatgaaataaatatacagtacaccataatacacaatcagtgggagccctgagcttattttcctgcaactagacagtcccatctgggggtgatgggaaatagtgacggatcatcaggcattagattctcataaggagcgtgcaacctagatctctcgcatgtgcaatggggagcagctgtaaataaaaatgaagctttgcttcctcgcctgccactcaccacctactatgcagcccagcttctaacaggctgcggttaggtacctgtccacggcccaagggttggccacccgttttctaaagtattaaaagtaaccaagtgccaggatgacaggaaaggggccgtcagcctttaaaatgtctttcatctaagtacaagaaggtggctcaactccaccatattcagcttgtctatatctgctgtgcagtagcatagccaccaactataggtggctcctgagctgttgaactgtagcttgtctgacggacagtgtgctctaactctaaaatactcaccagagttcaaagacatagtactcaaaaaatcattaaatttatgtaataaatttactaaattattcatcatcaaattacagataacatagatcatgaatcatttttaaattgatgacatgttgaaatgatattttggctatattgggttaaataaaatatgatattaaaattaattccatccagtcttttttacttttataatgcagctatgagaaaatttaaagctacattcatggctcaaattatattttggacagcgctattctgcagagatatgtggaatatggaatgtgtctctgcaaattggacgtactaatgtgtgtttaagaagattttagaaacagcttatgagaagagaacttaactcactcgaggtattcagtgagcaaatactaaataaaagagggcttgttttacctttttggggagatatgttggatggaaatcttcttggatgatcgtttttcagggaagaatacttttccatgagaatattgttggggtagtaggagacgattgttacagaacatggttggttgacatttgaaaataaccatggtgcacactttcctttggaatgttccatccagtgtcgtcgtacggggcccgggaggtgcttggctttgcagacacctgctcctctgccatctccaccccacgcttttacttccacctcgctttcaccagctgtatttagcatgctctagcaccttccaggggtgttttgtgggtgagattcttagatgaaacactttggattcttggatgctaggggctgttatgacaagcttcggctcttccctccccacccacagccacagttttgcttgcagcctacggggcctgttgggggcatgaagcagctaaggctctcccctagccagaggcagctcctaggtgaggcagtgccagggtcccactcaattccttgctgatgcatggaatcttctcatagatcatagacatctttatttttaagctttttgcacttgcagaccatacatttttctgagattcttaaaaatctgattttaggctgggcaccgtggctcacacctgtaatcccagaaggtctgaggaggaggaggtctcaggccaaggcaggaggatcatttgaggccaggagttctatattagcctgggcaatatagcaaggccctatctctacaaaatatttaaaaatcagccagacatgatgatgcacacctgtagtcccagcactttgggaggctgagacaggaggatctattgagtccaggagtttgaggctgcagtgagctatgatggcaccgcagccagggcaacagatcaagaccctgtccctaaactaggaggaaatggatgaaaattattaagtctgctgaatctacccagggctacaagtatttttttaaactttaaactcttcattctttttcaggattttttttttccaaaaaactcaaaaatgtgaaagtgaaaaaagaggagatggagttcaaagtctcatctcctgttgagctctcggagatgccgtctccattatcccattgccaggtgttcacttgctcctaaataccactttgctctttctgcacaccagcagaaatgagatgctgtgtttgtggatagtatttgccacttcaaagagaacacggcttacatggggaagtttgtctttgccagggaagtgggaaaaggtaccagatgcagcttctccgagctgcttctgcctaaagctcacctggtgagagccgcatggataatgcacatgtaggtagtaggtagctgggtattttctggcgttgattcctaaggatttttaaaatatcattactctacttgtttttgtttttaaacagacatggggtattgctatgtttcccaggctaatcttgaactcctaggctcaaaggatcctcctgcctcaggctccgaaagtgctgagattataggcatgggccaccacacctggtctgctccataagtggaacgtcattcaccttccagaaaatccatgggcgatggaggaggggaaaataatacagtgctgtctaaaatctcatgatactggccgggtgtggtggctcacgcctgtaatcccggcactttgggaggccaaggcgggtggatggcttgagtccaagagttcaagactagcgtgggaaacaaggcaaaactccatctctacaagaaatgcaaaaatgagccgggtgtggtggtatgtgcctgtaatcccagctacttgggaggcagaggttgcagtgagctgataatgttccaatgcactccagctgggtgacagagcaagactctgtctcaaaaaaactcacgataattatagattatcatgccataatctaaccagagcacagaaggaatcttagaggtacaagccctgtagagtttcacgtaacatgatttggttaaggggtaaatatgttaatattaaagtgatttgctctacagggttcctgggcaaagcatgttaagttccattcagatgcccaaccctgaccaggctgaatcctttgcctggagtgctttatctttgtgaggtctggcacattccaacagagcacctgctcagtgtgtgatatctgccgtggatatgagatggggagtagcagtgctcaggccagatagttaccacccctgtttagatccacacacctcctttttctgtttggggaaatgcaaatcaccctgctagtggattaatcccaaagccttctgaattccaattcaccattctctgccctgcactctgacacctataggcctgaacttagattaaacgtgatgtccagctttccactgacatggtgtattagtccattctcacactgctataaagacatacctgagactgcgtaatttatatagaagaggtttaactggctcatggttctgcaggaggtacaggaagcatggcggcttatgcttctggggaggtctcaggaaacttagaatcatggtggaaggcaaaggaggcaggcacacatggcagagccagaacgaaagagcacaagggcgtcaatgctgcatgcttttcaacaaccagatctcgcgagaactcactcactatcacgagaacagcaccaaggggatagtgctgaaccattcatgagaaaccgcccccatgatccaaccacctccaacactgaggactacaattctacatgagatttggtgggaacacagatccaaactatagcacacggccatgtgtcacctgctgtggtgaaatcatcaggtcacctgggcagagagaaactgagagggagggacagtgccaagagcagatggccaacagccacaaatagggagaggaggaggaatatcagtggtgatactaataccactatgtatggtatgcttctaccgtttgtccttatcgtaaaacaagagaaagcaaaggcttctctctagatactggcattccttttcatgggacaccagatctgtgtaatgtcactacctctagagccacaggacaatgtgtgctccacatggtttccttcacgtgatattgcttaaggcttcaatgacttagtatatacaacgtggcagagaagcttcctgtgtgcacactacaggaatcctgccctggtgatgaccagcctaatgactcagaggtcatgaacgaccctcatctgcccatgtaggagcctcgtgaggccagaaagactctaacccttccatgataataaaaattcattctgattttttttccaacaaagggaagaaaacactacttttatgttaattttagctgggcctggtgagttgtacctgtaatcccagctactcaggagtctgagatcacttgaggtcagaagtttgacactaacctgggcaatatagcaagatcccatctataaaaatagtttaaaatatatatataatgttaattttaaccaaattctcttataaattactatcttcaactagttcttatcaacattaaaaatcattaacattctataaaagtcctttgtatcttaaaggaatttagtagaatcaccctggtcacggtactgtacaaaagtgtccgcaagaggacaatggcctggctcccagaaggcctcacgaagtggcgctgcagcacctttactgagtgcctggtcttccctttagccttagaagccctgcaagctggcaaggtgtgcctgtaatcccagcaccttgggaggctgaggcaggaggatcacttgaagccaggtgtttatgaaaaaaaattaggcatggtggcatgtgcttgtgccagctactcaggaggctgaggcaggaggatcacttgagctcaagaggtggaggctacggtgagccatgatcgcaccactgcactccagcctgggcaacagagtgagaccctgtctcaaaaaggcaagaaaaatgaaaccctgcagccaactgaggaaaaaacataagaagttgttggaggaaccggagttccaccacagaggataactgcccccaaagacgggaacacttgcctcggtctgcacagcacagatcccttcagtagacagctccaggtgggaagctgatggtagtcacctgatgagcgtggaattgaggacatcaggaagtgatgcttggctcagatgttcagtcactccatatttttggggtgacagttgtgtatgaggcaccaggcactggagaaacaaaagtgatgttggcctagtccctgtctcagaggcactaatgatccagttgggatccatgtatttggatatttgtaatacttcctagtaagtacagctatacacactttcattaagtcaatcaacaaacatttctagtgtgtcccagggacactgaacaagacagataaggttctggtgctctaggaatgaaccttctatcaggggaggcaggaaacagacatcaaataaataactagatggtgacgagtggtatgatggaaatgaacgtagtcaaagatagaaagtgtgggcaaagatggcctggctcgggaactcacatttgcagtagaccagagtggtgacgtattcatcaagaccagcattgctttgattacaaggaacacaaggcctaagagggagggggattattttgatgattttacactaaacatcatccagcaatacagctgacttcaggcattgggacccacacaatgtccttaggcccagtctctctccgtccctcactcctgctttgtctgctggcttctcccccaagcaggctctctcgccacagtgctaggacaaggtaccagcagatctgggctcatccttcctacttcaagtaaaacagaaaagaaaggacttttcttcccacgcggtttgagctcccatgtgaggcctgtttttctcgctggctcttgttggccccgtgcttgtgtgtaaaccagttacggcacccagggtgacaggacaccctgatggacctaagactgagtcatgttgacactaacatcagggaagcacagccagaccccggagtctgaacacctgcagtcacatcacggtatttaaactctgggccttgtttccccacctgtcaaatgggaatgggggtagcgcctgtctcagggggaccttgagatgagcattccaggcagagtgaatagtgatgggaaacagaagcccctaaggagttgggatcaggggcatggagggtcgcggcagaaggtataggaggggagctggccagaagctggaccgtgcaggtgtggatcgcgtgtgccgggtgggcggtgctgtgttgttttctgtgattcctcctaggcacacagtcccgccagggcatccacagaactcacagccgctggtccctactgcctgcattttctcccccgttttcagtgctgactctgatgggcaggttctctctccagctttgctgatatccctggtctgcttatagtcgaggcgcactggtctgggagttaaggctggtgttattttgggtgacttttcatgtttctgcttcgatctattctgtgttgatttttattacttaacacccaggggaaaaccttatttccccatacgttcaagttttggggtggtgcctcactcttgccccgaccagagtcatccccagctagttctgtgttggcagggcataaaatctgaagcaggtcatgttaatatatgggccaaagtgatcattggtgactgtatcatatcatcctccagctagaggacattttaagaggtccattagatgattactatttaggttctgagagctagattcaagttagtgcattttcatagtagtggttttgaagagtaatttttaaatgggtaaattgcccatacaaaaataattcctaacttacttccttatatttatgaataggtttgtgtatcgttgtattacaagcacatacatatacagttggatgtctctttttagtctctgcagatgccaagtactaaaatgattctttcttttcataaataaaagaaatccactccaggtatgaagtctatcagggaagtaacttaccattgcccttggactgatttccttttgcctttgagtttattctggaaattgcaacatttagcactttgcagtttaatttaaaaggattacctattttcttaaatgcttaagcagggaagcaaggtgcagttattgatttttctctgcctgtattctgtgaaagctccttccccagggaacatacctcctgaactgcatgcctgctggtgacagcttggacctctgatacataaccaaagaccttacctaatatccttgcatctgctccgggaatttttattaagtaaaagcatcattagagtagacaggatgatgaagtttaatgagcatcttttttgcatgatattgttagttttgctctgccagaatcctcatttctcccctccagtggggcagatcgtgagtctagaatatatggctgttttgaaatctgccttatatattatagcctatttttcatatagcttgctatctgtcttaagccaactacacatttcgttgtggctgtttatatagatgccatttgtgcatgtatgtttatactttctttctccactatgttgggaacagaaagcaggttataatggagaagaatgtgacagacacacgctgccattcgtaaattgcatggaaccatctcttggaggtttgatctcaaaaagaaaaaaaaacatttccttttgaattaatgagacttctcacaggaattagggtaactgttaattttttttctttaggactcagcaatttacatgctcaggttctgtcaccagcccctgatagccgccggctaggagaaataaagctattacaagtgcttattaataatctcggcttcacactttgtccacagatctatttgcagagattttaaatttagcatcctaccggaagattacagattagaagcaaaattatttttctccattattttcactggccatatcctgagattttaaaattggttcttttcttggtctgtatgaggacttgccatggaaacacccaaaacaacagtagggatacatatgacacgagcaaacgacttcagaacagcatattgcacctctcatatacctggcattctgaaagacaatatttacatagcacacaatgtgtttctagcagtgcctggagtgtatagactacaaaagaagttaagcctgcactccctgccctgcagaaaatggtagacttcttaagaaaacaaaaccaagatgggagatgaggtaacttagtgctttcagagtttgaactttggagtcattgcctgggtttatcggagcctcaagctgctaagcctcaatttcctcatctgacaaataatgatcataataggagcttcctcgctgggttgttgcgacagtgaataatgaatgcacgttagctgcattggaaatgttgtgctgtgatcacggcactctgctgatgttttgaggtaacatgccaaggtcaggagtcactttatgtatcatcaaggacttagtgatgagatcctgatacatcccgtagggctttgtgatggcagaatggagaaggggaggaggaagctgtgaaagtcttcaaggcctcaaaatatggacagaggagatctcagttgcagaggggacctaagcaggcattcctggcagtaataacacagataagcaacaacaacaaaaacaagccaaaaggaatgttggctgtcaggaaaggcttatctcaggcctcagattgagtgagccattttttcatttttcaatgggtgagcccaaggcaacctgattaccagttcacctgccagggagataatgagcgaatactccccttttccagttccgatggcagaggttctggaaagatataggactctgaggctactcagctaataggtggcagaactcacactcactccatctttcctgcactctgccctgcctgcctcaagcccagccttaccttgcacacgcctgttagtgcagaaagagaggacattaggcgagccagattccccagccacatgcgctgtggctgctccatgccaggtgccaggctaggtaccccatccaggggccagaggttgctgtttttcatccatgcaccaggaagagttcagacatcctgtgtaggacacactgggaagggaagtcacctgcatcgggaaaaccaagaagggaaccattataatatttgaatggccatgtgacatgggcctgattaaagaagaaaaaaggagtggatgatggaaataaatgaggtaccataaaacagctaattaatgagttatgggccctttgaggagctgatgaaaactgtggtccctttctgccgaaatatacatatacaactttacttagagtttcagacacttctagggtcctaggctaagaacttctactgtagaggaaactaaattcctatcagacctgattaatatggtgaccaaaaacaaaaagaggagaatgtcaaaataacttagcatttgctcctgaagttctggagacatggagggacagacctgtggaaggtggggtgagggactcttccctgccttttggggattcatagccaaagtgtcccagtgggctgatgaggacttggagagcagctgctcggagacaatcattaaagttataaaattagatggaaagaagacacaaagacagacaggaccaaagaggtgtccagagagaaaacaagaaccaggatgacatcctagagccaagcgaggacatttttaagaatgaatggctccgcggggtggggtcttccttgctgctgcagcaaagggatatgagacccttggatctgacataagactcaatttttccaaaaataaagatgcccatattaaataaaatccacctatcagccaggcgctgtgggttacacctgtgatcccagcactttgggagtgtgaggtgagaggattgcttgaaccccagagtttgaaaccagcctagcaacatagtgagaccccatctctacaataagattttaaaataagctgggcatggtgatctgcacctgtagccccagctacttgggaggctgaggcaggaggatcgcttgagcacagcggtcaatgctgcagtgagctgtgatcatgccactgcattcctgggtgacagagcaagaccctgtctcaaaaaccacccccccctaaaaaaaaaaaaacacgtgtcagtaatagaaaatcatgcataatatatctgcttaatcaaaaaaaaagttgcaaaatttattctgagtacagtggactggaattttttgctgtgcaatcttagctgtccaggcggtagtggtcagttgcacggagcttgaagcggcctgtctgcaggctgttttaacagcacgtcaccgaagtcaccagcctgccaacccaggcagtctccaggatcatttccccatgatccttctagaagtgggcttcagcaggggttcctggggtggcagctcagggcagcgcccactcccacgttggcatttgggcttcacagtgagatcaagagcccttgtgagcctagcagactggttcactcatctcccaccactgagagcgtcgcaggcatctcatctttgaaaccatcttcagtgacagaagcctgttcatcagactctcaagagcaactgatcctcttgtgtcacttcagagtgcggtttctcgtttttttcccacttcttaatcatctcccaattctcctctccaaatcccggctatcaggggagagatgctctagggttccatgtcaaagggtttcctccagttcctgggctaagcattttacccaccagccactgcagccccatgggtgaccttgggccaggctccctttatcactctccagctgtcatagccgagtggcagtgcccgccgaagctttcccagaaagatctacaccaaaggcacaggctggcagtgcagattccgggcagcacgagggcatggcagcagcctgcaagaggtggaaggagttggccctggtagcctgcgtcagagaagcttcctaagaggttagaagcggcagctgtcattctgaaatgcctactgtgtgcccaagggacaagagcgtttccctaatttaatcttctcccaagctctccatggtagctgggaatcttcatcttcctcttgcatatggagacatcagactgtgggaggtgagggaggttccccagggcacacatcgttcagggctgagtagggtgtcgaaggcagaggtggctgtgagtcccagagactgttctccaggaatccctggtgcaggatgtggtgggctcctgtagggccagacaggtaccacatgagcagagagctgcagtggccctgagggcacatgctgtctaggaggggacagtggtgcccgggtttgagggatggttggcgtttcccaggtgaaggagatggagaagctttgttcaccaaggccctgggggaaaagtacaagttacaagaggtcaggacaaaagttttttgccaatcctggcacttccccgcatggccctgcatggtatgccacactctttcctctcaggaactgcaaggaataggttgtctttcaatggcactgactgttctgtcctctgtagtcagtcactgctataaattcaatccaggtacatgcaaaacacaagccacgagtgttagcttcagaggatggtgggacagggaccagccagttcgtagtagcaaggggacagtttgcaaagctgtttgcacttcctctcgtagaaacaacacccatttttcctttgggacacaccttgcctctctgcgtcttggttctttcatttttccatctttttaatttatcccagaaactcattttccctattgaaattaagcagaatcctcacggacaggccaccctgtcaggcccagagaggctcacctactatgttagttctctattgctctaacacattaccaagaacttagtagttgaaaacaaaacgaatgtattacctgacagttctggaggtcagaagtctgaaaccagtgttgctaggttgcctcttgcaggagattctagggaagagcatttccttgcttttctggcttacacagaccacctgtgttccttggttcatagcccctttccccatcttcagagactgcagtgtaacatcttcaaatctctttcactttgaccccctgcctgtttttatttttgattgattgttaaggtcttgccctatggccaggctggaatgcagtggtgtgatcacggctcactgcagcctcaaactcccaggctcaagcgatcctcccaatgcagcctcccaagtaagtagctgggactacaggtgtgctccaccacacctggctaatttttttttttttactttactttttgtagagatagggtctccctgtatggcccaggctggtcgtgaacgcctggcctcaagcaatcctcccgccttggcctcctgaagtgctgggattacagatgtgtacccctgcagctggtccctcctgctgctttcttataaggacccttttgatgacactgagcccacgggatcatccaggattctcttcccagctcaaggttcttaactaagtcatgcctgcagagtccccactgccatggaaaataacagtcacaggtttcagggatcagatgtggccatctttgggagctgtgattctgtctaccacacttacttgcccagttgaggccccgtggctcgtaactggcagagccaggaatggaacaccagactttggagcttgttgtgactgcaccgccactgccatagccacatccctgtgaaaacggccacttatggccgcttagtaaaacgccagctctcatctgcccacacagctggaggagttaaaggatcgtgcggcggacagcagcgtcatccagccctgccgatgactcactgaggaagtgggccatgcatttagctctgtcttagttgctttcttcaaaaaggattaaaacctttgttccagaggtgtttggggatttagtgttgatagaaaataccctgttattttgcaggggaaacagccctaaagaaggaaggtaatcatataattatcttgatttaatcactcttgactgtaactccatgtctgtcctacttttcaataagcattcgctgactgcttccagtaggtttgccatggtgctgggcttaccgaaacaccctgcaaggaagacaaacgacatctctagcttacagataaagaaactgaggcacggagagggaggcaaacattgctgatcatttgcccagagtcatcagctaataaacgtcaaaagcaggatttgagcagcaagttcagggccactggctcccacctggccctttgtagtgacttgttctgcagccccaggatgttcagacacacacagtgggatctgaatataaaaaggcagagactgaaacagtggaacattccagttcgctccgaaaaaggagaagagccctgcagcttttgcaaccccttctgaaatcgcttgcctggatccccatcgtcagggccaagctgaacacccacctcagcccttcccgcattcaacacttgactcgaagcagggccttgtcaattcctctcaattcctactgctcctctccctctgctgacctcttatcattgccaagactctttccttacactcgggtattgctaggtttccatgggcatgaacagtggagtcatctttctgtcaacttttagaatccttacagtttggaggccaggtgcgtggctcacgcctgtaatcccagcctttccaaggtgggtggatcgtttgaggtcaggagtttgagaccagcatgtccaacgtggcgaaaccccctctctactaaaaatacaaaaattaggcaggcatggtggtacacacttgtaattccagctacttgggagactgaggcacgagaatcacttgaactcgggaggcagaagctgcagtgaactgagatactgccactgcactccagcctgggtgacagagcaagactccatctgaaaaaataataataataatccttaaagtttgaaactatctttgaataaaaatgtacatacgtatttttttgctctgtgcggataaggggtttgggaaacagaggaaagatctctgaggctggaaggaagctgtgtgtgtagctgaagctacctaggccgtaggtgcctgtgtgaagacacagagtcagacccttgcttcctgccaggtgaggggagcttggagacctgatgcctccagggtttattactctgcagtgctaagcccttgagcattgagtcagtggccctgagtagatcaacatctgaggacaagggcaggtgctgttagaggagtacgcatgtttcggagcttggaggatgaggaatagaatggagggatctactttgagcatttcctctgcctatctgttgtgtctgggagagatgccgaggaggaggaacacgggttgagtccacatggctaatgcagggtggtccttaacttcgacacctgcagagccccttttgtcatgtaaggtaacatactcccaggtttcaggacttgaacacaggtatctttggaaattgggggcagcaacagagacaaggttggacccgctgaactttactccctatctaaaccagtggtctcccacctgggacacaggacccaggacccccaggtgcccatggcctcgtcttcagggggacccgtgacccttttaaaagtgtaggttgggggagcccctataggttgaaaaatgcgctttcatggagcagatttttttttttctgagacagagtctcactctgttgccaggctggagtgcagtggtgtgatcttagctcactgcaccctctgcctcccaggttcaagtaattctgctgcctcagcctcctgagtagctgggactacaggcatgcaccactatgcgcagctaattttttcttttttttagtagagatggggtttcaccatgttggccaggatggtctccatctcttgacctcgtgatctgcctgccttaccctcccgaagttcagattctcttaaggagttgtttcttcttctgtggcttcagaggaggcacagccgggctggtcaggacagggctactgtctccattacacaagcaaaaaggcctccaaactaattcctagagatgtggaaagccaatttgcaggctcttatgttctctgtctaggacatatggaaacttcttgatgcaaaagaatggcctccccttttcctggagtgcaatcccagcacctggctggatgtgcacgctccggctcgtaggtctgtctctggccagctctgaaccctgtgttctacactccgtgagagtgaccgccgatggaacctgcttgtaccgcctccaaggcaacacttggaagactggaatagttagaatacagtatggcctttcaaaaccatagtgtccagctttcctggatcacaaaatcaactgggcagttccatctgccagcccttcccctctgcctgtcagccatggtggagatgtcatcaagaacactagtattggacgccaggcacagtggctcatccctgtaatcccactttgggaggccaaggcaggaggattgcttggggccaggagtgtaacaccagcctgggcaacctagtgagaccccatgtctattaaaataatttttttgttggggcatggtggctcacgcctgaatctcagcactttgggaggccaaggtgggtggatcactggaagtcaagagttcaagaccagcctggccaacatggtgaaaccccattgctactaaaaatatgaaattagctgggcatggtggtgcatgcctgtaagcccagttactcaggaggctgaggcaggagaattgcttgaacctgggaggcagaggttgcagtgagccaagatcacaccactgcactccagcctgggcaacacaataggactccatctcaaaaaaaaaaaaatatatatatatatgatatataatagataatatagtatattttatatgatatatatgatatattatctatatgtatcatatattatctatgatacatataatatacagataatatatgatatagataatatatgatatatatcatatatatcatattatctatcatatatatcatataatagatattatatatgatatatatattttttttaattagctaggcatggtggcatatatctgtagtccagctactcaggaggctgagccatgagatcgcttgagcccaggagtttgaggctgcagtgagctatgatcatacactgccctccagcctggggagcagagtgacagagtgagacactcaggaaaaaaaaaaaaatgccggacgccagtatatgctaaacagcccaagatgccagcatccagagagtgtgcatattccttgtgtggatgctggagctgggccacctggtacagggacgtcaggctctgtgccaaccctcattcacagcaactgcgggctgtggagccgggtatgcccttgctgcagaggacctgagacacccaccaggctctcttggagacacagttatatcaataaaaggagttaagtttgagctgtatttattttagggtggcttttaatttggtttaatcagaattactcataaattatcgattaattaccttctgctgttcagttaaatcctctcagccacggagccagcttcgctgcgcaatgaatgccatccaccgtaattatagggcactttgtcagcatttaatcagcggtacttattaatgtggcattgatgtgtggtggccagccccacgctatccatcatgggtgagcagccagcacagatttggacaccattgctctctgtcccattagccagcccctgggctttcgggccaagcatcatgctcgcttttcactaaatggacactctgtctcttccattcaatcccatttttatcactgtcgacttaaacactcataagcttttgaacttcagtccagaacggctgagcagggcctgaccacttctcccagtgagtgtgaaatcccaagagactggtccgtgatcggacatcatggcatggcgtgcatgtgtaagagaattttatattcaacacagcgtagcacccagagaacacagaagtgatcttttggttttctttggcttactgaatatttttggagattcttctattcctgaaagctcttccagtgaaagctatcttgtgttggcaaaatagatctgatagtgtcctttctctgtctttgcagcctctacggcagacacatgcaggccaacccagaaccaccgaagaagaataatgacaaatcgaaaaagatcagccggaaacccctggcagccaagaacagataaggaagggattggcatcggctggccttccagcaccttctctctccaacacttcattctctcttgccctgtctctcaaataaacccaatgctgcgtgtgaggccttttttatttttcttttcactctctttctaatgcttcccaccttaccttttagattcttttgctaggtgggagattgttataaggtctttaaaccatttccatttgtttctttaacattaccaaaagcagggaacaaagctcttattcaactgcgaattccatagtgggctctggcttttcttgaatagatatcacaaggttgcttattatcaaaagaataattaaaatcatgtaaccatttaaatgtcactgttaacacttttcactctttctgttgattcacctaactcattattttgctttattaaaagtcttccttcaccaccgagatatgctaatttaacttacaaatgattttaataaaatcttgagtttgtatcacatgttacttattgactcagaataaaagaacagtctgatcttggggtataacacattttcatttacttttctcccccaaaatcatcttatccaattttattggttatacatgataaacttttcatgaaagaaatgcaaaattaaatcacagttcgtttcttctcacattaatttgtcaagttttttttttctttgaagactttctaaattaggaagcagaaaaacaaatctctaggagattctgccaaaggattttggaaagtagcattccttcgccgaagaaatggtgatttctgccaggggctggtagacaagaactgtgaaagagagagagaaaaaacctcaactgtgtattttgtcacggcggaaaatctgctcgcatcgaagcattcttctaagcgacttcgatgccaaggaagttgtgtaaatgtgcacgcgctacaccacacccagggtggaaaccacagttgcagagtcattaaacaatcaattgtttgtttaacatctgtgataggcagctttccttcttttcaacagtgatacctacgaaaatcaaaataaatgcaagctgaggttttgtgctcactgaaagggctgtcaaccccagaaggccgacacaaaaaaaatggtatgtgaagatgcaccgtcttttcaaatggcctgggagagtcaaatggcctgggagagggggcctgcccttctctgctgtgtcctttcggcttcccagttgagctcccaagaccaggacccactggggcatataaaatctctgctgtatcctttcggcttcccagttgagctcccaagaccaggacccactggggcatataaaaaagtcaaaaatcaaaatcaaacaacaagttctgagttacttaggaaacagacttcgcatttcaatcagagaggccacagagcaaggtctaaacttctggcttctagacaaattcctgatagaacatttaaatgtgggaagtggcttccccaggtcccatcccctgtttagggatagagttgatatcatttttataggtgccatgtatgcctctgcctgaatttttttaattgacttttgagcttttgagattgcacgagggagaacaaggcctttgctgttgtggataggaaagacttaacctaaaattaaaccagcaagaaagcattagtaaaaatctaacaatatgaagggctcttatgagtcatttttttcaaaagatgaaaactccagaaacgcacaggaacgaaatacctcccagaaacatgaagcaatcatcgaagactcactggtaatatttttaaaaagtatacagatcaaagcaaaaagaagccatgtgtaacaaagagaaatgtgcaaatattttttaaggcagtattaagtgcaagaggagtaacatgaaataaacattctttcacatggctactgggaatataaatttcgctccagaaaggccgtagcagtttgacgataggtggcaaaaccttaagattgtgtactggggcccagaatttttatttctaggaatgtatcctgaggaaattatccgagatccccacaaactgcaatgtttaggaattgtccttatagcattgcatacacaagaaaaacagagaaaagcctgatccctgtcagtggaaaaggggttcaatgaattacggtgtgtctgcatgaggcttttatgacattaaaaattgttgaacaacggccaggcacagtggctcatgcctgtaatcctaacactttgggaggccaaggtgggaagattgcctgagctcaggagtttgagaccagcctgggcaacacggtgaaaccccgtctctactaaaatacaaaaaattagccgggcgtcgcagcatgcgcctgtagtcccagctgctcaggaggctgaggcaggagaattgattgaacccgggaggcagaggttgcactgagctgagattaagccaccgcactccagcctgggcgacagagcaagattccgttcccaagaaaaaaaaattgttcaacaataagggcaaagggagagaatcataacatctgattaaacagaaaaagcaagatttttaaaactaactatataaggatggtcccagctgtgtcaaaaggaagcttgtttgtaatacgtgtgcataaaaattaaatagaggtgaacacaattattttaaggcagttaaattatctctgtattgtgaactaagactttctagaattttacttattcattctgtacttaaattttttctaatgaacacatatacttttgtaatcagaaaatattaaatgcatgtatttttcaa

SEQ ID NO: 36038 - DNA, 33211 bp, Homo sapiens
cgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctccgggagggagtgcctggccaggccggcctgtctgccgcgatggatgacagtaaggtaagtcttgtggtttgcacgcgccgccgccttcttgtcgctcaatgctagtcccgcggctgaacctccgctatgtagtccacgccaacacccaagagacacctgcctaaaacatccctgcgcctctccagtccactgcccgatggtacccagccaggaaatcagggaacaccggggctgcgtttttccaggaagggccctctctggaaatttttcactcccagggcgtttgctagctttccaggtagtgcaacccctagtccttaacttgcctgtcgagataagaaactactgtactttttcttcttgcacttttttgctgcctcctctctccagtttggagactttagtgcacgctgaaccagccttattccccttgacgattccccttctctcaggctcccttactcaatgccccattcatataatcagttcactccccctctgagctatttcctgtggttggttggaacaccgctaagctcctgttgctatttggccagtgtggagtttaacctccactagaaagccttctctaaaaaaatactgattttcctcttgttaactttaatagcccatcaccatccaatttccctgtccaaatcacttactttatgattataaaataatagataatgttcattattggttaatccaaatagtttatctatgtatagcctttttgtctttatttattaattgagacggagtttcgctcttgtcgcccaggctggagtgcaatggcgcgatctcggctcaccacaacctccgcctcccgggttcaagcgattctcctgcctcagcctcccgagcagctgggattacaggcatgcaccaccatgcccggctaattttgtatttttggtagagatggggtttctccatgttggtcaggctggtctcgaactcccaatcttaggtgtccgctcgcctcggcctcccaaagtgctgggattacaggcgtgagccaccgcgcctggccgcctttctctctttacatctacccacattagtgttgtttagttttatttcctgaagatagggatggtcaaagatttgtttattgatgtttcaggttgttttggatttggacttttttattttaaggaatcagacttctaaaatttgccagtttttaaagtaaaaaccgtccttctttgtgcttctcagcgtcttctgtttcacagtctttggcatactctttacgatagctttgtcctttgtttgggtgtctttttttgctgctgctgcagtttttgtttcacatatcctcagagagattcaaaaaatttccaacttctctgtgttccttgttttattctttccttcttgttttctcttcctcttcatgtagaaggctgtgaggaagtgacagatggaagggaaagcccagtgcagtactctggaattgttactcacctagaggaacggattgcttgtgaagtagtaaacccctcttaataggaagtggtatttccaagacagaaggggggcgagtttcaggaagctatcagctcataagagtgcttaatatgctcagtacacacattaattcccttgacaagaatcttgcccttgtttgtttacaacaatgcaacagaatgcgggataacattgtagactcttcagttttactatagtaacattcgtggggtatgatattggggaagtggtatttccaagacagaagggtagcgttctaaaagttttccagaaaaatcagcaagtaatttttttttttttttgctttgaatatttctttggggaggggacatcacacttctttcttttttcttttttttcttttttttttttttttttttgagacggagtctccgctgtatcgcccaggctggagtacagtggcacgatctcggctcactgccgagaattgctcttgggttcaagcaattctcctgcctcagcctcctgagtagctgggactacaggcgtgtgccaccacatccagctaaatttttatttttcgtagagacagggtttcaccatgttgatcaggctggtctcaaactcgagtgacctcaggtgatccgcccacctcagcctcccaaagtgctaggaatacaggtgtgagccactgcgcccggccaggacatcacacttctactcaatgaagataaacgtttttacaccttttgtcttttttacccctattatgccacgaattcatagggaataagttctagtagctcaggctgttttccactggtggagtaggctggtgcttcaattgaacccaggtacctttcttatttagtttccttttttttttttttttttgaaatagggtcttgcactgttgcccaggctggggtgcgttggtgtgatcacaactcactgcagcctcgaactcctgggctcaaagcaatcctccacctcagcctcccaagtggctgggactacaggaatgcacatccattcctagctaattttttgcagagatgagggtctcactggcttttttttctgatcattttccttcacacgtttctggaagctgtcagctcttaagagtacttaatatgctcaatatacacattaattctcttggcaagaatctttcccttttttgtttacaacaatgccaacagaatgctgggtaacattgtagactcttccagttttgccatagtaagatttgtagggcattagttttttttttttttttttgagatggagtctctctctgtcccccaggctggagtgcagtggcacgatctcagctcactgcaatctctacctcctggatttaagcgattctccagccccagtctcccgagtaggtgtgattacaggcatgggccaccatgtccggctaatttttttttgagacagggtcttgctcagtcgcccaggcttgatgcagtggtgcagtcttggctcactataaactccgcctcccgggttcaagtgattctcctgcgtcagcctcctgagtagctgggattacaggtgcatgccaccacaaccgattaatttttgtatttttcttagagatagggtttattagagcctgccatgttggccaggctgacagggttttgccatgttggccaggctggtctcgaactcctggcctcaagtgatccgcccacctcggcctcccagagtgctgagattacaggcatgagcactgcacctggccaactttttgcatttttttttttttttaacagagacagggtttcatcatgttggccaggctggtctggaactcctgacctcaggtgatctgtgtaaggtattcccttttaaacagtccccattccattgatgtctaaaatatcaaccttctttttttttttttctttgagacggagtcttgctctgtcaccaggttgtagtgcaatggtgcgatcttggctcactgcaacctctgactccctggttcaagcaattctcctgtctcagcctctgagtggggattacaggtgtgtgccaccatgcccagctaatttttgtatttttagtagagctggggcttcactaggttggccaggatggtctcagtctcctgacctcctgatccgcccacctcggcctcccaaagtgctgggattacaggcatgagccaccgcacctggctacaatatcacctttcttgtaggtttccatgtatgtggccgaaggaacaactccatgtgttctaaaaggcctggagaacatctgttggtgccttttctctttgcctttgtgttaatcattttggtgaattactggaagatggcagttccagccaaaaggcagaaataatatttcataaaagtctttggtagcttgatctttcagtgttaattttgaaattaaatattaacactgtatctattatcttgatgagaaaataatactaatgttatgggtatttaaggatggtagaagaacatactgttctttatttttcctaacttgagattcagaatatattctttctgattttcagttttttccttttcagacctttgaaacatttaacaactttctgaaagtcttcaataatttcaaataagtcgaagaaaaatacataggattttgggctacttagctgtaagatcatataaaagttatttctaaaactagcaatctggtggggtgaaggaaggttcaaaatgtcattgtttagcctgaaagagtgaagttaaaatttgagggcaagctatccgtgaattacttcctaaaggatacacaggtaagcacagtgaatttgattctcactctttattaattcattgtttttataagtacttagaaaccagcagctttgaaaaccttagtgagcatcaaaaagaaaattcatttaaatgtctctggatggagagtgcctctggaatactctacttgcactttgaatgcatgttgtagttgtagataagtaatatttacatgtcatgtataatactggactctccttcaacagtcaggcagtgtgaaactgtccttatataaggctttggcagctcccagccctgcgttttctgtgccctagttataatcccacaaaattgtactgtcctcctagtatatacagacatacacacaaaacacacttttccctcacattctgtatgagtcacactctctcgtcccattttcttcagtgtaagggaagatgaggattggggtttggaagtatggtggctgtgcccttgagagcataaaggatgataaactggctgacagcaagaccagggcaacaggaagaagacagagtaggcaggaacagcagttatagagaggtagtatttgagtgagtaggtcaggaaacatgatgatgataatgtgagggcctccctttataaagattttgtattctgagttgtttttaccagtggtgataaatgagtttgctgcgagttctccacactctgccatctagctggctggagtgagagcaggacagatttgaatggggaatagctttgcctcccaagtttctagcagtgtgcctaatacagcataaagtactcatttatagagattgaattgaattgaatcagggtgacattaaggagattgccctgatgtactcgggctttattaatcagtgtgctccagctgagcaaaccagccagcacatacttacaatggcaaatgagagaaataaagcaagagacagatttggcatctctaaagtgggggtttaggaaagtgttaagtagcagagctcaaatactgagtagatctcctactaggctagttgggaaggaaaaaatcttggctaatttatttaacttttttgagcttccatttccttatctgttaaatgtggccaataggtgaggccttggtgaagattagggttgatacatttaaagctctagtacagactctaacacatagtaggctctcaaaacacgttatcattattatattacctaacagtgattccttgtgctttactacggtgcagtaggtccctgagatgctcattttagtaattcttttttttttttttttttttttttttttttttttttttagtatttattgatcattcttgggtgtttctcagagagggggatttggcagggtcacaggacaatagtggagggaaggtcagcagataaacatgtgaacaagggtctctggtttttctaggcagaggaccctgcggccttccgctgtgtttgtgtccctgggtacttgagattagggaatggtgatgactcttaacgagcatgctgccttcaagcatctgtttaacaaagcacatcttgcactgcccttaatccatttaaccctgagtggacacagcacatgtttcagagagcacggggttgggggtaaggttacagattaacagcatcccaaggcagaagaattcttcttagtacagaacaaaatggagtctcctatgtctacttcgttctacacagacacagtaacaatctgatctctttcttttccccacatttcccccttttctattcgacaaaactgccatcgtcatcatggcccattctcaatgagctgttgggtacacctcccagacggggcggctgccgggcggagacgctcctcacttcccagacggggcggctgccgggcggagacgctcctcacttcccagacggggcggctgccgggcggaggggctcctcacttctcagacggggcagccgggcagagatgctccttacctcctagacggggtggcggtggggcagagacactcctcagatcccagatggggtcatggtggggcagaggtgctcctcacatcccagatggggtggcggggcagaggcgctccccacatctcagacgttgggcggccgggcagagacgctcctcacttcctagacgggatggcggccgggaagaggcgctcctcacttcccagactgggcggccgggcagaggggctcctcacatcccagacgatgggcagccaggcagagacgctcctcacttcccaggcggggtggcggccgggcagaggctgcagtctcggcactttgggaggccaaggcaggcggctgggaggtggaggttgtagcgagccgagatcgcgccactgcactccagcctgggcaacattgagcactgagtgagcgagactccacctgcaatcccggcacctcgggaggcccaggcgggcagatcactcgcggtcaggagctggagaccagcccggccagcccggccaacacagcgaaaccccgtctccaccaaaaaatacaaaaaccagtcaggcgtggcggcgcacacctgcaatcccaggcactcggcaggttgaggcaggagaatcaggcagggaggttgcagtgagccgagatggcggcagtacagtccagcctcagctgggcatcagagggagaccgtggaaagtgggagacgggagagggagagggagaggagggagagggagaggagggagaggagggagagggagagggatcattttagtaattcttaagtatatgctgttgtataagatttgtaacacctacactaccctttgctccagactatgctccagatgggacaggggcagtggggtgggacataaaatgaacttaagctctgtcattaagttagatagtgtgagaaaggtagtctcctgaggccacctccatgtttaccactaggaaaaagtgcttgtttttatgaaaatttcttcttggccaggtgtggtgtctcatgcctgtaatcccagcactttgagaggccaaggtgggtggattgagttcaggagttcaagatcagcatgcgcaacatggcgaaaccccatctcttcaaaaaatataaaaaattatccaggtgtggtggtatgcagctataatcccagctactcagaagggaggctgaggcacaagaattgcataagcccaggaggtggaggttgctgtgagccgagatcacgccactgcactccagcctgggcagtggagccagactctgtctcaaaggaaaaaggaaagtttcttctcccttgacctgctgcattcaattagaaaatagaaatgtgttattttcagaggctttgatcatagatagaaggttcttattttttattttatgttggactttattgaatgaacacatgaatgaattgaaatatcctaaggcgtcaagatccagttgagggactgatgcaggagtgggccaactactggctgcagcatgccaatgtgagctgccatttccctccacacttcttttctaccttgtgttctacgtgattatctggaaatgaggtttcttacactttccttacccttttaaccctctccctctgccaaagtcttctgattctttccagttctgagtagttctggttctcaaaaaaattttaatttggcaaaaaaatctctttgacattccctcatttatcttttggctccttaaccatcctctgctgcagttggagctaccttccttgggccgtgccttatagcccagacattttctgcttttcctgtcctcttactcacatcaacactttctagaagaccaagacaaaagagccatgttgtctattaaacaaatctctgacagtagacattaatgtgcttgctttcttttcttttctttttctttttttttttgagacggtctcactctgtcacccaggctgggcacaagtggtgcaatcatggttcactgcagcctccacctccctggctcaagcgatcctcccacttcagcctctggaatagctgggatcacaggcacctgccaccatgcctgactaatttaaaaatattttttgtagagacagcctgtgttgtccaggctggtttcagactcccaagctcaagcaatctgcccgcctctgcctcccaaagtgctgagattacggacatgagccaccatgcccggccgccttcctttcttgtctaggttacatgcacatttcaacttgagtacctctacagataattcagaaaccaaggagtaatttaaataccacagaaaccagttgaaatctaagtttaaataaccttaatctaagtttaatctaagtttaaataaccttattcagaatgttttgtcctcttaagattttcagaaaagtttatttattaattcattcaacatttgttggacacctgatatgtacgaggcattgtgctaggcattggagttgcaaagatgattaagagtttgtaactgttctcagggaacattttattgggtgaggcagacaaatagaaaagtaattacaatacagtgaggtagaaaatgagggcaatagaggcaaagttcttttggggcagtaagagtgggtgcttaactgtcgaggaacgtcagacatgggtttacagagtaggaatgaatctttaaagaactggagtcccctccaaaacaggaaagatggaatatcctgttgtaaagcatcttgcacagtaaagtaagtattttggtacagctagagaaggatcgacagactttctgtaaagggccatgcacaccatatggtctctgttggaattattccactctgccattgtatcatgaaagcaaccataagcagaatataatgaatgggcatggctgtgttccagtaaaactgtattttcaaaaactgggccaggcacagtggctcacgcctgtaatcccagaactttgggaagccaaggcgggcagatcacctgaggtcaggagttcgagaccagcctgactaacatagagaaaccccatctctactaaaaatacaaaattagctgggcatggtggtgcatgcctgtaatcccagctactcgggaggctgaggcaggagaattgcttgaacctgggaggcagaggctgtggtgagctgagatcacaccattgcactccagcctgggcaacaagagcaaaactccgtctcaaaccaaaaaaaaaaaaaaaaaaaaactggcagcaggctatatttgagttgccagcagggcggtgatatattaaccctgagctacagcgtaaagcagaagtagaggtgtggtcagagatgaggatgaaagataagcagggaccaaattacaatatacctggtaaacaaggctgacaaatttgggtcagtatctttcagagtggaagagacctggtgaatcagattctttcgggatagggtctgggaatttaaattttaataggcttcccagttgagtggctcttatgtgtaatgaggtttgaaaaccaaggccataaatgttggggagccattgaagggttttaaagcagaagtgacaaaatctgatttgtgtttttgaagaaaaatgccaatggctatatggagaacagattagggtgaaaatgtaggaactgggacaagaccagaggcagacggtccgattatgaaagaacatgggttttagcatatgactggagttcaaatctcattttcaccctttcaaactgttgtgattttggacagattatttaatctcttcagatattactttcttcagatacggattgggtgtgttaataaggaccttattgagttattgtgagaattaaatgtaatatatgtgtgatcccataccaaaataacttaatacatactgagttcaataaatcctggtcttttttgaattctcactggcatggttagattgcacagaagaaaggcctggactgaagaccatattagagactttacaatgtaagttgcagttgatgcggcgtgcataaaattctgaaaagataaagagtgaagagaatagagagctaaagagaaccctggaaaactctaaagtgatcagaagattcttgaagaataggactcagcaaaataaactgaaaagagaggtcagtgacgtaagagaaccagaagacagggctgttatgccatctaagagtggagagacttttaaaaagaggacttaccagttgtgggggatgagggaggggataggggttgagagaggagaggcagaagttaactctcaggctagagatgcctacttgatctttctcctgtcgactagaaaaactggcagaaaggttagcagcaggaagatgtgagtagactttgctgctttctgtagatctggcaaatataaaaagagaagaagcctaacccacagctgtgaaggaagttatgggagccttaacatcaaatgaaaacgccactgcttgttttttttctttaaagtggtaaagagcagtggctagccacattcatatttatcttaatttttctttaatccgtgggagataacttttctctttatgtttttaagagaaagacaaaacaagccctcctgttttcctttttggctgaggctgctggtacttcttcatctaaatacagtagttctcttaactttaacaacttgaaacttttattagttgccttaattagagcatcaggatgtaaataagtgtaaaaagggtgataaaagaagagttcttaattgcttttcagattttacatccctgagagggagcatttctttgtaacaacttcttttttttttttttttttgtaacaacttctttaaagttgttggtgatagtagtatcagtttaaatcactttcaaaatattgctgatttttctttttcatttcattaaattatcaatcttttaataaatatctcttaaatgcctggctctgtgctggatactatggggttgcaaaagaagtagaaaacacagcttctgtgcttgaggagctcagactacttggggagatagaaaaatgtgtgagtccactaaaaaaaaaataaagcatataaattcagtgggatattaactctgtgttccagaactttgaagaaaaatgacttatggactgagggtggtggtcagtgagagcttcagagaaagagggctagagctgatcttaacaaaataaaacaagatttgcccttctggatggtgggaggatagagggaaaatagaaatgtaggtatagttagaaatgcaggggatggggttcaggctggtggtctctagggagactggcttgagttgatagagagggtgcctgctggggataatgaaagagagaactggctttttgtgggaatcctggatgcagtgggctgaatggtggcccctaaaaagatatgtccatgtctgaatccctggaacctgtggttatcaccttatatggtaaaacaatgaatattaccttgtatggcaaaagatgtgattaaggattttgagaagaggagcttatcctccattatgtggatgggccgtaaatccagtgacaagtgtccttataagactaaggtagagggagctttgatggacagatgaggaagcagcgtgaccactgaggcagattgcagtgatgtggctacaagtcaaggaatgctggcagccaccagaagctggagaggcaaagaatggattcttccccatgacctccagagggaatgcagctccaccagactgccccagtctggacttccagagccagagaataaatttttgttggtttaagccaccacatttgtggtaatttgttacagcagccccaagaaatgagtatactggatatggtgacttagtaagtagtgctgagccagaggtcttttcttgaactcgagggtgacatggccaggggccattagagaaaatttattatttctataatgatcaggtattacttttttacagggaagaaaaacaccctaaagttattaaaagaaaggttaatctggcagctctttgcaaaatgaattgactagggaagtggggtggaaacggagagatggtggggagatgcactgggaacctattgtaacaacctgtgagtagtgccctgactggtattagggagtcagtgaagcaggatatttccctgaccctttcacgggactcacaacgggtgcctcatatactcagcccaccactctcaactccttgcaggagggagcatgtgagcaaatgagtgagggaactggagtgaatgagcacgggaatcggccagctgctttggtgctagcaggagtgaactttatgcaggcccaatggcagcatccaggtaggggtgcctgagacttccgaagccccagagggagtgttacagtgctctttgagctctgccatccgtggatagctcaactgttaatagctcagtggactctttgccttttcttgtgaggcaactgccttccaccagcaaggacaaagggccagtgtgacagccttttgtatctgcacttgtggctcccaagctcttatccagcgtccaggtaaaatgaggtcacacaaatgaattgaaggatggtgaatgcaggggattttattgctgatgaaagtagttctcagcaggagggggaactgaaaaggggatgggactggtaggtaatcttcccttgaagtccagctgtctccagccagactcttctctgaagttatgccgtcaagccattcctctgaagtcaagccacttctctctgacatctagccgtagtctcgtctaccagtctcgtctgggggttttataggcacaggatggggtggggcagggccatgggtgatttaggaaaaggcaacattcgagtgggaaaacagggatgtaagttctcattttgggccgtcatttcaggcttttcggcttgaggatggggttttgtcggggacccacccttttctgtctagaattttctgtcccctgtccctctcagtaggaatggagaagaagagagaaatcagaggtttataaaggaatacattggcatcactttagtgggtgagcatggagaatcacaatagcagagggaaacttcaatgaggtgtaacatgaaaaagtttgttagttaacctcctcagcacaccccttaactgagtgcctaatatcaaagtgagttacattaaatgaatgactgtatagcataaatacagcagtgcatttaatgcacctgtcagtgttagagctttttcaggaaattatatgatcagattaatgtgtcctgtctgagatgtggatggtaataggcatgcttgattaccttctgacaggttgccatgatacaaatctagggacttgggttctagtccttgctctgatggaagtctctggactaaaatcttgtcatctatgaaatgaagagatcacatatccttatctgtgtctatgtatacacatccctccaccaccagcattcttgtctatattgatattctgctatctgcaatgttattgtttatttcatatctgcttcttttcactagtctaaatacattaagattaagtgtcctattgttttgtatttatccctagagttttacagtgtttgggacaaagtgggtatttaataaagggtcattgaataaaggaattaatgtgctcctctttacctgaaaaagatgaggataatagtgcttacctcatctgaggtaatgtgaaataacatgagatagcgtgtagagtgcctcactcaaggccttgttcataatgagcgctttctgaccacacaccctggtttagccccgaatttatgtttttattctgtttgtcctgaaaaatgggaggtaaatggtccaagaatctttggaataggattaaatgtgggtgctggaggcttcctcattttaagaagccccagttaactcctaaagagcatgcaactataattatatgttctctttctgtggaagttaaacttgttgactgtgaagcctaggccatccataatttcctcaggcctttgcagactgatttctgttttgtctttcgctgtaatggttaattatagaattatcagcaatccctcccttgattaaatccagttttatcttaattctcaaccttaaaactcatgagttagaaccttatgcttgacccctcccctccagaatactcattcttctcataagcttctgtatctgtgctaccttgattctttcctttcagctatttttgctttttcaggctcactaggcaaccatgtctttttaaaaaataatagctttattgaaaggtaattcacaaaccataaaattcacccttttaatttgttcatcctgtgattcttagtatattcacagaattgtgcaatgatcatcactatctaattccagaacagttctatcactccaagaagagactcttacaaacaaactgtggtacatccctctggcagaatactatttagcagtaaaaagaaacgagttgctaggtgtacctgtagttccagctacttgggagggtgaggcaggaggatagcttgagcccaagagtctgagaccagcctgggcaacatagcgaggccctgtttcttaaaaaaaaaaagaaaagaaaagaaagaaagaaaaataaataaacaagctatcaagccacgaaaagtcatggaggagccttaaatgcatattgctaagtgaaaggagccattttggagaaggcaaaactgtagagatagtaaaaagttcagtgattgtcagggtttcaggagagggaggaagagagggaggaatagatggagcacagggggtttttagggcagtgagacgattctgtatgatactgcttatcaaaattcatagaatataccacaccaagagtgaactctaatgtaaactgtggacttcagttactaataataaatcaatgttagttcatcaattataataaatgtaccacactaatgaaagatgttaataataagggaaactgtgagagtggagaggggatagtataggaactccctgtactttcttcttaattttcccgtaaacctaaacagctgtaaaaaaataaagtctattgatttaaaaaagaaaaaaagaaactctgaggccattaacaggcactccccattttttcttcccttctcagccctaagcaaccattaatctactttaagtctctatagatttggaataatacaatatgtggccttttgtatttgtctttcacttagcataatgctttcaaggctatcagtgttgtaccgtgtgtcagcacttcattccattttatagctgaataatgttccattgtatggatatactactttttgttatctattcatcagttgatggacatttgggttgtttctgctttttaggtatcatgagtaatggtgctgtgaacattgatatacaagttctaatgtggacctatgttttcctttctttttggaatatacctagggctggaattgctaggttataaactttatgtttaactttttgaggaactgccaaaatgttttccaaagtggctgcaccattttacattcccacagcaatgtatgaggatttcactttctccacatctgcaccagtacttgttactggttgtctttttttttgagacggagtctcactttgttgccaggatggagtggtgcaatctcggctcactgcaacctccaactcccgggttcaagcgattctcctgcctcagcctcccgagtagctgggcctacaggcgcgcgccaccatgcccagctaattgttttttatttttagtagagatggggtttcactatgttggccaggatggtcttgatctcttgacattatgatccgcccacctcagcctcccaaagtgctgggattacaggctaagccaccatgcctggcattggctatctttttgattatgtaaacatcctagtgggtgtaaagtgatatattttgtggttttcattcacatttccctgatgactaatgatgttgagtattttttcatttgcttattggcatttgtatatcttctttggaggaatgtctatccaaatccttgcccctttttaaaattgggttgtctttttattattgagttgtaagagttctttatgtattctagatacaagtcccttatcatatttgtgatttacaaatattttctcccattctgtgggttgtctttttaccttgattatccttgaaatacagtttggtagcttgtgcttatcatatctaagaaaccattgcctaatccaaggtcataaggagtaaatcctctgttttcctctaagttttatagttttatctctgacatttaggcctttgttctattttttttaaatttgagacagggtctcactctgtcatctaggccggactgcagtggcacaaacccagcttcactgcagtcttgacctcctgggctcaagagatcctctcgccccagcctcccaaagtgctgggattacagtgtgaaccactgcacccggcttgttcaatttttaatttttgtatatggtacgaggtagtgatccaacttaattattttgcaagtggctatccacctgtcccagcaccctttattgaagagactattctttccccatttaattgctttggcaccttgtcaaaaatcaattgaccataaacgtaaggatttatttctggattctctatgcttttccattggtctgtatgtctgtccttgtgccagtattacactgtcttgattactgtagctttctaataaattctgaaatcagaaagtgtgagccctccaatttgcgtctttttcaagattgttttggttattctgggtccctcgtatttccatgtgaactttaggattagcctgccaatttcagcaaaaaggtagctgagattttgataggaattttgttgaaactgtagatcaatttgaggagtattcctttcttaataataataaatcttccagcccactaacatgggctgcctttccatttatcagatcttctttaatttcttttaatgatattttgtggtttttagtgcacagatttgacactccttatgctaaatttattcctgagtattgtattcttttttaggctactgtaagtggagtcattttcttaatttcattttcagattgttcattgatagtgtgtagaaacacaactgatttttgtatattgatcttgtatcctggacccttgctctactcatttagtagctctaataggttttttcaggggggcaagaattcttttggattggattttctatatataaaatcatgtcaccttcaaggagatagctttactttttcctttcctttccctgaatgcttcctattttttcttggtagttcagtgttaaatagaagtgatgagagaagacaagattgttgccttattcatgatctttgggggaaagcattcagtattctaccattagtaagatgttagctgtgggttttttgtagatgtccattatcagattggggaagtttcctcctatttctaggttattgagtgtttttatcatgtgaagatgttgaatttctgtcaagtcctttttttgtgtgtgtgtgagatgaacatgcaagttttgtcctttttttcctgttgatacagtgtattatagtaattgatttctcagttgtcaaaccaacatttattcttgagataaatcccttttagtcatggtgtataatcttctttgttgctagattcagccttctagtattttattgaggattttttgcatataaattcacaagaccatattggtctgtagttttcttctgatatctttggttttggtttcaagtacatattggcctcgtggagtaagttgaaataagctttctcctattccactttttggaagagtttgtgaggttaattatttaaatatttggtagaattcattagtgaagtcatgtaaacctaggcttttctttgattactaatcgaataaaattttttattactgattgtgtcttgttattgctatagatctaattcagattttctatttcttcttgagtctgttttgctactttgtgtctttctaggaatttgtccatttcatctaggttatctagtttttttggcatgcaatttttcctagtattcctttgcatcccttttatttctgtagtgttagtaatggtgtctctttcggtcatgattttagtatttttgagttttttctttctctaatggtccgtctagctaaaggttggtgaattttgttgatccttttgaggaacaatcttttggtttcattgatttttctctgttgtatttccattctttattttattcatctctgcctactatttatcattacattctatctgtctgctttatgtttaatttgctcttcttttgctagtttcttaaggtggaagattagattactgatttgaaaccacctttcttctttaaaacaaacaaaaaggtgtgttccgctccctctgaggaatgctccagttgtaccccatgagttgtggtatgttgtattttctttttctttcatctcaaagtatttttctaatttcccttgtaatcacaattgccatctattttcctcaaagtatttttctaatttctctcataatcacaattttctttgacacattggttatttaagaatgtcttttgttttttaactgtcatttattaaatactgattaccaggtactaagaattatatgacacagttccaggtgcttactttgaaaaagtcatgacctttagtttagcttgtcttaaaagagaaagtgtttaaaacagggagttggaaaattgggacctttagtcttgcttgtaatcagtagactttaacacttttgacatataatgaagacagacttagtatttcagaaaccttactgatgtctaacatctttaatagcccacctttgtgaaagaagctctctgtgaagggtaagaaaaatcactggctagcgggtttcttttctaagtgattggaggtagggagacaggtctttattgtttcccttgggctcactgtccgcatctcacaaatgtgctctagggcagaaaaagacataaaatggatagtgggtaaagaggtatactgttttaaagccagctgtttaaattttcacatgactctatgtcagtagaaataaaattagaacaggaaaaaaagctagatgtgtggggttattttcatagttttctttggagtttatgtcggtacatgaaagtcagtaattttgtttacccatattaatatgcttcctcacagaagttatcaggaaagagcaagggaacaatgtggttatcattgagtttgtgaaaactatgaattgtgaagaatggtcttttggcccaggaattagtgggcttgatttcagttttagctgctggttcttggttcctaattaacgccccctatctgttcctcagtctttatggcttatgaaatatataaagtttagtagttaaggcaactggtactaacctacatttgtgtaatacttttttctcttttatttttttaatctcctcaaattccttttaccaaatactttttttctttataaagtagtctcatatacattgttatagctaagatttacaataatcctgtgttatacttactctcttagaactttaggcattagctgttacaaaaagccaaaacatttggtttattactgagaaaaagttaagctagagaagtggtgattatgtagttttaaatgtaactttataggaaatgacataaaatacagaaaccttggattcatatactatgcctttctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagtcaggatggtctcgatctcctgacctcgtgatccgcccgcctcggcctcccaaagtgctgggattacaggcgtgagccaccgcgcccggccagcctttctaatttaaaaaaaaggaataacacagttccaattaaaatattttgctgccataaaaactaaacaaagggttatagcttttattttatatttttatgattgctaggtttgtttcaaaaatcagtgaagtccatgaagtacactgtgttctctttctggcgtctcaaaagcagctactcctgaattaattaaaaagagcaatatatgaggtattggattatagtgttgtatgattaatgactcattttactacatgaagaatagatgtcattatccatttatttcactacagacatgagttcttgatgtaatatataagcttttcaaaaagtgtattcaatagtaaatacactttgttttaactcaggttgatttcaaaatattttattaaaattatgtgattgatgagatataagcataattttaaatttaacccattttaatatctggatgaactaggtcatcctgcaattgctttcaaatatttggctctgaagaaagtttcattatttttatatatatatataaatttttttaatttttattttttattttttactttttgtttgagctggggtcttgctcttgtcatctagcctggagtgcagtggcccgatctggacccactgcaacctccacctcccacgttcaagcgattctcctgccttggcctcctcccaagtagctgggattacaggtgcccaccaccgtgcccggctaagttttgtatttttagtagagaaggggtttcaccatattggccaggctggtctcgaattcctgacctcaggtgatccacctgcctcagcctcccaaagtgttgggattacaggtgtgagccaccacacccagctagatgtatattgttataatgtaataaaaacatgacgattgggccaggcccggtggatcacctcaggtgggcacctgtaatcccagctacttgggaggctgaggcaggagaatcggttgaacctaggagcaggaggttgcagtgagctgagatcgcgccattgcattccagcctgggcgacaagagtaagactccatctcaaaacaaacaaacaaacaaaaaacatgacgatgatgcagaagagaaaagctttaaaagaccaggttttgaaaacttgaaactaacttggaagcagtactgaagaacctggctttaagacggtgatggaaaggacagattttttttccccagagccttggagtaatctgtgtcatttcagagccaccccacaaaaatgctagatacaatggttggccatcatgatgtgacagaagtttggtaaatgtggctgattcacatttaaagcttggttttcttgacctaactattagacttagtaatgatctcatctttttagggtacttagcattgtgaatgtgatactaatagtgatttcaaacaaatcagagtttttgtttccaaacagatattgaccctttgagttttgctatctgggaaggcacctacatttattctaatgatttgccagtgtttgaattttgcatcttctcttttagaattgcctttaaagccttagcaatattcctgtcaggacactaaagatataaaatgtttattcttcgagggcgattttcagaaagagctagacatcagtcattcagaaccatgtcagaaaaataaagtggataatcagattgggaatttaaagaatagtgtatagttctaacatattgtgttatgccttataaaacttataaaaacaggctccaatactacttttcagaaaatctttgaactgtggcattattggaataaatgtaccccctttcaaggtgactgcattaaagaacacttacttgatgtgtaagttcaggttcaagtgtttagtaattcatcatctttaccatatagttacatcttgcataaaaacttgggaaggtttcaaagctaaacaatgaagaagattaaattactttggcagtcacctaataattgtgcctaggcaggtaattgagtaacaggaatattgagaggttgctttatgacatcagtgggagcagggagaaatctactgagacagttgaggctttctgtttgttcctttgggctcaacaaatttgagggaatttatagccaaattccttaggatacatatttatgtgtgtatatatatacgattttatacacatattttatattttattatctaatttgaaaatcataaaaatataggtgaggaaaagctatttataattacacctatcagagaagtcttcactgaccttgttaacttcctttcttctatgtattgtcttataatgttgagatcataatgaacttacagttttgaatgttgagttctttaaatgtattttgttgcaattatttttctcaaggcaataaaaacttcttcatgagtccaggcacaatggctcacacctgtaatcccagcactttgagaggcggaggcaggaggatcgcttgaggccgggagtttgagaccagcctggtcaacatagcaagacaccatctctacaaagcgattttttttttttaattagccaggcatggtgatgctcacctgtagacccagctactagggaggctgaggcagaagatcacttgaactcaggaattcaagaccgcagtgagctatgatggtgccactgtgctccagcctgggtaacagagtaagcgagaacctgtctcaaaaaaagaaaaaaaagtggggcctggcaccatggcttactcctagcaccttgggaggccaaggcaaatggatcagttaagcctaggagttggagaccagcctgggcaacatggtgaaaccccatctctaaaaacaacaacaaaaatagaaaaattagccaggcatggtggctcatgcctatagttacagcgacacgggaggctgaagtggaaggatcacctgagccctggaggtcaaggctgcagttaaccatgattgtactactgaactctagcctgagtgacagagtgagaccctgtctggaaaaaaaaaaaaaaaaaattgtcatgaacaaaatatttagtagacatttttcttatctatctccatatggtttgtaaagtttactggtgagctaaataaataaataaataaagtttttattatctccatatggtttgtaaagtttactggtgagctatttaaactttattatcaaataaataataaaaatgtatattatttcttctttcacattcatggtttcaaaagtgtcagaaaataaattagggaaagacccagaaggcatttgatgggattatgctttcttagttccgtagggcttcactcacgttttgtttataaatgttctctttgctaatatgcagccatattcacttttctgtacacagaactaaggaaaaaattatttcttctctcgcttgctgaaggtggttggaggcaaagtaaagaagcccggtaaacgtggtcggaagccagccaaaattgacttgaaagcaaaacttgagaggagccggcagagtgcaagagaatgccgagcccgaaaaaagctgagatatcagtatttggaagagttggtatccagtcgagaaagagctatatgtgccctcagagaggaactggaaatggtaagaaatcgtcagtaaacacatgaaaaaatcaccttaacagtcaaataaataatacattaaaatacgaaaataccagttatcacctgtccagttggcaaacattggagagaatattaatctgttagccaggatgggggcaaataggcatcttcatacactgctggtgggagcagagtgtacgtgactgttaacactaagggattgtttatgagagaagaaaatggaaaataacccagatggacaataataaaggactggttaaataaatgttactacatccatgtattagactacttcgtagccagtaaaaatcacaatgcacatatatttactgatgtagaaagatacaatatattgctaagtagacaaagcaatataacaatatgtaactatgcatagcataccatttgtgtttaagtgactttatttatttatttttattttttattttttatttttttgagatagagtcttgctctgtcgcccaggctggagtgcagggcgcgatctcagctcattgcaagctctacctcccaggttcacgccattctcctgcctcagcctcctgagtagctgggactacaggtgcccatcaccatgcccggctaattttttttgtatttttagtagagatggggtttcactgcattagtcaggatggtctcaatctcctgacctcatggtccactcgccttggcctcccaaagtgctgggattacaggcatcagccactgcacccagccaagtgattttgtttattttacatgttttattcactcatccattcagcctttgggcagtggctgtaaaaatgtgaaagagagtagataaaacagaattgaaactccattattgtgagctgagggaggaagtgacagaagagagagatgatattactgtgatcattacacaactgggacaggcttctacaggtttttagaaagtaagacaacaaggttggaacatgaagaggagggacatgaacagtgttgtatatattgtccagatatatgctattcagtagatttttttgatatgttgaatgtgacatgctatcaattatttcttactttctgcagtgtaagccacttgagggcagaatctttggtcagctttgtctttgtatacccccaaagtccctagcatgcactctggtagatagtagatgtttaatgatcacttgttaaagagagaaaggaaattactaacatttatttctttattttgggagtagaaataatactgtgacaattattaaaaaaaaaaagattaattctaactagtggcacactgtggggagatgtccttttaaccacaggggccttttaaatctgagcaacactccagtacatcaaagacaattcagcagcagtttttccgcctcttctgaaagatggcagatctcgtacatgtcctcagttataaataggtaataccatggagggtgggattcccagcagcgaacgtgacctctagccatgggagttcctatgtctaggatttctaccagtggttcctgaactctgacaagtaaaagttaatttaaatatgttttaaatttatatttatatttaaaattaaatatgtttcagtacaagcagtggtgcatggcaatggaccaaggaaaaatcccttctgaaataaaggccctactcactggagaagagcagaacaaatctcagcagaactcaagcaggcataccaaggctgggaagacagatgctaatagcaattcctgtaagtgccatcaatgggagaatttatatttaagagagtgtctcggttgggcgcagtggctcatgactgtaatcctagcactttgggaggccgaggtgggcagatcgcttgagcccaggagttcaagaccagacagggcaacatggcaaaaccccatctctacaaaaaaatacaaaaattcgctgggcatgggggtgcatgcctgtaatcccagctatttgggagactgaggtgggaggatcacctgagcccagggatgttgaggctgcggtgagccatgatcatgaaaccctgtctcaaaaggggggaacaaaaagagggtatctcaaggtagggtatctcagggtagggtttctgttgaccacttttcttagtatgtctttaaataaaatgttgatgccatttttaatacactaataagcaaatgaaatggcattagattctggccaggtgtggtggcttatgcctgtagtcccagcactttgggaggctgaggtgggcagatcacttgaggccaggagtttgagatcaccctggccaacatggtgaaaccccatttctattaaaaatacaaaaattaggcgcagtggtgtgcgcctgtaatcccagctactcaggagtctgaagcacaagaattgctttaacctgggaaatggaggttgcagtgagctaagatcatgccattgcactccagcctgggcgacagagtgagacctcgtctcaaaaaaaaagaaaaagagaaatggcttagattctaaatattaaaatgcattttacatggagtctataaagagcaactgataaatttatcgaaattttattattaatagacttagtccataaatgggagtggcacgaatctagctttttgttaataataataccttttatttgtattttgatttacagtttacagagtactttcatttatatttatcttaaatattccctccattgattgtgttaaggaattatacttattttatagatgaaaaaatagcagaaaggctggctaaggtgcccaaggtcacacagctttaatggtagaacctgtcctcacctaatccaggctgtctagtgcagtagcccatcatcgtaaggattgtttttaattgaggtaaaattcacataacataaaaattgagagccatttagtacattcacaatgttgtgcaaccattatgtctacctagttatgaaacttttaatcacctcaaaagaaaatcctgaacccattaagcagttattccccattacccacttcccccaacccctggcaaccatgaatctactttctgtctctatggatttacctattctgtatattaatattttatatacctggagtctatacagtatgtgactttttgggtctggcttctgtcacctagtataatgttttcgaggttcatccacattgtagcatgtatcatcagtatttaattcctctttatggtcaaataatatttatatatatacagttgtttatcctttgatggacatatgtttttacctcttagatattgtgagtagtactgctgtgaacatgtgcatataggtatttgttttcatacctgttttgaattcatttgtatgtatacctaggagtcaaattgctgggtcatatgacaattctgtgtttaatttttgaggaatagtcaaactgttttccacagtacctgaaacattttacattcccaccagcaatgtatgtctgctccaatttgtccacatctcatcaacttattttccattttttaaaactatagccatcctaatgggtatggagtggtatctcattgtgtttggtttgcatttccctaatgcctaatgatgctgaacatattttctatgcttgttggccattcgtatgtattctttggggaaatgtctaggtcccctgctcatgttttaattaggttgtttttgttgttgagtggtaacagttctattgggggaacctgcccccaatatttcaatgtaggttctttctattttccataaatgtcggccaactgagaaataaagagagacagtacaaagagaggaattttacagctgggccgccaggggtgacatcacatatcggtaggaccgtgatgcccgcctgagtctcagaccagcaagtttttattaagggtttcaaaaggggaggtggtgtaagaacagggagtaggcacaaagatcacatgcttcaaagggcaaaaagcagagccactaataagggtctaacaaagatcacgtgcttttgagggaacaggacaagggcaaaagcagaaccactgataagggtccaacaaagatcacagggcaaagggcaaaagcagaaccactgataagggtctatgttcagcagtgcacatattgtcttgataaacatcttaaacaacagaaaacggggtttgagagcagagaagcggtctgaccacaaatttaccagggcagagtttttccccaccctagtaagcctgagggttctgcaggagaccagggcgtatctcagtccttatctcaactgcacaagacagacatttcccagagtggctgtttatagacctccccccaggaacacattcctttcccagggtattaatattaatattccttgctaggaaaagaatttagcaatatctttcctacttgcatgtccgtttataggctctctgcaagaagagaaatatggctctttttgtctgacccagcaggcagtcagatcttatggttttcttcccttgttccataaaaatcactgttattctgttctttttcaaggtgcactgatttcatattgttccaacacacattttacaatcaatttgtacagttaacacaattatcacagtggtcctgaggtgacatacatcctcagcttacgaagataataggattaagagtaaagtaaagacaggcataagaaattataaaagtattatttgggagcagataaatgtccatattaatatgaaatcttcacaatttatgttcctctgccgcggctccagccggtccctctgttcagggtccctgagtttccgcaacagagttctttattgtggttataaaacctttatcagatacatgatttgcagatattttctccccttctctaggcttcttttcactttgttgatagtgttctttgatacacaaaatattttaattttggtgaagtccaatttatctatttttgtttttttgttactcatgcttttggtgtcatatctaagactccattgccaaatgcacagttatgaagatttacctgcctcatgttttctaagaattttatggttttaactcttttatttgggtgattgatccattttgaattaatttttctatatggtataaagtgggagtccatatgttgcatgtgagtatctagttgtccaagcaacatttgttgaagaaactggaaagactttaaaatgaatatgtcctatgttgatttcttcattattgtgattgctctgggagcactttaaatagctataaagaaatgtcacaaacctttattattattattattattattattatttttttttattttttttttttttaggtcaacctctgggagcacagaacaatgtttcaatatttttttttttgagaagaagtctcgctctgtcacccaggctggagtgcagtggcacgatcttggctcactgcaacctctgcctcccaggttcaagcgattctcctgcctcagcctcccaagtagctggggttacaagtgtatggcactgcacccggctaattttttgtatttttagtagagacagggtttcaccatgttggccaggctggtcttgaactcctgacttcaggtaattcacccgccttggcctcccaaagtgctaggattacaggtgtgagctaccacgcccatctagaacaaacttcttatgttttcagtattttttacaaaattgaagaaatcggctttttgataacttttattagataacatttgtcttcatctaggttgacaagtgcactaaaatatcagactccaccactatacaattcacccacgtaaccaaaaaccacttctaccccaaaagctactgaaatgtttaaaaattaaaacatttggcttcatctaaattaaattaatggaaaaaagccaaatcagcttttttttagtctgtatttttaaaaattagccttactgaagatactaaactgaaaaaaaaaatttatgcatcttaaaacagattaatcaaactttattgactctaaaaacattcttacattggtaacttttatttttcagggtgaagattatataaagatgagtcagtgattgaagccaatattctgattcccatggaagatggatgggcaagagtgtacttcttggctccatttactacctactgctcagtagtcatctctgtaaatctgcaatttctaccaaaatgtgtgatcgtagatctcaaaggatcttgctttaactttcaacacttagaaaatctacaaacattcagacctgtctgggttggtattgccacccatgacatttaacatgttgtgatgcttgaaaacacaggagtagagaaaatcgatgaagattgtatttttgcaccttaactccacattgctttattggttaatttatattctttccatgtaattcatgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttaaaacaggagttgtgttctctgtcgctgctaaattattcttcacttgagtgaagcaaatatttagcttccaaataaagtatattttgttctgaactggcagtttaagaggagataccgtagtctagattgtctttgaggtagaatatatgatggaccacatagtttaagattacaaggtactttccctcttctctcaggccatgcatttgaataaagtgcctcccttagcctgagctcctaaagacctcttgtacttggttgcaaactcagatctctagtctagtctagtctagtctagtctagtcatgtgtgactgtgtactgagataccactagcccagtttgctgggtctctatgttttggaagttgggggtttaataatatttaatgtctttttaggatcataaacataaataggtttgttgatattcaggccttcagaatttaagggttttaaatatagcattcagattgtaattggtatgtttttgccatctggtccactcaattgtatatttttattttgcaaaacaacccaaaacttactttatgttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcacttttgaagcatgttaataaatgtcactgattaaaacagctggagcatttccttccctttccagtgaaggagcagcatagtgaaatcctggcacccctcacctttttgtgatgacaagatggctgacagtcacggagtccaggagaaggtgctgctctccttgctttctgagtaaacagagtaatgttttttttcttattttcccaaagaaagaaaagggggaaaatatatttgtatgtttagaccagccaaattctgtcattattttagtatcaacctgctgtatattagagcaactgaatataatatggaataagtttgaccaggtcaagttttaggatatagttgaatttctttaaaaagttttctattttatctaaaatctttccattatatctaaattagaatgatcatcctgcgcaaattcagattactgtttgctggctaattgacagtatttctcagcatcactatgtagcattctgttttagcatctttgaattatgatcatttgatttggctaattacaaaaagtacaggtttaaactggacttagcttgagttaaaggcaaagaaaatctaaaaacataaatgttatatttcacaagaaatcagttgcatattatccattacatatttagttttaaaaggaggagtcaccttgaattattttctgagtcaccttgagttatttgatctctcagcctgctttctcatctgtaaaaaaggggggaggataactttcacagggtaattggtaggctaaataggagttacagaaaactgttaaatagggaagaactacattaaatttaaatattcacatt

SEQ ID NO: 36039 - DNA, 45145 bp, Homo sapiens
ccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcggtgagtgacccccgccggcatccctcctcccgcttcttcgggccggcctgtgcggggagtttagggaagtggcagggtgcagaattgaaagggagcggcggtgtccccagccctccccggcggggtttgccggttcagataacccagtggagggagactgcgcagcctcgcgtgcgttcctggatcgcccccaccccagtcttcggcgccgggagacgggaagcgcccagcctcagccctggacactcccccacctggggcaatggaggaacgtccgggcagcaagttcagtgcacgtttgtctgcgtgtgtgtgtgtgtgtgtgtgtgcaattacggatactgttggtgttttggattaaccccaaatttgccattcagaaaatatgtaatgctaatataaagatcggctggtgacattgagctctgagataagccgtagtgtactttagtaaagatgcttagttttatggaaacataaccagtccttgaaccgtattgtttccctctgggagaaggaaaaagcaccaaaaagaggtacaaatattatctatacctccaactttcacccaccactttttgagtgatgaaagacttttcatgttaacaactacaaatggcaaatcgatgattgtagaaagaaatagttgagcttttttttttttgaaacaggatgatcagttttgtttaatctagcagacctagccgactttggttgggtcagataagtgctccgaaagacaaatcgcattcttgctaggttttatgggataacagcctaggaaaaagtattaactttttgtttttgtatcagacagaaagtgttataaaaacaaacttataaaaaagataaaaattgaccagtattagattcatacttctgcagttaaggtctatcttgaagaaaattgttgtttggtaatcccaagaatagtgagatactgtttttttgtaatgaaaaacataactagagttgagtgatcattatcagtgagaccagaatgtgagggtttttaaaggtctgatctctggcattgaaaggtgtgagaaaatagcactcctagttgaaggagattaaaaattaattgtaaagtatggcatacgaaacagtgactaaattatgttgctctttgttggtaatgctatgtagtagaactaactttctacattgttaccatggtatgaaattttaatatgttaatttttcctctaatgtcattctatagttaatactgtattggggctatttaatttggaaatagggcagaggtcacaggagatgggacatggatgattgaaagcattgacactgaagacagactaaagttctttagggttttgatgtgaaagtttctccaaagttcagctccaaaaaatgaattgtcttagctccttggtaggcctttggcaaacaagtcattaggccactaacaattgccaactattactgtgtaaagactgtcaggcgagttctttgttaacaagtccactagaaaaactcgtgtgtaaatgacatcatagcccggcagaggcggagtagttaagcccagtaatccttttcctttgggatggtatattttacatatagtcaggaggcttgcaaggcctggattagttgtcaaacttgaggctattagtttcttaagagtttttgtggtttacagtactcagcttctgcagtggttggcacatcaaacctatttttccgtttacacttgttttaagaatgtcttatttcttcagattttgtgtttacacagatctgtagttatcactatgattctttttgttggaatgctaaaatttaggattcataaaatgtactaagattagaaggtaaactttgatgaggcacaaatacgacatgaactatgaagaaagaactaaaggaaaatgaacaaaggaaacatacatttattctaggtttccattgggaaaaagttgcttataagttccgtttcaaaatttcagtactctatataaatggtaatattaggaataatggatacattgttggtttgtgaatccgtaatgaacagttaacctttaggtaagctgataagcattttagttgttttttggttggttggttgtttttttgagatttttttttttttttgagatatttttgagttttgctcttgttgcccaggctggagtgcagtggggtgatcttggcacactgcaacctccgcctcccgggttcaaacgattctcctgcctcagccgccccagtagctgggattacaggcacgcgctaccacgcccagctaatttttgtatttttagtagagatgggtttcaccatgttggctagggcggtctcgaactcctgacctaaggtgatccacctgtcttggcctcccaaagtgctgggatcacaggcatgagccaccacgcctggcctggttttttttttttttttttaacgtgtaaccaaaaatacattacaactgaataacatagccttaaaaaatgaaaggcaacatgttttggttcattgttttcagaaactagtttcttgcatatagtaacgacattaattattgaggtctcatatttttgttcagttttttaaatgaattatttcattttgtaaaaggttataagagcagccaggaggagcggaattggaaaatctgtgggtaaaatcttctcggtttggttttttcattttactggttcctaatcctgattcataatgaacagtttaggagagaattgctgcaatgcagcatttaaaactaaatttttaaaaacatgatttaagaacattttgtatacaatcttctatttagatcaaaattgaaagaatattgtagtttatgatgttagaagcataatcagtgctcatggagaaagtaatttttaaggattctgattttcttataacttgagtttttaatactttgtctaaacttttttcctgctactcatgtaatcagtgattttaatatgacaccatggcaggcaaatctttcatagtgtttctgtgtatgctgtacagcctttaatacagaatttatttttaattaagtgcttggtgaagtgctataaatgtaacatcgaatgaaatgaattattttatgaaagtctttaagcgatatacatataaactatttgctttaaattagagaacttgttaccgcaaagcaaggaggacagggaaacagtttatgtctttgaaatgagcttgctggaaacaccagaaaaaaatcagtagaaaaaattaggagcttgctaaaaacaccaggaagaaaaatcaataaaaaaattacatctatctatttatgaatcatgaaagtagaatatggttatttgcatcattaagtatctttacaaatcattattccttatatggtacaccgtaaaggctgccaaaaacaagctgtggtagttccgagaaattagaagagaataaaactaattagataatcttgcccagttccttgcctaagcaaaacaacattctcgcttttcaagtgaatgatttggtgtttgaaccttcttgattaccttaagagggaaaaatgaaggagaggagggaaccatcatcacatacctttacagttgtggaatgttagcccactatagtgtttaactaaggaaaatctaatataatacactcccaagtgatctgaaatgatccgctattcagaattccagagaaagacatatccctgccagaagggtgtccttcataaccaaatttggtcttcagtctggtcggtgcatactcaaacaggaatcacttcccttaaggaacctaaggtatgcagttgagatcaacttattcctttttgatttgtccccttaaagcatcaatcagacgtgaatgcatcttgtgacttggagttactagtaatattgaaatctgaaacttgggggatctttgaagacacatgggattaaaagctgcataatgtacatttcgaggctaaaaaccaggtttgaaaaatacagatgtccagatgagtttttctttaatttatttgaaaaatagagatatgccttaattatagaccattagaaataatttttgtgtttcacagagtcttgattttcattccaggaagccagagtcagtaatttatggctagatctttaattaaaacatttgccttacttagtattacaaaatcatcatttggttttgcaatcaagataagactgttttgtcaacttaatgctaagcacttaatttttatttaacaataacttctagaaagataatcactccagtctcaattatttttatgtttgtgtgttaccttttaatagttgccatttatattattttagtaaggttgtagtggtagtttatatatttgcttggagttgataactagagtaagcagcttcataaagtacttctgaaggcaggctttactattaaaactgtttactattatgaagctgtttacattatttctggcatatctcttggtaaatggtttaggggcactattttctattgatgtaaaaattgaggccaggcatggtggatcacgcctgtaatcccagcactttgggaggctgaggcaggtggatcactggaggtcaggagtttgagaccagcctggccaacatggcaaaacctcatctctactaaaaatacaaaaattagccaggcgtggtggcacatgcctgtggtcccagctactcaggagtatatttgtagatacatataaaattctcttgacattacttgatcacttatattagatccaagtgtataacttaacttagtattcaggtttttatctggccttatcctctattactctttgaaccctacagtctgtactaattatttctaaaattgtgttactcatctacaatatctcatatctttatagtcactaaatgaatgtctgctggataaatgagggaaaattactttctttttgcatagaaaaaactattagtatggtttgtttttgggtggcgattgttattttgattgtacttaacgtttgttttcagaattgttcaccatgaatatatcttgtgtcagcagtaaaataatagatttcttttagtcacacctgtagaattgaatgttaattgtttcagtagcatctgagaaaaggatacgttcacatatgtcacaactaaagaataatcagacatcgatgcctattttaaattgatgccaaagtgagatcagcttcttgtatctgtcagtaatgctttcagctttagaggaaaaaccaacagctaatagtggcttaaataaataagaggatgtttttctcacataacaaaaagcctggatataggcccttcacggttcctcactctgttatactttgtcgtccttagctgttgcttttcatcatcctgtttgtcgtatttgcaagatggatgctacagctccaggcattcattccaggaaggagaaagggcagttttagctgagatggtcctttttatcaggataacaacacccttctcagagacctcgaacagaccgccacttcatattattcagagcttggtcatgtgactactagttgcagggagactaggctaacaggtatttggctttccggcctatttattgggaggtagcaagggaaaggggaattgggaatggctttaggagtgtctggttcattgttacttttatttcagactttgaagtggggatgtggagggtagtaggtctttttcagctaagacttaggaagtgttttctaatgttaagggctttttctggggtcatgattgttttgtgttttagggcccaacttccttcctttcctttaggagaaactagagagcaggcagatacttgcaaatacctagaaccccttgcctcttatttttggatacctactctttctcctagattattaaaattgttcctgcaagcatttaaactacctcaggtcttacaagtcttaaaaaaaaaataactttcttagacatacagcagattttctgcaccacttggttacctcccattctttttcaatccattccaatctgacctttgtcattgagtactttttagttttgtcttggcctcacaactgtatttgacataatcactccctccttgaaaattattattttttgacttgcatggacaccactgattttttttttttgttcaatacccctggctccttctcagactatattagtggttctctgagagtggtccatggagtccccagtatcatttctggggtccagaagatcaaagctgttttcagaataagatgatgtctttttaaccgttttgatatttgcatttgatccttgctccttgtacttcaacttaacaacttccattggtttcttgaatgctacactgttctttctgccttaggatctttaagtatcctcccagtgcctagactactttcctacacgaaacctttttcacccttcatgactaatactggggagagtgatgatgagttagttgctgcgtatttttcagttcttaaatattctttctccaagggtgtttccgtgatattctgctttcccgtagacttaggttctcctcctatattctctcattgcactttcatagcactcaattgcatgagtcagaattctggtcacttaattttttaatgtctgccccactattatttatgctccactaaagcagagagggaatctcttggttatcattctagcatgtcatctcacattccataagtatttgttaaatgaaagaatggttgaaaagctgttgcaggacaggcatggtggttcacacctgtaatccgagcacttggggaggctgaggcaggaggatctcttgagcccagaagttcaagacaagcctgggcaacatagcatggtggcacatgcctctagtcccagctgctcaggaggctaaggtgggaggatttcttgagcccaggaggttgaggctgcagtaagcagtgattgtgccactgcactccagcctgggtgacagaaccgagaccctgtctcaaaaataaataaataggtatttaaaaaaataaaaatcactcagcaatatttggctgccatagtagtgctaattataattactgggaattataattgtaattactgggccctgggaatgcagcaaagactaaagaccattcttgttttcctggagtttattctaatggatttgtgcatggtgatcccttctacttcaaagattcaatgataccaaattatgcatactaggtatactattttgaggattaaatatattatatgatggcatctgtaaaggttagaaatgttcatttacctttaatttgtatagttgaaacacttttttgtttttcagtccaagccttatgcatttgatcgggtgttccagtcaagcacatctcaagagcaagtgtataatgactgtgcaaagaagattgttaaaggtaaatatattcaacctgctgagttgtctcagcaataagtaaataagtttgtgatcttttctacttactcagcttccttttttcattttaatgcccctttcttctaagttaattgcagaagaaagttgtttaaataataaaaaggtcaaacacaattagtaaatattctattgctcaaattccatgatctaattatatacagtacctaattaaggttattatgagaactatgttacacacttattcttaagagatgcatttctgttagatattcccaggagagtttccaaggtggcagttctagaaagagaacagtatgagaatgaaaacaaaagggctagacacatttctaaaaagtagtggaaaatggcagtctatcattcttccattccattgttattccttccccaaagacttacctatcccttgaggaatttaacaagggttgccaagggtgagaaaagtatgtacattccagttaatactataacttatacaagaatatttataactttatatattctaaaaccattgaattttaaagctgagagagtgctcattgtttatctggagttacttccagttactgtagaaatctgtttaatcaaaggaatggctgttactttgtgatatgatttatttcattttttgacagctgtagttgttacaaagtgcttcttagattgaggcaaaatctgtgttgtggcattcaccacattaaaagaattgggattcagtataaaaataggtggattaggatagcataggagcacagatgctcatcctagtaacaggagataaagtggagttatagaaggtttatagatgaggtgagggagggaaaatgtgtatgtactcattatatcaatttcatattgtctaatacagggagcaaagtcatcatggagatgaggaagggggaagaggttctaggaaaaggcatgaaatggatggattcaggcagtgtgagagtattgccaggcagtattaagggcccactcaaggttagctgctgaaagagttgaatttttgcccatttggagttttgctaggtgagtacaaaagagggaagtgggggacaagagaattgaggatatagtcaaaggagtgattataatggtggaccatgggatctaaggtggttaagttacaggaagaaggatatgagggaggctgaagggcagtgaaaaaaggtggtaacattagtgggttgtagatctcagtggggtcaaagatttgttggaatcagggtactggacggagtaatagaaggtgaatacagacagtccctgacttagaacaacttaaaattgttcgactttacgatggtgcaaaagcaatacacattcaatagaaatattcaatagaaatatttctagtacctgtacaaccattctgtttttcactttcagtatagtattcaataaatcatatgaaatatttaacactttattataaaataggctttgtgttagatggttttgctgaactgtagatcagtgtacgtgttctgagcacatttaaagtaggctaggctaagccatggtgtttggtaggttagatgtgtttgatgcattttcagcttagggtattttcaacttacagaacatttatcaggaagtaaccccatcgtaagttgattagtatctctacttgaaattgagattatggaagcaatgcagttagtaatgaaaaggtaaaggtgttgtcatggagttgacttccgaggtagtaaagaaaggataaggccagacatggtgggtcacacctgtaattccagcactttgggaggctgaggtgggaggattgcttgaggccaggagtttgagaccagcctgggcaacagcgagaccccatctctgtttttaaaataaaaatgaagaaagaataagatcgcagaaaatttggtcaaggagctgagaggccaggttattttagtgggattatctgctacagactttgaaaccaccagtactgttttattacaacagtaatggtattggtgagagagagtgaactgggtactgacatcttcataaaatgaaggggaattaacacttgtaattgtgtaaatgactgcaacaaagaggaacagggtcatcatgttgtaagcatcatgtggttttccagagggatcgatcatagaacacaattttactacattctttgattgagacatacttctgtctcatcagtacagtttaagattacattagctttctaaccaatagaaagttaccgattcatgaattcatgggcaatttgaatatacaggtcttttttgtatctcttgccgccagctttaagccccattccatacttgcactttggagagcaaacctttaaagtgcagattccattttgttcattttagctcttaatcatattttgagttttatactggggatctagtaagttggctgtcagcacatttgataagtctattaaagtgtcaaaggttttgaagtttgaaaaatatgattctaaaccatttataaagtgcttaatgggtcatggtccctaggttaatcttctaaaatgaataagattgttggcagttatttcaatcacactgtttgggtattcagccaacttcagagcctcttacctatacgattggctagtccttagtttgtcaacatactcacaagaaaatgatgaaaaacttgaatccttttatcaagtgatggtgcatgactctagtatttgcccaaagtaccagttgaataaccatatccaaacaggaaatgaggttagttcaaccatagtctttacttaataaaattttggtatacttatttccataatctatcccttttcccattttgaaaatgtaaataacattagtgtcttctattacctttgttctctttggcttttaaaagtaacctacagtagctgtgagatttttatccctggaacgtaatcctccttagtaactagaaacttgggctcatttgaagccattcttttgctatcgtactatccacataaaccttaaagtccctttcaacaatgtttattctgttgttctgttttgaggatcatatttgtggaagatggtagtaaatagaagtacctctgttttaatatcatcagttaatattttctggtctttcctaagcaatgcaggttcattcattcattattttttttctgaatatgactttaaaagttctttttagggccttagtttttattttgttttggtcttaaagttacttatcctggacttttatctttctcatgctgttctcgtgagttctgtctcttctcttgtatatccttagttacacagtctcttaataataggctgatactcagagtttttcaaaatctattgttttttaagtggtacctaaccttaaggaaaagaaaaagatgaagtctgttttcctgacgtttaggatacatgcatctattacttttgttctgttttattactatttgcagttctaagatgaaatcgtttgcttcctgaaatttctcttcttttctcaaaatttcagtcccttcttcatcctgctttactgtttggaactgcgttcaggataatagttcccttctctgtaatatggtaagagtataatctttagaatcagacagtcctagattgaattctaggctctgccactttcttgctgtgtgacttttggcaagttacctaacctttccaagcctccatttcttcttgtgcaaaataggtactaggagttgttaagcacaatacaggtatcagctgctaattgtgtcctctgtcgttgtcttctttttttttttttaaattgagacggagtttcgctcttgttgtccaggctggactgcagtggcgccatcttggctcactgtaacctacctccgcctcccgggttcaagcaattctcctgcctcagcctcctgagtagctgggattacgggcatgcgccaccacaccctgctaatttttgtgttactagtagagacagggttcctccatgttggtcaggctggtcttgaactgccaacctcaggtgatccgcccaccttggcctcccaaagtgctgggatcacaggcgtgagccaccacgcccggcatgtgtcctctgtcttcttagaggacattattaattcaatcagtcgtgtttgtatttgggataaactcatagtctcagctatttctactgtacaaaattagacttccagcaagtgttagaatacaaggtttctatcataatctctttcttcttctatgcaacctttgtaatttatgtcagtatcacctggcgatgatttccttttatctttacccaagtgctctgtaccattttggaggagactgcatgtagtagctggtgggacttgtcctggacaaggatatgaatgtggcagagttaccaataaatacacatatttaaggagaaagatggcgtaggggtaggtcgtgggtacctagggaggtgtgaggacaggaaagcaattaaatacatggtaggttgtacttgggacaatcattgttaaacagattggatgagaagccatggttagaaattgttggtaggcaaagatcagcagaatgatgggccagctgggatttcttttgagatagggatttgatgagcaagttgccagtaatgacctgaaagcagatagtactctctgggtccccgacaagttcactgagaatgcactggctcataattatctggacaagtttataacttgattttatgtagggctattaacattccctatctgtagatttgttagatacaattgttacttttgaataaggtttatccacttgtattctcttgaattctgaatctgagtgatttgtttcccttgtgttaagtagctatttattcattgcccactatatgataagcatctcatcaggtctttgtagatttcctgttttttccaccatggcttcctgacctgaactctctgccgctgtattcacctttggtttttccagatgtagcctaccttgtatttattttggttcctctgctccttgagtatatagtacagtggttaagagcaggtctctggaaccaagtctatttgcatttgcgtctcagcttcatcttactagctgtggagttacaggcaagttatttaacctctctgtgtctcagttttctcatctataaaatgggactaataatagtacagtgcgggctgggcgcagtggctcacgcctgtaatcctagcattttgggaggccgaagtgggcgaatctcctgaggtcaggagttgaagaccagcctggccaacatggtgaaaccctgtctctactaaaaataaaaaattagccgggcatggtagcacatgcctgtaatcccagctacttgggaggctgaggcacgagaattgcttgaacctgggaggcggaggttgcagtgagccgaggttgcagtgagccgaggttgcgccactgcactccagcctgggtgacagagcaagactctgtctcaaaaacaaaaaactaatagtaccgtgcacggggttttgtgatgattaaatacaataatatataaaaaatggttagaacctgactcattgtaagctctcagatgttaatagtaactttatatgatgacttctaattctcagagcttttgcctaagtagtcattttgctggggaggctgaagttcagggagatacaaagtgactttctacaacgtgatgtgctgttatctcactacctaaatatgttttttctgttgatacagtatgaaagaagtaatacttgttcagagttgtccacctctgtttctcataggaatggcaaaagtatatttaaaagggtgagggaggctttagaaagatgctgtacattgatgatggtaataaatattcagcaagcatttgagttcctctggagtgccaggcactgtgttaggagttaaacacggtcctgactttgagttgacaggctagtgagtaaagcagacaggtaaattgatcgaatactcattggtaagtgttatgattaaatgcagatactgtaagaacacataggatgagacttttacccagatattttgggggtgcgttgtggaattgggttagaggaagaggtaaatgtgatacatgaaataattttgctttccttctcaaaaataaaaagattttgaaggaaagtttcaaatgtttggagtctcttaaaatcttcccagggaagttagtaatgatgtctttttttctcattaataaatgtttctgtaggaaatctgttatccacttagttgtgcccatgttggggtttttttttctttttaaaataatgaataaaaacaaggattggcttgcttattagtttacttttcactgttatatgctgtttccaacagaggcttctctttttgttttggcttcctctagaatagaatgtaatttcatagtacctttcttgtcaccaaaaacaaacaacaaacaaaatcctcgaaagccagaaatcaaaggattgcctttttcccccctttgacctaataaaagaatatatttaaatgttaatgtcagaggctagaaaaaaatttcataggagggtcaggtgcaggggcttacttaggcctgtaatcccagcactttgtgaggcttgaggcaggagggttgtttgagcccaggagtttgagatcagcctgggcaacatagcaagaccctgtctctacaaaattttttttagaattagccaggcctggtggcatgtgcctctagtcctggctacttgaagctgaagcaggcagcttactacacccaagaggttgaggctgcagtgaccagtgagctatgattgtgccattgcactctgaacagaggggagaccctgtctcataacattttttttcataggaacttcttggtaattgattttgaggtaggagtgagtgttacactttgtgggtaggataaagaggaaggtcggggtttgtgaggattagctactaattaaccatcaattagtcttgtttctaaaatctcatctgtatgtaaattggcagaggattttttttctttttggtcacataaagctttggagtgtagatgtaatgacatttgagatgtacactgatacaagagattctttattataagcagtggaatttaaaatttgtttcttaattaaccacagaaagcagtctgggtccagagaaaattgcttagatgggtcatcactaagaaaattactgttgttatatatttcctttaatgtctttataaatcctttatgtactaaactttgatggagtctttcatattagcataaagaaaatctgaatctttcttgccactctttccacaaataattttggttttttttttttttttttgagacagagtctcactgtgtcacccaggctggagtgcagtggctcgatctcagctcactgcaacctccttctcctgggctcaggcgatttttgtgccttagtctttcgagtagctgaaattacaggccacgtacagctaattttttttttttttttttgagatggtgtcttactctgtcacccagactggagtgcagtggcgcgatctcggctcactgcaacctccacctgcccggttcaggcaattctcctgcctcagcctcctgagtagctgggactacaggcacgcgccaccaagcccagctaattttttgtatttttagtagagacagggtttcaccatgctgaccaggcttgaactcctgaccttgtgatccgcctgccttggcctcccaaagtgctgtgattacaggagtgagctaccgcacccagccactcccacaatattttattatacagaatttagtatgcaagggttaggaagagggtgtgtgtgtgtgtgtgtgtgtgtgtgtgtgttttagggtgttttatacctcactaggaataaacatctgatattttcctgtaacattaagtaattttttttttaaccttttctctaccctgtcatcctgtagtttaagtaatttcttaggaatcttgcttaaggaaaaaatcccctgaactataaaatcttttctcatagatgtacttgaaggatataatggaacaatatttgcatatggacaaacatcctctgggaagacacacacaatggaggtaacgttttataatctgtacttagatgtggtttgcaatacatacagcattcattatttgtgatattatttcaccatgcataaacattttaatttactctttattgccttttctcatacaaataatatacatgtaacatcattgttggaatctaatcagttcctgagtttaaatagtaagggatacctgtatttgagattatatttgagattgttttatcagttagcataaccataaaataaataacattttagacaagaattttttgtcaccctgttatatgggaaattttgaatgcttatgtgttgttgattttatgtagtataaataactttttcctgttctccttggctcctccttcctcaaaataactgtcactcttctctgataagaatgttgccataattatcagtgctgctgttaataatagatgtggacccactatagctttgcttctagaaaacagcctgtgattttctgccactgctaaagagcatctgtttttatcatttatttgagtgtactatattaagtaaatgactgcttcttttagtgtgattcatattactgattttcataaagtcatagagaacaaggacatcctagtatttgcatgaatttgcctcgaagtagaaggaacaatgtagaattatatggaaagaaactaaaacctttttaattatgttcattttacaatgaacattttacaagcatggataatctaaatctagtgattaaatgaagggttaagatctgttggtaacccatgtggttgatgtacagtactgtgtatgtgtaatagttgaattggattttttaggtatttacagagccgtttccacaaaaatatagttcctgtcctttcttgactataagttgtagattgaaactctttgtttttacttcatattttataatttatttaagaagtctagttttgttttttgtttagggtaaacttcatgatccagaaggcatgggaattattccaagaatagtgcaagatatttttaattatatttactccatggatgaaaatttggaatttcatattaaggtaaattccttgaggaaagattatattttattttacagcaagaataatgttctaaaaaaatagtaaatgctggtttctttaattttaaaaattgtttttctggaaaggtacagttgaaagatcattcaggttagtaaacttggatttttgttcatctgccattagatgaacaggaatgttaactaacgtaaatgattaagtctttagcctccttcaaaaaataaaggaggttgctttactgcagaacttgaaggtttctactacataaaactattctaattcattttagatgaagataatgtaatttatgtccaatgggaagactgcttaaataactaagctaatttggctaatttatgtcttcccattagaatgtgagctatggctggtatgttgataactgtctctctagtctaaacaatgcctagcactcagacctcaatatgcgaataagttatataactttagttgatcggtgtttttttaaatttgccctttaggtttcatattttgaaatatatttggataagataagggacctgttagatggtaagttaaattcttgctaatcagttttaaataacatctgttaattcctttttaataatagatgtgagactatttctttgtaacctatatgaaattgtcttaagttattggaaatagacaaaattttttttcttctaaagttttagttgaatacctttaaatagaataactagtttaaagcgatgtttatgggtacttcttagtagtaattagagcattggactgggagttacataatctgagccctgagttctagtcttctgtcaactgtcaattagatacattgtccttaggcaaatcattgaaccattcagggttaatgttcttgtttataaaatgtgggtggtaggttggagtggtcctaaaattctatattgttgcattggtttctatttacatctcctgctgtgtctgtaaggtctgctttagagcaatgttttaatatgtttttagagttcaactattgctgttaggctgctcaggaaagcctatcagttatttcatatccagtgttaagagttttaggagaatgttgctaacatttgtttttctttctcagtttcaaagaccaacctttcagttcatgaagacaaaaaccgagttccctatgtaaaggtatttatagtacagttgtctagaaaaccctgtaatactttttttttttttttaagacagagtctcactctgtcgcccaggctggagtgcagtggtgcaatctcggctcactgcaacctctgcctccagggttcaagcagttctcctgcctcagcctcttgagtagctgggattacaggcatgcgccaccacgcccagctaatttttgtatttttagtagagacgaagtttcaccatgttggccaggctggtcttgaactcctgacctcgtgatccgcccgcctctgcctcccaaagtgctgggattacaggcgtgagccaattcatttaatatatggaggctcgctctgttgctcaggctggagtgcatggcatggtctcggctcactgcaacctttgcctcccaggctcaagcgattctcctgcctcagcctcccaagtagctaggattacaggcacccgccaccgcgcccggctaatttttgtgtttttattagagaaagggtttcatcatgttggccagacattaacatatttttaaaaattatttcacaggggtgcacagagcgttttgtatgtagtccagatgaagttatggataccatagatgaaggaaaatccaacagacatgtagcagttacaagtaagtagaaaataacactggttaggatttaaaaccagcttaaaatatccttatccaggtgattaattataagattgcttcagggaaattgttaaggggaaatcatgtttgtttatatttgtttgtgtaatttccttgcagatatgaatgaacatagctctaggagtcacagtatatttcttattaatgtcaaacaagagaacacacaaacggaacaaaagctgagtggaaaactttatctggttgatttagctggtagtgaaaaggtaaagtcttcatgtattttgacaaatatttaagcatctttgtaaactttagtttgagttgggagttacgcagggttcattgttgcatcttacttaccaaactggatttggtaacctgagatttgtaaccgctgatgccagtgccttatgatgatatcagctgaataatcagttccaagttactgttgtttgaccatactctagttcaacccataagtggtttctatgacttaagatatgttcatagtgagaactggttcagcatatgttgttataaactttattagatatcccttttctaatttttgatacgtattttatccatattggcagtggggtccctattaaaactggtaactctcgattagtcttttctggtttggttggacttatttctttcctttggattattgtttcattattacaattctatacagtctgattctagtctatatcaaattaagtttgaatgttataatagggacctctgaccatttttgctgttgtgctaattttgtttcttctgcttagaatgatatatctattccgttctactctgaagtcttacacacatctttcaaagattatctaatctgagaaatctcctaagctatttcttcagccaacattgctaatttattgttctgacctatctttaacatagatactagctgggcatggtggcacatgcccgtaataccagctactggggaggctgaggcaggagaattggttgaacccgggaagcggaggttgcagtgagctgggatcaagccactgcactccagcctgggtgacagagtgagactcagtctccaaaaaaaaaacaccacaacatagatatttagatattttatatatttttaaaagaagcagatttgcttatataatgtgtttaaaactcagtctctgttttctaacagttacaacatcaacattatgcattagccaattttagaaggttcctgttttctaatgtagcaaaggggactaacagattaatgaactacaaatttacatttaaattggttattttcaagagtacctacaaactacagataaaatttgatgtctctctaatcaaactcttaagagtagtactcaagaaatggtggtatgcttggcaaataagatcatgaagcttttcatgttcttttttcttttttactggttattgatgacatatgaacattttagaaaatgtaaagaaaattataaacttgtaattttgtttcattcttttgaaatcttatgtataggttagtaaaactggagctgaaggtgctgtgctggatgaagctaaaaacatcaacaagtcactttctgctcttggaaatgttatttctgctttggctgagggtagtgtgagtatacatgtcttctatctccctgttaccttatggggcattatttaaatataggtgtatatgtgtgcctgggtgtgtatgagagagagagagagaaagagagattgagattcaatgtgtttgaatcagtatgtgtaagttagttgtcttttgggagtttattttataataacattttattatactggtcttgttttctttctttgtttttgtatgcagacatatgttccatatcgagatagtaaaatgacaagaatccttcaagattcattaggtggcaactgtagaaccactattgtaatttgctgctctccatcatcatacaatgagtctgaaacaaaatctacactcttatttggccaaaggtttgttgttaagaaagtacaaaacctaaatttagatagaccttttgtttataaaatgtaggaaaatgtgagctgttattccaacctgtacatactgttttgtgctagacacactcagtttgaattgatgacagataatacaaggtgggtctgatttttagactgcttggtttaagttttagtacacattaaagtcagatgtaattttagtcaaatttgtgtgacaagctgtaatttggtattaaagaaaataagcatttgaatcaaataatgaggtcaaagcctggcaaacataatcctctgttaagcctgtagacatgcatgacaggttaatataatctgtatgagatgattaggaaaatcagtaatgatgattccgtctttgactttcaacagtaatttcttaattcagccttgcaaacaaattggaaaaatataggcctttgtcttttatttttagtggtttgttgatttttttttttttaaagctattcacagattttggagcagactcaaatttagttgagttgtaaataacgtcatatgttgcggcttttagtatttagtctaagagattactggacaagcataagtttcttagccatatatacatatattccatatagataaaattaaaaataatttcagtctcatcctttttttcctccaattacatctcttagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggtaataacttaagaatttgtcatcttcagtttgttaaatacagatttagagcatagaaacgtagaaatagttcagcaaaatcagtaagtgactagatcaagaaatttaatagacatcgaaataatttttaaaaaaattaatagaaatcctggagctgaaaaataaaatgagcaaaatgcaagagaccatcagtagtagaattaattaagcagaagaatctgaacttgaagacagattatttgaaaataacacagagaagaaaaagtttgaaagaacgaggctgggtgcactggctcatgcctgtaatcctagcactttgggaggccaaggtgggcagatcacttgaggtcaggagttagagaccagcctggccaacatgttgaaaccccatctctactgaaaacaccaaaattagcctggcatggtgctgagcgcctgtaatcccagctaatcaggagtcttgaggcagtagaattgcttgaaccctggaggcagaggttgcagtgagcctagattgcaccactgcactccagccagggtgacagattgagactctgtctcaaaaaaaaaaaaaaaaatttttaaaggaatgaaattgaaattagctttagacgtcgtttttttattaaccactttattttcttattttaggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggtaggtattgcttgatttaggtctgctttatattaggatactattgacatgggtgtttttattttctaacttttctcatttcagtgctgtgggcacttaggatctttatgcatcttccttgatttctgttaatcttgtaaaaattattgtattaacaaaataaaaagtcataatttcaatttctgtgtggaaactgtatgagcatgtatcttttcttccccctctttttaagctaaaagaactttataaggcagcagtccccaacctttttggcaccagggactggtttcagggaagacagtttttccgtggatcaggtcggggagatggttttgggatgaaacttccaccttggattatcaggcattagattctcataaggatcctctaacctagatctcttgcatgcacagctgataatagagttcgcgctcttaatgatattctaatgctgctgatctggcagaaggcggagctcaagtggtaatgcttgctgctcacctcctgctgtgcttcttggttcctaacaggcttccagtactgctttgtggcctgggggcttggggacccctgttctaatgaaaatttggcattgggtcattgggagcctcaatgataccaattgttagaatcagggctctgaagactccaataaaagatgatgtgagagattaagggaaacacaatagagtggaaataatatcttcctgctttgcatatagaagtaatgtcaatagtatgaataatagcaaactaagaacgtaatagaatggaaggcaagaacaagagtagtaaagagattagaagaaaatattttcttaagttgatatttttaatatattttaagcagagatggcaggttcgaagtacatgaccattataagtattgataattgaaagaaattccttttgttttgccattttcttaaaagagattaaaataagcaatgttgaatttagagaaatggttttgaaatatttctggggagtagtaatcttataacctgtattgggaaacaactagaaccaggttgttagctactggttaaccggatacttcacaattctaggatgaagaaattaaccagcaaagtcaactggtagagaaactgaagacgcaaatgttggatcaggaggaggtgagttgaataccttttacattgcttccagaaaagctttatagttttgttttctgaatcccattgactttgtctttaatagttgtataattttgggtatgactgtctttgtgggaataagaatgtcacatggataaagtgaatttttacttattcatcgtatctacccagatacaatctgttgttcatttccgccatcttttttttcaccctggttcttgacatttctcttcttgtcacttactttggatcctcattttatcttctcacccagcagagcagggggataattgaaaagcagtcctttaaatttttttgtgggggtggtgggcagggtgaagacaaagactgcttcggtaagaaagagatactctccatcagtgaacttaatcctggtcagatcatctttcaactatagcatttcatatttcaactatagcattattcctcaaaggggcactattgatattttgcattggataatttatgttattctgtcctttgtattataggacattaaacattcctggtccctactcctaaatgccattagcattctaccctattattaacactcccacagatttccggatatccctacaggagagccactaatgtggatgattgtggttttctcctaactagtctcttggcatccctgcagttcagattttatgtgctgataccaggttttgtttttgtttttgaggcgaagtcttgctcttgttccccaggctggagtgcagcggcgtgatcttggctcactgcaacctccacctcccaggttcaagcgactcttctgcctcagcctcccgagtagctgggattacaggcgcccgccaccacgcctggctaattttttggtatttttagtagagacgggatttcaccatgttggtcaggctggtctcaaactcctgaccttgtgatccgcccgcctcggcctcccaaaatgctgggattacaggcgtgagccaccccgcctggcccaaatctaaatttttaagcaactcttgtagaatgccattttcctttattacattaatttgcatgtgactgcagtcgatctctcctagccaacttctccatgaatgaatactctttcctgtattactaagcactttatctgtcctgtccctctcttatggttctgaccttctatcttgtactgcacttattcatgtgcctatcttctcttctactgtgttccttaaacacagtctttgattttctttctgccttgcagcatccagcacagtgcctgcacatagttgacatttagtaaatctgtttaatgaataaatgttgccacactgaataccatccatatttcactccatttgttcttgacaaatggtgaagcttcatgggtgttttttaaaacctgtatacttttggggaaaataaattattttctgtcctatagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggtaggatatagttttattttcttttttaatgctttagtacaagtattcttaacctaaaaactacttaaataacttacttttctatgtaagtcaaatatcgataacatcaattttcaaggactcgggtttcaacttcatttctttctgtatatgaagccttagaggtggaggaagacagttattttagttcctaaaggtctgttaatatctaatttaaatgctgttttagaggatgtttgctactcctaattttaatttttttaatttagtatatagcatgtagaatctaatgttactactaatgttaaaggaaaaataatttaaagctgctagttgcccaataaagctattagatgattgttcaaacaataaattaaatatgcagtacaaattaaaatgctatttaatcaactgtgaattatttggaatagatgtaaggatatgtaacttaacataatttatgttttacttactgttacatttccactacgtggaacagtgcctttttagcacagtgtagtggttcccaatagatggagatttttttttttttttttgagacaaagtttcactctggttgcccaggctggagtgcaatggcgcaatcttggctcactgcatcctctgcctcctgggttcaatgattctcctgcctcagtctcccgagtagctgggattacaggcgcccgccaccacgcccggctcattttgtatttttagtagcaacagggtttcaccatgttggccaggctggtctcgagctcctgacctcaggtgatccacccacctcagcctcccaaagtgctgggattacaggcgtgagccaccgtgcctggcgactagatggagatttttacttgctgaaaattgatacaggacagacatcgccaacctccaacaatgatgacagaaataatacatagctatgaatgtttcaacatcatcatggaggagctattttgtggttttgttgtggttaatgctagcttcttgtttagaaatcagcatctagagttgcactcaggacccatgtccaccacttatttccctgctcacattaacttgtctaaaagaaagcagtcaacagtacaaaataatgcttttaaaaggtttcctgcccctatgagttccttttctctttttaatctacaaagttacagttagcttgaagttaacattcagtactgtacagatctaagacaccattataactaactcttactgagttgcattattaacaaagctaattgttgtatgaaagaataacaggagttttttacaactctgaaaggtggtccttggccgctgattttagtctttaagacagttatatttatgtttcacttgtggagctgaaatctatcagcattacattgataataggagttagaaatccctagtgtttagcatctgtttatatgcttagacagtgttgctgttcagttagagagtgtctggtaatttaaacaattatggtagaagcatgctatattatgagacttgaagataattggtatcatattgtagattaacctgggtggatacatactctactgatactcagaaacttaaggaaatgacgaactaccataagaaataagcagttggaatgatggcatctttactaaaagatactgatgaaaagtcaataaatggcattacaaatacagtatagtacaggcattacaaatacagaagccccaagcgtttcagattttggaatgtttgcattatacttaccagttgagcatttctaattggcaagtccaaaatgcttcagtgagcattttctttgagcatcatgcaagcactcaaaaagtcccagattttcgagcacttcggagtggggatgctcaccttgtatctgttctgccatatgagttattttaaagtgggcaccaaactgggttggacttttcaaaatttggtgattttgtagctgttaagccagctatgatttgagatttataatgatagtcattaaactcagataatattactttaacactagctcctggataattgcctgtatcatagtattatcacatggattctttccagtgagtaagtatatagaaagtagatgaagaaagcatactaaccatctagaaaagagtgtcattgtaacgttaatttgctgactcactttctaaagataagacataatatagtaataagtgataatcaaatctagttaaatttgaggcttcccatttttagacagaaaatattattcaatcccaggaatttagtgaaataacagaaactgcctgctcttaattgaaaacaatgtggctacttttaccatagcctattaggtctaaaatatattttaagtttgagctgggagcccagaacctggtagatagttcaagaaaaatgaaagcagaaaagacatggtttcgtaagggcttggtgtaaaacttgaaacaccgatgagtatttgatttgaattttcatgtagtagatttaactatactttttgttttgggttctcttaggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaaggtaaatataataactaagtattaaggacaattatctgtatacactggcacttttgtttactactaatagtttgtaaagttcttttcgtattcatgatctcatcctcacaaacagtcgtgtagtagatgttattaaccgcattttaaatagatcaggagagagcaagagaataagggcacccaaataggtaaattcagtaggcggcatttattggacctcatgtttgattctttactataacattttccccaacctgggcaatgtggcgaaaccctgtctctacaaaaaatacaaaaatgagcctggcatggtggcgtgtgcctgtagtcccagctactggggtgggaggattgcttgagcctgggaggtcaaggctgcagtgagctgcaatcgtgcaactgcactccagcctgcacaacagatcaagatgctgtctccagaaaaaaaaaaaattcgtgcttaaaaattacgttaataaatttccataagtgaaatgattggaacaacaattaagattagttcacggaccagacatagtggctcaagcctgtaatcccagcactttgggaggccaaggcaggaggatcacttgagcccaggagttcgagaccagcctgggcaacgtggcaagaccttgtccctacaaaaaatttaaaaattagcctagcatgtaggcatggtgatacatgcctgtagtcccagctattttaagagactgaggcaggaggttaaagatgctgtgaaccatgtttgtgccatggcactccagcctgagcaacagtgagaccctatctggaaaaaaaaaaaaaaaaaagattagctcagggaataaatttataatgaatgggcttgtggttgctttaaatatttaaagaaaagttaaagatgagcactgctttcttaattcttttttattttagtgtgaaaaatttcaaacatataatagtagagagaataatacaatgaactctagagttttcagttttcaaaatatgtccatattttctttatacctctttgtcctaatctttttaaagatactaatattggttgttagcattaggcatttgacttggtggtagatttaaaaactaagaccaaagaaccaaactaagactcttaactgaaaaaccatgcatataacatgaaagatttgtatgttgcagtagctgtttagactttacctttttgattaaagcctaattacaatacaaagagagcatatacacttgggtttatattgagagcctactaaaaagcccagtctgttaaccagagttggaactgacgtaaaagttttcaatatggagtacacatttccatcttttgtattgtttaatgttgctgtttgctgttaactgattcttcagtttaaaaatgaagaaaaaatatttttaaaaaatacaaaaagaataaaagataaaatcaacaaaataaaagttactgtttgttgatggaggcaaggattctcatgactcttctcttcatatgttatttcttcagtggactcactatggggccacttgacttgctttcccttcaccatcagtctgaacatttcggccctattctgtttatggtgaagtaatgtgagatgtagagaaatctctaggatggaaaagtacatttatttcatatcgcagaacaccagagagatgttgttcaagatttgctttgtagatttgcaactttttagacaaatcttatattttatgttcaaataattatgatttaagttaaaaagtgtaaagagagagtggaaatggtttatgtttagtggcagagggatgaaatccaggttccatgactactagatttttttttccactataccatagcagtttgaaaataagtcgtctttgcaaatagttattctaattaaaaaaaaaaaaggatcctcagtatttttgtcattaacaagtaattcttttcctctcatcatatataagctctgttagagcgttacttttttttttttttttttttttttgagacggaatctcactgtgtctcccaggctggagtgcagtagtgcgatcttggctcactgcaagctccgcctcccgggttcatgccattctcccacctcggcctcccgagtagctaggattacaggcgtgtgccaccacgcctggataattttgtttttgtatttttagtagagatggagtttcaccgtgttagccaggatggtcttgatctcctgacctctttatctgcccacctcggcctcccagagtgctgggattacaggcatgagccactgcgcccggcctgttgttgttcttaagttacagtttacagttttatgttacagtttacaatgattgttgtactcattgtattctatagttgtgtggattttaaggagtgcataatattataggtccggtatttagaatagttcccacaccaccctaacaaattcccagtgtttttgctattcacctctacttcttgaacttctggcaaccactgatgtttttactatctttatagtattgctgtttccaaaatgttatatagttggaatcatacagtatgtatatgtagccctttcagctagtttctttcacttaccagtatgcatttaagattcttccatggcttttcatggcttgatcatttttttaaattactaaattatattccatgatatgaatgtaccatggtttgtttatccattcacctatgtggttactttgaggttttggcaattaatgaacaaagctgctataaacattcatgtgtaggctgagcatggtggctcatgcctgtaatcccagcacttcgggaggccgaggcgggcagatcacttgaggctaggagtttgagaccagcctggccaaagtggtgaagtcccatctctacaaaaaataaaaaaactagccaggcatagtggtgcacgcctatagtcccagctatttgggaggctaaggcacgagaattgcttgagcccaggaagtggaggttgcagtgagccaagatggtaccactgcactccttcctaggtgacagagtgagactctgtctccaaaaaaaataataataattcatgtgtaagttattctttggacataaattttcagttcagttgagtaaaaatacctagaagtgctaggttgtacgttatgactatgttagctttgtaaggaactcccaaatggtcttccaaagtggtggaaacattttgcattcctatcagccatgaatgagagtctgctgttccacatcattgccagtgtttgctcttgtcagtttcttgggattttactaatgtatggtgttattttattgtcattttaatttgcagttgtgttttttcttattgttgaggttttctttttctttgagacggagtctcgctctgtcacccaggctggagtgcagtggcgtgattttggcccaccataacctccgcctcctgggttcaagtgattcttctgcctcagcctgccaaatagctgggaacacaggcgcgtaccaccacgcctggttaatttttatatttttagtagagatgggatttcaccatattgtccaggctggtttcgaactcctgactacaggtggtccgcctgcctcagcctcccaaagtgctggtactacaggcatgagccactgcgcctggccctgttgttgagttttgttttgttttattttgagatggagtctcgctctgtcgcctaggttggagtgcagtggcatgatctcggctcactgcaagctcctcttcctgggttcaagcaattcttctgcctcagcctcccgagtagctgggactacaggctcccactaccacacctggctaattttttgtatttttagtagcaactgggtttcgccatattggccaggctggtcttgaactcctgacctcaggtgatctgcccgcgtcagcctcccaaattgctgggattacaggcgtgagccaccgtacctggcctcctattgttgagttttaagagttcttcggccgggcgcggtggctcacgcctgtaatcccagcactttgggaggccgaggcgggcggatcacgaggtcaggagatcaagaccatcctggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaagagttcttcatatgttttggatataagtcttttatcagatagtgttttgcattatttctctgtgtcttgtttttttttttttgttttttttttttactctcaacgtcattttttgagactaaaaatttttaattttaatgaggtccaacttaccaagttttacattaatagattgtgtttttggtattgtatttaaaaacttgtcaccaaacccaatatcacctagattttctcctgtgttaaaagtttttttttcagttttgcatttacatttagatctatgatccatttggagttaatttttctgaaaggggtaaggtgtgtaccaggattcattgtttcacatctggatgtccagttgaagagactgtcctccctccattaaattgcctttgcacctttgtcagagatcagttgactgtattttgtggttttattcctgggctctttattctgttctgttaacctgtttatctgttctttgccagcactgtactgttttgattattatagctttacagtaagttgcatagtgtcaagtcctgtgactttgtttgtccttagtgttgtgctagctattcagggtcttttgactttacatgtaaacttaatcatgtcatctgcacagttttatttcttcctgaaggtgaaggaatatacagtgaccacaattccttctggttgagcttaaagttcatcctttccctgccacctaaacatcctcttgttaaattttaagctgaacgtgcacatgattaacaatgaatttactgaagaggtcctgtaaagaggaagtgaaaaaattgaaagaggcagaatttattagtttggttgtatttttgtgttttctttaggtttacatttatttatttttcttgttggcatgtattaacattattctcagtttttaaaaaaaggaaggcaaaaagtaagctgtatttatttacctttcgttgaaaacagtaataaaagaaaaaaataagatccagactttgtatgaatattgagtaatactaaaatatattttataaaaagattttatagcctaattgggaaaacacacattgaacatttttggctttaattttttattttactttttccttacagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaagtatgttatagaacaaagtttattcatttttttgaaacagccacatagaaattttatttattatacaagttttcagaaaaatgtgtgtctataggtgaaatttagttgtttttttcctagtctagctgcagtaaatttgaatgatttaactgagttatatttgcctaacataaatatgggttatgtatagaaatttaccagaatgatgtgactggtggtaacttgttaaagacttcagaattccagggtgggcaaaactgcagggaaccagtttcctggcttggcaactgaatgaatggggccattcaccactatcagaatttcacaaggagggaagatggtaacgttagatggtggtatctgtaaaattagtatttcatatttgagtcttcagtgccttagtttgcaagttatgatcaccaatgaattaattgattacattctttaacatttcaaaattggctcctgaatattttagttttaaatattcccaaatttatcatatatagataatgaaatgtttactgtcaaatattcttaaagtgtatgcatatgttttccacttcatatcagtatattttttccaaaagcatgaagccaaaatcaagtcattgactgaataccttcaaaatgtggaacaaaagaaaagacagttggaggaatctgtcgatgccctcagtgaagaactagtccagcttcgagcacaaggtatagcttccaactgtttatgagttacatctgtgttcttattttagtataattgtagtaaacttaatattcacactgaaagaaatagtaggaatatggctgatttcgaatggtaaacaaatcatacatattaatgttgctttgaaacatttttttgttgttgttttgagacggcgtcttcactctgttgcccaggctggagtgcagtggcactatcttgactcactgcaacctccacctcctgggttccagtgattctcctgctgcagcctccctagtagctaggaccacaggcacatgcccccacgcctggctaattttttaccttttttgtagagacagggcttcaccgtgttacgcaggatggtcttgatctcctgacctcgtgatctgcctgccttggcctcccaaagtgctgggattacaggcatgagccactgtgcctgtcaaaacatatatatatatatttttaagattttgtttgaatatggaaatagccaatctggggatttcccacagttacgaagcggggtgtgtgtgtgtgtgtgtcttaacataggggacttaggagttatctcatttctttaccattcccttaactaatctgttctggattaggccaaaaaaaaaaaaaccaaacaaaccataaaggaatacataataccaacacaatggatgtaacttgtatactagtctacatgtcattgaacttggagagcaggtgacatttgggtaatttgaagttgaatattgctaaggaaaatgcttattgtaaaatccatttgctccttggtttatatgaggaaccttaaaggcttatttcactcttctattttctctctattcaaacagagaaagtccatgaaatggaaaaggagcacttaaataaggttcagactgcaaatgaagttaaggcaagtttgatgtcacatttctaacagctttaattaatcagtattaattttgattagtctgactttaacatccttttcccccccaaaattttagcaagctgttgaacagcagatccagagccatagagaaactcatcaaaaacagatcagtagtttgagagatgaagtagaagcaaaagcaaaacttattactgatcttcaagagtaagtattatacttctctagttaggaggaaagaatcggttactgatggtcatggtatatattcttattagaaacctgcagttttcatcaaaattacatttttatcttggaaaataaagaattttctcatttatgagtaaaacttctaaattccaggtgaaatttttgaggcttttttttaggtcttttgatctaaattattcagtaaaagaaaaaaatccccaacctaagtctattattgcataccacagtcttctccaaatcctttatttagtttccttttttaaaaaaattcttggctgggtgcagtggctgatggcctgtgaccccagtgctttgggaggctggggtgggaggatcactagaagtcaggagttcaagaccagctgggcaacatagtgagactccatctctacaaaaaataattttttaaattagctgagcttggtggcacatgcctgtagtcccagtgacccaggaggctgtggcacgaggattgcttgagtattggaatctgaggctgaagtgagctatgattgtactacagcctgggtgacagagcgagaccctgactcaaaattcttaactgggaaaaacttttctggaaattctatggattttcaaaggtttttttttttttaagttgtcatcttagtttatctagaagcaatttccctgcctccataaccatgtgcacatacatagagtttatggaagtcagagtttgcaacaatttgagtaggaaccaagaagagaataacataacaaaataatgatgaggtttggggcgtaggtcttactatgaatacctgatggaagtaggcataaggattcaggaagatgaaagacagaggagaacagaatcatgatttcaaaccaaaatacgaaaaattttgtatgtccacaagtagccaggtccctttcctcttttcctccatagggtataggataacagaaaagtccttgatgagattatagaatttaaaagtttggaaattttaatgatgacattgagaaaactgtgatattgatactgtgttaattatttttttctttcgtcagccaaaaccagaaaatgatgttagagcaggaacgtctaagagtagaacatgagaagttgaaagccacagatcaggaaaagagcagaaaactacatgaacttacgtgagtaattgtttttaattaaagtttaaaaataaaagctaaattagaggattataggcattacctttggatatagccagtggatacatattttactttgtatgggctaaaggattttttcttaaatccactgagttggtttgatttatatctaaatacttggaatatatacttgcatttgagtgaaagcaaggtcttatatttcattgtggttaagattaaggtttctctttattaatctgcttgctgtttctttatctccatattacttcaggatccagcataaaaatgaacctaaaacaatatattaagtaacttcgaagattttaagatctaacacaaaaactgagtttttgttaaattttctcttgcataaaagagcattgtggtgtttagccttgccattttgaacagaggttttcatggtttaccttttctcattttctcaaaactcagttttctagaatcttagcaggtagaaagtgcatgattataatttttcacataccttgagtttgtgagacaatttgcaaatcaactgatattgttaggatagttagaacatcaggaccagttcagagtggattatatgaagattctgctaacttgcagctgtaattttgtttagaatacttgtaatgtaaaatattttagtctttgacagtttataatctataattaatcagtatcattttggataaatagcagtataatacatgtggcatattttaaaatataaattatagaactattccttattctttgaattctgccacattttatttcatctcttccattgctatatatggaatgtataacaatagactgttgtttagaaggcatatgaaaattttttgaaattgcaaagctgcagtggctcacacccataatctcagcactttgggaggccagggcaggagaatcagttgagcccagtgtttgagaatcagcctaggcaatatagtgagaccccgtctctacaaaaatttttttagacagggctgattgtacatgcctgtagtcccagctatttgggagacgaggtgaggaggatcacttgagcccaggaggttgaggttgcagtgagcagtgtttgggacagaaactctgtgtcaaaaaaaaaaaaattttttttttgaaagacagcacaggtaaattgtttaaaataggcatcttgtatttatttaaatttaagaatttatcctttcagacacaaaatattttattcaactctcatgctaagtacaatatacagaataaaatttgaaaatatatgtttgttcttctactgttagggttatgcaagatagacgagaacaagcaagacaagacttgaagggtttggaagagacagtggtaagaaaaacatgaaaataaacaggattgggaaatattttgtgggttttttctaccatgattattctaaatttaaagtctgagctccaaaaatatcgctgttcttaatccaaggcaaaagaacttcagactttacacaacctgcgcaaactctttgttcaggacctggctacaagagttaaaaaggtaatgtaactatgccgaggtaggcgtttgcataaatggtgcttacttctaggtaattatttgtattcaaagtgaaataactttacagtcacgtcaatttttgtatagttaagcttagttttttttaatttttttgtaatacttaccttcttttctcagagtgctgagattgattctgatgacaccggaggcagcgctgctcagaagcaaaaaatctcctttcttgaaaataatcttgaacagctcactaaagtgcacaaacaggtactaaagagtatattttctggtagctgcaagatagtaaaaatcaaaaattgaggattggcaagtgagtatttcaatctttcagagtcctcaggaatttttataccctgagccattttatcagaaattatataaagaaaccataagtaacttttagaggagttaatatttttaacaacgttattatcaaaagaggcagtgaaaacatgtattctcattttccctttaggattttaagactgtgcattttcataatttattcatggtaattttgaaatctctactacacaagactgcagttaaagtactgcaaagtcttttggggagagtggtctttttatacctaataccccagtgtgtcagacataatgacgcagttttcatttaaccagattagttgtcttactgaagaaacatagcactatcttgtaatgtattgtctttgcctagtagagggaaagaacaattctccccctaaaaaattaaaggaaattatacctttgtgaataaactagatgtgtgcacgctatgtatagatggatgtattccttgcgtgtttctgcctaaattagataaatgggaaacaatataaaatgcagttttacttttctaaagagcaattatgaaatgctcatactttttcaagtcatcctgttaaatctggaatccttgttttctttgtgtacgtttagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattggttagtagaacacattaaaacctttaaaccttgctcaatttgaatgctttcatttagtggaaaacgtaatccgaattttatgtgttgtcatggtgcatctgtctctattttctaacttagcagagtggcactgttgggaaagaggaataatcacattagcagaaaaagaagataaatgagaactagagaagcaagcaagaatggtcatggaatggagaaactatatagagcaatattattaaagccaagagaattgcaagaaaataagccatcagcaatgatttaacgtttaagaataatcattggtggctgggcgcagcggctcacgcctgtaatcccaacactttgggaggtcgaggcgggtggatcacctgaggtcagaagttcgagaccagcctaacatggtgaaaccctgtctctactaaataaaaaaaattagccaggcatggtggtgaacgcctgtaacccagcaacttgggaggctgaggcaggagaatcgctggaacctgggaagtggagattgcaatgagccgagattgcaatgagccaagattgcaccattgcactccggcctgggtgacgagcgagactccatctcaaaaaacaaacaaacaaacaaacaaaaattggtgcaggaagtgttttttttgtgttttatttatttatttattttttgcttgttttttgagatggagtttcactcttgttgcacaggctggagtgcaatggcgtgatctcggctcactgcaacctctgcctcctgggttcaagcgattctcctgcctcagcctccctagtagctgggattgaaggtgcaagccaccatgcccagctaattttgtatttttagtagagacagggtttctccttgttggtcaggctggtctcgtactcctgacctcagatgatccacctgcctcggcctcccaaagtgctgggattacaggcatgagccactgcccagccattttttttgtttgtttgtttgcttgttttttatgacacagggtcttgcttgtcacccatgctagactgcagtggtgcaattatggctcactgcagccccagcctcccagggtcatgcaatcctcccacctcagccttccaagtagctgggactacaggtgcacgccaccacacctagctaatttttttatattctgtagagacagggttttgccttattgcctagtctggtcttgaattcctggacccaaatgatccacccacctcaggctctcaaagtgctgggattacacaggtatgagccactacgcctggccaggaagatttttaaaggctaagaattgtataggtcctagagaaaaggatgttacagaaaagaaaaagtgatggagaaacaaaaaggcaaagaaaaacaaaacatttgggaatttgttgtgaataagagaagaaaccttaacagtcattgcagtcacatcttaaactttattctaaagtctgtctttatttttcatattagctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtttgttatttatatctggcttttcatatctgtttgtggaaaattggttgttaaataggttttttggttttaaaaaattctcacattagtgttatgatttttttaacttaagcattataaaagtaatttagtttgatctttttgtgtagtttagatcatactatatattcaaatttgtggtcttaattgttttgaaatctagcattggaccatttgtaatagcttttgatactgtgtctaatggatgtaccatggtttataaacattcctttccttttggctagacatgtaattatattaattttttccataattgaaattttcaaaaaccaaaattttcatatatgaaatttgaaacatctttttttttttttctttttctttttgagatggaatctcactcttgtcgcccagcctggagtgcaatggcgtgatctcagctcactgcaacctctggctcctgggttcaagcgatacccctgcctcagcctcccaaactgggattacaggcgcctgccaccatgcctggctaatttttgtgtttttagtagagacgaggggtttcaccatgttggtcaggctggtctcaaactcctgacttcaggcgatctgcccgcctcggcctcccaaagtgctggaattagaggcgtgagccaccgcgcccgacctgaaacatctccttgtattccctaacctgttagagattatttccagaaggttcccagaaatgcaattacaaggaaatatgaacatttttaaggctcttgctacatattaacacattggtttctagaaagactgcaccaaattgcttatgagcccagcttactaacagatttctgagttttatttataattatataagtaatatctgttctttgtagggcataaaacagtcacaaattagaaaaaatctagagatactacacaatatactatctctctctctctctctctctttctggagctttctgtattagtttttaaatttaaaagtttaaactgttgataactattgtaatagactccacttattctactacatatgctgcttcggagcctgcttttttttccggccccctgcccccacaaaccccacacccccctgccccactccgagacggagcctcgttcttgttgcccaggctgacatgcagtggggtgatcttggctcaccgcaacctctgcttcccaggttgaagcgattctcctgcctcagcctcccaagtagctgggattacaggcgtgcaccaccacaccggctaattttgtattttgtagcctgctttttaaacttagcaatatattcggaacactttcttctacaacgtgattggttagtggttgcctaataattggtcatatagcagcaactctgattgtaactaactcttcaggaagtccctgatgtgtgtatgtgctttggaaataaaaaatactagataattatgaaatgatcagctgtttctgacaaatactaaagctagtttattttaatgttgcttgtttatacttcgacattttgcataatactggctctaagttgagtagagaattaagaaatattctgaaggattcacatttctagcaattttaaacgttttgttcacacaatgtaggatttaaaacagtggtagagtgaaaagaacagggactatggagttccatccaagttggaatcctgactacttttatgaacttgagcagataaactttttaatagtttttttctcattctgacttgttttacagtacttcataaaaattatggatttattgcttaactatttaatgaatctctaaaataacatttttctacatagccacaatattatcacacccagtaagattatatttttaatattatttaataccattccatattcagatttttccaatttctttttcactatcctgtacagctggtttgtctaaaccagagtacaattcaggactgctgtttgcgtttagttttatcccttaaatctcttctgatcttgaatgagcaccctctttagtgatattgacttactgagtaggcccagttatcttgagggtataacacctgtgtctgattgtttttatgtgtagtcaccttgttctccctctatttctatgcaaaagcattgattagactcagcataaacatttttgacaaagttatgtcatagataatatgtacttaatatcagtagacatacaatagctggttttcatgataattagagataactcctgtgtttttcccctttggactcatagcagttttattagtaaaatggaagtcattcttaagaattacatgagttggccgggagcagtggctcacacctgtaatcccagcacttgggaggctgaggtgggtgggtcacctcaggtcaggagttcgagaccagcctgaccaacacggagaaaccctgcctctactaaaaatacaaaatcagcagggcgtggtggcacatgcctgtaatcccagctactcgggaggctggggcaggagaatcgcttgaacccaggaggcggagtttgcagtgatccgagatcgtggcattgcactccagcctgggcaacaagagcaaaactccgtctcaaaaaaaaaaaaaaaaaaattacatgagttaagatgttacccagcacacagtattcagtagatgcaagccttttcctacctttctggaagtgggagctgggcaaggggattttcaaagcatagatagaaagtttatcctttttggatattgtcctcacattaaaattcatatgtcaactttaaacttacctcattgtagagagaggacagaccatacttttgttaactattgctgatagcagtaaagtgacaccaggttagcacataagggagggagctaacccagccaaactaggttttcaagacttgaaagttatgatgtaaaaatacaattatttacaggtttgttttgatgctggtccaaagatagtggttcttagttttcaaactcttataatctatcttaaaccatgattggggagtatatgattcacttaagtgataaattgtttaaatgttaaataatttgcactggagtgcagtggcaggatctcggctcactgcaacctctgcttcccgggttcaagcagttctccctgcctcaccctcccgagtagctgggattacaggcgcccactaccacgcccgcctaaggtttttgtatttttactagagacggggttttgccatgttggccaggctggtattgaactcctgaccgcaggtgatctgcctccctcagcctcccaaagtgctcagattacaggtgtgagccactgtgcccggcgagaaatttttttaatgttaagaaaaacatttcaagtcactgtgtttatttttggaaaggatgacatttataatactgatacttttagttcccagttttacatgactagtcttctgccttgcatagtactttaaataggttgcttttctaaatgcataggtaagtaggcagtttaatactactagaattatttatttcactgttacttttcctactgtatacacctcttgtttatccctattcctctcccccttttttttttaaagcttctatgtatataactagtagttgctggttagtgttccttggtttaagaaggtcactgaccactgtctgctggttaaaagattagccgtctttttcttttttaaacaaatacaattcataaatcagcttacccatagctttatttgggagaataaaaacaaagggagggctgacctccctttaaacattactgcttctaaacagttctacttaggtagtatataaaaggaaaccaaatcatttaatattgccatccttctaattttggggaaagtagccacagatgttggctaaaatgtttataataaactgttggcatattttattttgttttattcttcatgattatctcaaacaccaattttgtaaaactaaacatatttactctatgctttctcccatttttaggtgttaaaaagtaatcgaagtacgaagaggacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagct

SEQ ID NO: 36040 - DNA, 7060 bp, Homo sapiens
gtcatctggccagcccccgcccctcctcccggcgtcagcccgccagaggccgcgcggggcccgggcttcggccgatcagcccgggaggccccgccgcgcccccttggcccgcgcgcccgtggtcacagtggaagaggcgcccgcgctgcgctgcccggaggagccgtcgcgcgcccgcttcctgttcggctggttcctgccagctcgaggacaaaacacgcgtgcgcgcggcgggcgagcgcgctcgccgcctcagtcgccagcgccgggcgcagtccgcctttttccggagcagactggccgcggtgctagtcggtagcagcggccgccgcagcggctccgcactggcgaaccgagggcagaaaaaggcggggttgacggctttttggtaggagtgggctggaccggacgccagagacaaaggctcccaaggcaagagggactgtggccctgcgtcggctctgctcgggactgctgaccccaggaatttacgccccttcgtttttctcttctgattcttctcttctcccaagcccgcgtcccctcacgcgtggcctctctccttgccgggagggccgcgatggaggtcccgcccaggctttcccatgtgccgccgccattgttcccctccgctcccgctactttagcctcccgcagcctctcccattggcggccgcggccgccgcggcagctagccccgctcctcccttcgctcgctcccagctccgcccggcagggggcgcgccgggcccagcgccacgtcaccgcccagcagccctcccgattggcgggcggggcggctataaagggagggcgcaggcggcgcccggatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacgggtaccgcacgcttcttcccccgctccccctcccccagcgcgccgcacgcgcccttcgttcctcgtgagccgcgcgctgcccccattctttctcagagtcgattccccgcgtgccttctgggccccactagattggagggaagaggaaagtaagagatcgagggggtgactggagagacccgggaagagtgggggaagggcggaggggttggaggaggagggcggcggcgtctgtgtcccgagcgcgcaggcgccgcgtgggacccgggggggaggggccggcctcccagcgctgcacgctgcagctgccgccgcctcttcattgtgtctctgttaccactcggcgcggttttcctgggaagagttttagaggactgagttggggcacaagcaggcgactggtacccagattcacaaaacgtgttatgattgatgagttctctgggtggaacgttggcttgacagctgagaacgaagatggacctaagtaagataagatgtgagggattcatctaggaagttgtgccttctacctaaaggaatctgggcagaacctttactgtattttattggtctcttttgagctttgctttatgtagtgcggacagtgagctgtccgctggtttgagtaacttcgttgggatattgggatttttgtgtgacatagattaaatgtaaacatgaattaaattgcctacacttagggggtaaatgtccctgtttttatttcacgatttaattccagaactgaaggatcatttgagttattgttaattttttttaaaaacacttttatttctagtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggtaggaactatgttttgcattgtgctgcttttgtggtgttttgcaaatttttctgggggttatatggtgctgtcagattaaataaatctgtcttgtaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagaggtgtgtgattatgtttacacatgttaagcttgatgtgtttataaaatgttcaatccttgtccgatttatgcagggcagattcatgtttcctgtaagagtagaattaaatgactgctcaagtcgcttccagtgactgtaccttgatttcattgctgctctgatggaaacccaactatctaatttagctaaaacatgggcacttaaatgtggtcagtgtttggacttgttaactagtggcatctttgggtacaaaataatattaatttctctcaatgcttcaaatatacaacaaatcactgtaggctgatgttgatcataaagcagtgatgtctgtatagaagtcacccgataagaataacatgtttaagttgaagcctgaaaaggcctttggcattctgacactgtaacgttttacaattatgggatgacgttgagtgtgcatctcgatttcagattgaaaatattgaacttcccatggatacaaaaacaaatgaaagaagaggattttgttttatcacatatactgatgaagagccagtaaaaaaattgttagaaagcagataccatcaaattggttctgggaaggtaaagccatttaagcactttaaatgaaaatttaaataattgaaataatttcttgatgtggagaaaaataaaatgatttaattttagaacttcggtaaaaattatactttcatgttttttgtttatagtgtgaaatcaaagttgcacaacccaaagaggtatataggcagcaacagcaacaacaaaaaggtggaagaggtgctgcagctggtggacgaggtggtacgaggggtcgtggccgaggtgagacttaattcttgaaatatgactccgtggtttatttaagctgtatactgctgaatatgagtagtcctgtaccaaagcaaaactttaaacttaaaaccattccagcggaggggggactgttcagcttagtggaggttgtgtgtggtggttttttgttgtgagctcactggtttcaaaaaactgttaaaagtgtggccactttgacaattagtgtcatcactgataggaaaagtgtaccattacatgatacaccgtggtgtgataggttttcttgggcaggagtccttgttttaaacagaacagtgtacctgtcttcggctttaatggaaaattgaatgattttccattaagtttaggaagtttgatactggcacaattggactttctgcctccttttttataacagctggaaaaatagtttttcaagcagatagcaatatatatgtccattctgccctttaagatttgcagagtgagagacaagaacgcatcattttatgttagaattgggggtcagaagttgtttcctaacaatcattgtgcattgtttcaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggtaagaatatttaacttaattttataaagcagtggtattaaaattcattgttaacatacaatcctgttctgaaattgtgtgtatgggctttccattaaagtgttcggagttaagtgtttgaggcatgttacaatcataggatgattatactaacatagactggtggttataaatgaactaggatgtatgatttatgagtagcatctaatgggtgctaaaatatcttaatactttttatttagcatgcaaagatttgtagatttaatagtttgtgtttgtaaagaaagttttgtagaaaactatcttaatgagaattctgtgttttcaaaataggccaacagagcacttatggcaaggcatctcgagggggtggcaatcaccaaaacaattaccagccatactaaaggagaacattggagaaaacaggtgtgtataagagtacaggaaaacagtagaaatgtctaatttaatttaaagatcaatagacaaatgaaacgtaaaaacaaaatactatgtagcctgtttttactaaattgttgattttttaattgctttatgagcctgttttgcctaaagtgtctatagatctttaactttaaagtcttatctcactttctttagtattgcagaaaaacttaagagtttttctgtttgcttttgtgtaccaggtggtctagaggaataattaaacattttagaactattaacaggtaaagtactgaaatgggtacaacttaaggaaaacaagaatgttgtcttctaactctgacattataccttgtttgtacccgccagcgggaacttcattgcaggccgtgtgtcaccctgaccacgtctatctctgggggtcgcacgttgcgggcagagcgcaaggcatacaccagaaaacgctgtcctgtggtatggtctcttccaacttcatgtaccagcgtaaagattaaagtggaaaacttcagactttggcttcatttttaatctttttggagattaagtgtctaaacttaacttaaatggttttttacaggagttaaagtacataaatgcctttttacagcttaatcattttggtcttctgtttagtgttgtatttcaattgtggagcctcattttaagtgttcattcttttaagatttaatgcttgctttttctttttatagctaatagtgaaatctacaaaccaaaacaagaacttttaaatctgggatataaattaaagatcatatgcacagatcaatttatgttcttgtaataaacttattagaaattggtgtttgtgatagcattttacttgggttactagagatgcttctagtagaccttaatctagcatagttgaacctctgaatatgggaaggttgtattcccagattctttcctgaatagatttgaatttaatgtcatttgggaactccagggtgagtttattgactacccaaactgtattttaccaataaatatgcatatgatctttaattattgaagaaaataaagtgaggacttaaaacaattcatgaaagtggacctttaaaagcttgtcagagttgcacaaatctaactggtattttgtttttgtttttaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtcctttgctatctgtgttatgactcaatgtggatttgtttatacacattttatttgtatcatttcatgttaaacctcaaataaatgcttccttatgtgattgcttttctgcgtcaggtactacatagctctgtaaaaaatgtaatttaaaataagcaataattaaggcacagttgattttgtagagtattggtccatacagagaaactgtggtcctttataaatagccagccagcgtcaccctcttctccaatttgtaggtgtattttatgctcttaaggcttcatcttctccctgtaactgagatttctaccacacctttgaacaatgttctttcccttctggttatctgaagactgtcctgaaaggaagacataagtgttgtgattagtagaagctttctagtagaccatatttcttctggattgtaataaaattgttagtagctccttttactttgttcctgtctctggaaagccatttttgaattgctgattactttggctttaatcagtggtcacctagaaaaagctttgtaatcataacacaatgagtaattcttgataaaagttcagatacaaaaggagcactgtaaaactggtaggagctatggtttaagagcattggaagtagttacaactcaaggattttggtagaaaggtatgagtttggtcgaaaaattaaaatagtggcaaaataagatttagttgtgttttctcagagccgccacaagattgaacaaaatgttttctgtttgggcatcctgaggaagttgtattagctgttaatgctctgtgagtttagaaaaagtcttgatagtaaatctagtttttgacacagtgcatgaactaagtagttaaatatttacatattcagaaaggaatagtggaaaaggtatcttggttatgacaaagtcattacaaatgtgactaagtcattacaaatgtgactgagtcattacagtggaccctctgggtgcattgaaaagaatccgttttatatccaggtttcagaggacctggaataataaaaagctttggattttgcattcagtgtagttggattttgggaccttggcctcagtgttatttactgggattggcatacgtgttcacaggcagagtagttgatctcacacaacgggtgatctcacaaaactggtaagtttcttatgctcatgagccctccctttttttttttaatttggtgcctgcaactttcttaacaatgattctacttcctgggctatcacattataatgctcttggcctcttttttgctgctgttttgctattcttaaacttaggccaagtaccaatgttggctgttagaagggattctgttcattcaacatgcaactttagggaatggaagtaagttcatttttaagttgtgttgtcagtaggtgcggtgtctagggtagtgaatcctgtaagttcaaatttatgattaggtgacgagttgacattgagattgtccttttccctgatcaaaaaatgaataaagcctttttaaac
